(12) United States Patent
Gross et al.

(10) Patent No.: US 11,725,251 B2
(45) Date of Patent: *Aug. 15, 2023

(54) METHYLATION MARKERS AND TARGETED METHYLATION PROBE PANEL

(71) Applicant: GRAIL, LLC, Menlo Park, CA (US)

(72) Inventors: Samuel S. Gross, Menlo Park, CA (US); Oliver Claude Venn, Menlo Park, CA (US); Seyedmehdi Shojaee, Menlo Park, CA (US); John Beausang, Menlo Park, CA (US); Arash Jamshidi, Menlo Park, CA (US)

(73) Assignee: GRAIL, LLC, Menlo Park, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/069,502

(22) Filed: Dec. 21, 2022

(65) Prior Publication Data

US 2023/0140937 A1 May 11, 2023

Related U.S. Application Data

(63) Continuation of application No. 17/832,375, filed on Jun. 3, 2022, which is a continuation of application
(Continued)

(51) Int. Cl.
| | | |
|---|---|---|
| *C12Q 1/6886* | (2018.01) | |
| *C12Q 1/6869* | (2018.01) | |
| *G16B 30/10* | (2019.01) | |
| *G16B 5/00* | (2019.01) | |
| *G16B 40/00* | (2019.01) | |

(Continued)

(52) U.S. Cl.
CPC ......... *C12Q 1/6886* (2013.01); *C12Q 1/6869* (2013.01); *C12Q 2600/154* (2013.01); *G16B 5/00* (2019.02); *G16B 20/00* (2019.02); *G16B 25/20* (2019.02); *G16B 30/10* (2019.02); *G16B 40/00* (2019.02); *G16B 40/20* (2019.02)

(58) Field of Classification Search
None
See application file for complete search history.

(56) References Cited

U.S. PATENT DOCUMENTS

| | | | |
|---|---|---|---|
| 6,773,897 B2 | 8/2004 | Herman et al. | |
| 6,773,987 B1 | 8/2004 | Rahim et al. | |
| (Continued) | | | |

FOREIGN PATENT DOCUMENTS

| | | |
|---|---|---|
| CA | 3008623 | 6/2017 |
| EP | 1309728 A2 | 5/2003 |
| (Continued) | | |

OTHER PUBLICATIONS

A Guide to Reference Genome Selection, Oxford Genomics Centre, pp. 1-4, published Mar. 7, 2017. Retrieved from the internet: <URL: https://www.well.ox.ac.uk/ogc/guide-reference-genome-selection/> [retrieved on Apr. 12, 2022].
(Continued)

*Primary Examiner* — Xiaoyun R Xu
(74) *Attorney, Agent, or Firm* — Greenberg Traurig, LLP

(57) ABSTRACT

The present description provides a cancer assay panel for targeted detection of cancer-specific methylation patterns. Further provided herein are methods of designing, making, and using the cancer assay panel for the diagnosis of cancer.

19 Claims, 29 Drawing Sheets

Specification includes a Sequence Listing.

Related U.S. Application Data

No. 17/214,190, filed on Mar. 26, 2021, now Pat. No. 11,410,750, which is a continuation of application No. PCT/US2019/053509, filed on Sep. 27, 2019.

(60) Provisional application No. 62/737,836, filed on Sep. 27, 2018.

(51) Int. Cl.
  *G16B 25/20* (2019.01)
  *G16B 20/00* (2019.01)
  *G16B 40/20* (2019.01)

(56) References Cited

U.S. PATENT DOCUMENTS

| | | |
|---|---|---|
| 7,041,455 B2 | 5/2006 | Magness et al. |
| 7,371,526 B2 | 5/2008 | Zon et al. |
| 7,413,855 B2 | 8/2008 | Bergmann et al. |
| 7,655,399 B2 | 2/2010 | Cantor et al. |
| 7,700,282 B2 | 4/2010 | Tetzner et al. |
| 7,700,324 B1 | 4/2010 | Issa et al. |
| 7,749,702 B2 | 7/2010 | Lofton-Day |
| 7,785,798 B2 | 8/2010 | Cantor et al. |
| 7,899,626 B2 | 3/2011 | Kruglyak et al. |
| 8,076,063 B2 | 12/2011 | Fan et al. |
| 8,133,986 B2 | 3/2012 | Issa et al. |
| 8,137,937 B2 | 3/2012 | Markert-Hahn |
| 8,143,001 B2 | 3/2012 | Kum et al. |
| 8,150,626 B2 | 4/2012 | Fan et al. |
| 8,318,433 B2 | 11/2012 | Brenner |
| 8,318,460 B2 | 11/2012 | Cantor et al. |
| 8,415,100 B2 | 4/2013 | Markowitz et al. |
| 8,455,190 B2 | 6/2013 | Makrigiorgos |
| 8,481,292 B2 | 7/2013 | Casbon et al. |
| 8,486,634 B2 | 7/2013 | Lim et al. |
| 8,541,207 B2 | 9/2013 | Kester |
| 8,586,310 B2 | 11/2013 | Mitra et al. |
| 8,673,555 B2 | 3/2014 | Taylor et al. |
| 8,728,764 B2 | 5/2014 | Boutell |
| 8,741,567 B2 | 6/2014 | He |
| 8,771,939 B2 | 7/2014 | Tetzner et al. |
| 8,822,155 B2 | 9/2014 | Sukumar et al. |
| 8,865,410 B2 | 10/2014 | Shendure et al. |
| 8,880,350 B2 | 11/2014 | Von Hoff et al. |
| 8,900,829 B2 | 12/2014 | Distler et al. |
| 8,927,209 B2 | 1/2015 | Hamamoto et al. |
| 9,040,239 B1 | 5/2015 | Zheng et al. |
| 9,115,386 B2 | 8/2015 | Rao et al. |
| 9,121,061 B2 | 9/2015 | Vaisvila et al. |
| 9,121,069 B2 | 9/2015 | Lo et al. |
| 9,128,086 B2 | 9/2015 | Bawden et al. |
| 9,183,349 B2 | 11/2015 | Kupershmidt et al. |
| 9,200,260 B2 | 12/2015 | Correa et al. |
| 9,222,937 B2 | 12/2015 | Micallef |
| 9,260,745 B2 | 2/2016 | Rava et al. |
| 9,267,117 B2 | 2/2016 | Guan et al. |
| 9,290,803 B2 | 3/2016 | Laird et al. |
| 9,290,807 B2 | 3/2016 | Booth et al. |
| 9,292,660 B2 | 3/2016 | Von et al. |
| 9,315,853 B2 | 4/2016 | Domanico |
| 9,371,566 B2 | 6/2016 | Lo et al. |
| 9,394,332 B2 | 7/2016 | Markert-Hahn et al. |
| 9,400,276 B2 | 7/2016 | Micallef |
| 9,447,452 B2 | 9/2016 | Rao et al. |
| 9,464,277 B2 | 10/2016 | Zheng et al. |
| 9,476,095 B2 | 10/2016 | Vogelstein et al. |
| 9,580,754 B2 | 2/2017 | Markowitz et al. |
| 9,598,731 B2 | 3/2017 | Talasaz |
| 9,670,530 B2 | 6/2017 | Kostem et al. |
| 9,702,002 B2 | 7/2017 | Boutell |
| 9,702,004 B2 | 7/2017 | Van Eijk et al. |
| 9,732,390 B2 | 8/2017 | Lo et al. |
| 9,745,614 B2 | 8/2017 | Schroeder et al. |
| 9,745,627 B2 | 8/2017 | Van Eijk et al. |
| 9,752,188 B2 | 9/2017 | Schmitt et al. |
| 9,816,986 B2 | 11/2017 | Rao et al. |
| 9,834,822 B2 | 12/2017 | Talasaz |
| 9,840,743 B2 | 12/2017 | Talasaz |
| 9,850,523 B1 | 12/2017 | Chudova et al. |
| 9,862,995 B2 | 1/2018 | Patel |
| 9,868,756 B2 | 1/2018 | Markert-Hahn et al. |
| 9,896,725 B2 | 2/2018 | Lee et al. |
| 9,896,726 B2 | 2/2018 | Vaisvila et al. |
| 9,902,992 B2 | 2/2018 | Talasaz et al. |
| 9,920,363 B2 | 3/2018 | Gao et al. |
| 9,920,366 B2 | 3/2018 | Eltoukhy et al. |
| 9,938,575 B2 | 4/2018 | Tischfield et al. |
| 9,984,201 B2 | 5/2018 | Zhang et al. |
| 10,011,878 B2 | 7/2018 | Ahlquist et al. |
| 10,031,131 B2 | 7/2018 | Rao et al. |
| 10,093,986 B2 | 10/2018 | Zhang et al. |
| 10,144,953 B2 | 12/2018 | Domanico et al. |
| 10,297,342 B2 | 5/2019 | Lo et al. |
| 10,392,666 B2 | 8/2019 | Lo et al. |
| 10,435,754 B2 | 10/2019 | Lo et al. |
| 10,435,755 B2 | 10/2019 | Ahlquist et al. |
| 10,704,083 B2 | 7/2020 | Domanico et al. |
| 10,718,026 B2 | 7/2020 | Weinhausel et al. |
| 11,410,750 B2 | 8/2022 | Gross et al. |
| 2002/0192698 A1 | 12/2002 | Pinkel et al. |
| 2003/0104464 A1 | 6/2003 | Berlin et al. |
| 2005/0196792 A1 | 9/2005 | Fodor et al. |
| 2005/0221314 A1 | 10/2005 | Berlin et al. |
| 2006/0286576 A1 | 12/2006 | Lofton-Day et al. |
| 2006/0292585 A1 | 12/2006 | Nautiyal et al. |
| 2007/0141582 A1 | 6/2007 | Li et al. |
| 2007/0161031 A1 | 7/2007 | Trinklein et al. |
| 2007/0264640 A1 | 11/2007 | Barrett |
| 2008/0081338 A1 | 4/2008 | Lo et al. |
| 2008/0102450 A1 | 5/2008 | Barrett |
| 2008/0200343 A1 | 8/2008 | Clemens et al. |
| 2008/0286787 A1 | 11/2008 | Campan et al. |
| 2008/0305481 A1 | 12/2008 | Whitman et al. |
| 2009/0280479 A1 | 11/2009 | Hoon et al. |
| 2010/0068720 A1 | 3/2010 | Li et al. |
| 2010/0120022 A1 | 5/2010 | Ayalon-Soffer et al. |
| 2010/0304978 A1 | 12/2010 | Deng et al. |
| 2011/0027771 A1 | 2/2011 | Deng |
| 2011/0165565 A1 | 7/2011 | Wang et al. |
| 2011/0237444 A1 | 9/2011 | Clancy et al. |
| 2012/0053062 A1 | 3/2012 | Brooks |
| 2012/0149593 A1 | 6/2012 | Hicks et al. |
| 2012/0157324 A1 | 6/2012 | Lizardi et al. |
| 2012/0190023 A1 | 7/2012 | Wasserstrom |
| 2012/0208711 A1 | 8/2012 | Cortese |
| 2012/0221249 A1 | 8/2012 | Lizardi et al. |
| 2013/0017958 A1 | 1/2013 | Benz et al. |
| 2013/0059734 A1 | 3/2013 | Molloy et al. |
| 2013/0129668 A1 | 5/2013 | Firestein et al. |
| 2013/0130924 A1 | 5/2013 | Walrafen et al. |
| 2013/0186639 A1 | 7/2013 | Zhao et al. |
| 2013/0203605 A1 | 8/2013 | Shendure et al. |
| 2013/0261984 A1 | 10/2013 | Eberle et al. |
| 2013/0337447 A1 | 12/2013 | Porreca et al. |
| 2014/0024537 A1 | 1/2014 | Rigatti et al. |
| 2014/0080715 A1 | 3/2014 | Lo et al. |
| 2014/0256574 A1 | 9/2014 | Herold et al. |
| 2014/0274740 A1 | 9/2014 | Srinivasan et al. |
| 2014/0274748 A1 | 9/2014 | Ahlquist et al. |
| 2014/0274752 A1 | 9/2014 | Blume et al. |
| 2014/0274767 A1 | 9/2014 | Yegnasubramanian et al. |
| 2014/0342940 A1 | 11/2014 | Oliphant et al. |
| 2014/0357497 A1 | 12/2014 | Zhang et al. |
| 2014/0364323 A1 | 12/2014 | Fan et al. |
| 2015/0038352 A1 | 2/2015 | Cao et al. |
| 2015/0104793 A1 | 4/2015 | Quake et al. |
| 2015/0159212 A1 | 6/2015 | Pantoja et al. |
| 2015/0197798 A1 | 7/2015 | Xu et al. |
| 2015/0197809 A1 | 7/2015 | Myers et al. |
| 2015/0209786 A1 | 7/2015 | Hage et al. |
| 2015/0099670 A1 | 9/2015 | Li et al. |
| 2015/0259743 A1 | 9/2015 | Burgess et al. |
| 2015/0299781 A1 | 10/2015 | Ost |

(56) References Cited

U.S. PATENT DOCUMENTS

| | | |
|---|---|---|
| 2015/0322513 A1 | 11/2015 | Gromminger et al. |
| 2015/0368708 A1 | 12/2015 | Talasaz |
| 2016/0003848 A1 | 1/2016 | Holdenrieder |
| 2016/0017396 A1 | 1/2016 | Cann et al. |
| 2016/0017419 A1 | 1/2016 | Chiu et al. |
| 2016/0040229 A1 | 2/2016 | Talasaz et al. |
| 2016/0047001 A1 | 2/2016 | Larisch |
| 2016/0138079 A1 | 5/2016 | Guan et al. |
| 2016/0144378 A1 | 5/2016 | Huang et al. |
| 2016/0168648 A1 | 6/2016 | Allawi et al. |
| 2016/0186267 A1 | 6/2016 | So et al. |
| 2016/0210403 A1 | 7/2016 | Zhang et al. |
| 2016/0232290 A1 | 8/2016 | Rava et al. |
| 2016/0239604 A1 | 8/2016 | Chudova et al. |
| 2016/0251704 A1 | 9/2016 | Talasaz et al. |
| 2016/0258014 A1 | 9/2016 | Booth et al. |
| 2016/0265027 A1 | 9/2016 | Sanches-Kuiper et al. |
| 2016/0265042 A1 | 9/2016 | Schroeder et al. |
| 2016/0275240 A1 | 9/2016 | Huelga |
| 2016/0281175 A1 | 9/2016 | Weinhausel et al. |
| 2016/0298183 A1 | 10/2016 | Wen et al. |
| 2016/0319345 A1 | 11/2016 | Gnerre et al. |
| 2016/0333417 A1 | 11/2016 | Talasaz |
| 2016/0333420 A1 | 11/2016 | Stern et al. |
| 2016/0340740 A1 | 11/2016 | Zhang |
| 2016/0340749 A1 | 11/2016 | Stelzer et al. |
| 2016/0348152 A1 | 12/2016 | Zheng et al. |
| 2016/0357903 A1 | 12/2016 | Shendure et al. |
| 2016/0362748 A1 | 12/2016 | Mongan et al. |
| 2017/0024513 A1 | 1/2017 | Lo et al. |
| 2017/0029900 A1 | 2/2017 | Lo et al. |
| 2017/0101685 A1 | 4/2017 | Lo et al. |
| 2017/0121767 A1 | 5/2017 | Dor et al. |
| 2017/0137871 A1 | 5/2017 | Lai et al. |
| 2017/0175205 A1 | 6/2017 | Toung et al. |
| 2017/0176420 A1 | 6/2017 | Rao et al. |
| 2017/0191119 A1 | 7/2017 | Rao et al. |
| 2017/0198344 A1 | 7/2017 | Vaisvila et al. |
| 2017/0211143 A1 | 7/2017 | Shendure et al. |
| 2017/0218338 A1 | 8/2017 | Rao et al. |
| 2017/0219589 A1 | 8/2017 | Rao et al. |
| 2017/0233829 A1 | 8/2017 | Lo et al. |
| 2017/0235877 A1 | 8/2017 | Lo et al. |
| 2017/0240973 A1 | 8/2017 | Eltoukhy et al. |
| 2017/0249421 A1 | 8/2017 | Eberle et al. |
| 2017/0260590 A1 | 9/2017 | Eltoukhy et al. |
| 2017/0275689 A1 | 9/2017 | Maguire et al. |
| 2017/0292147 A1 | 10/2017 | Kostem et al. |
| 2017/0321276 A1 | 11/2017 | Cantor et al. |
| 2017/0327869 A1 | 11/2017 | Schutz et al. |
| 2017/0356053 A1 | 12/2017 | Otto et al. |
| 2017/0362638 A1 | 12/2017 | Chudova et al. |
| 2018/0010176 A1 | 1/2018 | Patel |
| 2018/0010192 A1 | 1/2018 | Zhang et al. |
| 2018/0023125 A1 | 1/2018 | Talasaz et al. |
| 2018/0044632 A1 | 2/2018 | Rao et al. |
| 2018/0044633 A1 | 2/2018 | Rao et al. |
| 2018/0044731 A1 | 2/2018 | Valouev et al. |
| 2018/0045727 A1 | 2/2018 | Spetzler et al. |
| 2018/0066306 A1 | 3/2018 | Namsaraev et al. |
| 2018/0082012 A1 | 3/2018 | Jiang et al. |
| 2018/0094325 A1 | 4/2018 | Zhang et al. |
| 2018/0105884 A1 | 4/2018 | Lo et al. |
| 2018/0119113 A1 | 5/2018 | Rao et al. |
| 2018/0119225 A1 | 5/2018 | Rao et al. |
| 2018/0119230 A1 | 5/2018 | Velculescu et al. |
| 2018/0120304 A1 | 5/2018 | Rao et al. |
| 2018/0171397 A1 | 6/2018 | Vaisvila et al. |
| 2018/0179587 A1 | 6/2018 | Rao et al. |
| 2018/0180602 A1 | 6/2018 | Rao et al. |
| 2018/0216195 A1 | 8/2018 | Elnitski et al. |
| 2018/0237867 A1 | 8/2018 | Bajic et al. |
| 2018/0327859 A1 | 11/2018 | Van Engeland et al. |
| 2019/0032149 A1 | 1/2019 | Van Engeland et al. |
| 2019/0136327 A1 | 5/2019 | Zhang et al. |
| 2019/0256921 A1 | 8/2019 | Mueller |
| 2019/0287652 A1 | 9/2019 | Gross |
| 2021/0017609 A1 | 1/2021 | Gross et al. |
| 2021/0025011 A1 | 1/2021 | Gross et al. |
| 2021/0238693 A1 | 8/2021 | Gross et al. |
| 2021/0238694 A1 | 8/2021 | Gross |
| 2022/0064737 A1 | 3/2022 | Gross |
| 2022/0090207 A1 | 3/2022 | Venn et al. |
| 2022/0098672 A1 | 3/2022 | Venn et al. |
| 2022/0119890 A1 | 4/2022 | Venn et al. |
| 2022/0380857 A1 | 12/2022 | Gross et al. |

FOREIGN PATENT DOCUMENTS

| | | |
|---|---|---|
| EP | 1342794 B1 | 12/2005 |
| EP | 1394173 B1 | 10/2007 |
| EP | 1644519 B1 | 12/2008 |
| EP | 1567669 B1 | 3/2010 |
| EP | 2771483 A1 | 9/2014 |
| EP | 2391729 B1 | 9/2016 |
| EP | 3218523 B1 | 9/2017 |
| EP | 2825675 B1 | 12/2017 |
| EP | 3265562 A2 | 1/2018 |
| EP | 3087204 B1 | 2/2018 |
| EP | 3288455 A1 | 3/2018 |
| EP | 3094747 B1 | 11/2018 |
| EP | 2893040 B1 | 1/2019 |
| EP | 3497220 A1 | 6/2019 |
| EP | 3207134 B1 | 7/2019 |
| EP | 3289097 B1 | 3/2020 |
| WO | WO-2001081620 A2 | 11/2001 |
| WO | WO-2003054219 A2 | 7/2003 |
| WO | WO-2005017207 A2 | 2/2005 |
| WO | WO-2005019477 A2 | 3/2005 |
| WO | WO-2005118852 A2 | 12/2005 |
| WO | WO-2006128192 A2 | 11/2006 |
| WO | WO-2008038000 A1 | 4/2008 |
| WO | WO-2008048508 A2 | 4/2008 |
| WO | WO-2008073303 A2 | 6/2008 |
| WO | WO-2008084219 A1 | 7/2008 |
| WO | WO-2007106802 A2 | 12/2008 |
| WO | WO-2010037001 A2 | 4/2010 |
| WO | WO-2010085343 A1 | 7/2010 |
| WO | WO-2011038507 A1 | 4/2011 |
| WO | WO-2011127136 A1 | 10/2011 |
| WO | WO-2012031329 A1 | 3/2012 |
| WO | WO-2012138973 A2 | 10/2012 |
| WO | WO-2012149171 A1 | 11/2012 |
| WO | WO-2012178074 A1 | 12/2012 |
| WO | WO-2013060762 A1 | 5/2013 |
| WO | WO-2013163207 A1 | 10/2013 |
| WO | WO-2013186639 A2 | 12/2013 |
| WO | WO-2014026768 A1 | 2/2014 |
| WO | WO-2014043763 A1 | 3/2014 |
| WO | WO-2014135469 A2 | 9/2014 |
| WO | WO-2014151117 A1 | 9/2014 |
| WO | WO-2014184684 A2 | 11/2014 |
| WO | WO-2014205981 A1 | 12/2014 |
| WO | WO-2015101515 A2 | 7/2015 |
| WO | WO-2015116837 A1 | 8/2015 |
| WO | WO-2015124955 A1 | 8/2015 |
| WO | WO-2015153284 A1 | 10/2015 |
| WO | WO-2015179672 A1 | 11/2015 |
| WO | WO-2016008451 A1 | 1/2016 |
| WO | WO-2016015058 A2 | 1/2016 |
| WO | WO-2016016639 A1 | 2/2016 |
| WO | WO-2016034908 A1 | 3/2016 |
| WO | WO-2016063034 A1 | 4/2016 |
| WO | WO-2016063059 A1 | 4/2016 |
| WO | WO-2016094813 A1 | 6/2016 |
| WO | WO-2016097251 A1 | 6/2016 |
| WO | WO-2016101258 A1 | 6/2016 |
| WO | WO-2016115530 A1 | 7/2016 |
| WO | WO-2016127844 A1 | 8/2016 |
| WO | WO-2016127944 A1 | 8/2016 |
| WO | WO-2016141324 A2 | 9/2016 |
| WO | WO-2016170319 A1 | 10/2016 |
| WO | WO-2016179049 A1 | 11/2016 |
| WO | WO-2016189288 A1 | 12/2016 |

(56) References Cited

FOREIGN PATENT DOCUMENTS

| | | |
|---|---|---|
| WO | WO-2016207656 A1 | 12/2016 |
| WO | WO-2016210224 A1 | 12/2016 |
| WO | WO-2017008912 A1 | 1/2017 |
| WO | WO-2017012544 A1 | 1/2017 |
| WO | WO-2017027835 A1 | 2/2017 |
| WO | WO-2017048932 A1 | 3/2017 |
| WO | WO-2017062970 A1 | 4/2017 |
| WO | WO-2015145133 A1 | 5/2017 |
| WO | WO-2017083562 A1 | 5/2017 |
| WO | WO-2017106481 A1 | 6/2017 |
| WO | WO-2017127741 A1 | 7/2017 |
| WO | WO-2017136603 A1 | 8/2017 |
| WO | WO-2017176630 A1 | 10/2017 |
| WO | WO-2017181079 A2 | 10/2017 |
| WO | WO-2017181111 A2 | 10/2017 |
| WO | WO-2017181134 A2 | 10/2017 |
| WO | WO-2017181146 A1 | 10/2017 |
| WO | WO-2017181202 A2 | 10/2017 |
| WO | WO-2017194668 A1 | 11/2017 |
| WO | WO-2017201102 A8 | 11/2017 |
| WO | WO-2017212428 A1 | 12/2017 |
| WO | WO-2018005983 A1 | 1/2018 |
| WO | WO-2018009696 A1 | 1/2018 |
| WO | WO-2018009702 A1 | 1/2018 |
| WO | WO-2018009703 A1 | 1/2018 |
| WO | WO-2018009705 A1 | 1/2018 |
| WO | WO-2018009709 A1 | 1/2018 |
| WO | WO-2018022890 A1 | 2/2018 |
| WO | WO-2018022906 A1 | 2/2018 |
| WO | WO-2018031760 A1 | 2/2018 |
| WO | WO-2018039463 A1 | 3/2018 |
| WO | WO-2018119216 A1 | 6/2018 |
| WO | WO-2018119452 A2 | 6/2018 |
| WO | WO-2018136881 A1 | 7/2018 |
| WO | WO-2018161031 A1 | 9/2018 |
| WO | WO-2018195211 A1 | 10/2018 |
| WO | WO-2018195217 A1 | 10/2018 |
| WO | WO-2018204764 A1 | 11/2018 |
| WO | WO-2019064063 A1 | 4/2019 |
| WO | WO-2019074700 A1 | 4/2019 |
| WO | WO-2019178277 A1 | 9/2019 |
| WO | WO-2019195268 A2 | 10/2019 |
| WO | WO-2019199696 A1 | 10/2019 |
| WO | WO-2020069350 A1 | 4/2020 |
| WO | WO-2020154682 A2 | 7/2020 |
| WO | WO-2020163403 A1 | 8/2020 |
| WO | WO-2020163410 A1 | 8/2020 |
| WO | WO-2020232109 A1 | 11/2020 |

OTHER PUBLICATIONS

Ashford, M.,UCSD Methylation Haplotype Method Tracks cfDNA Origin; Singlera to Commercialize, Genome Web, 2017. Accessed Dec. 7, 2020. Available at: https://www.genomeweb.com/molecular-diagnostics/ucsd-methylation-haplotypemethod-tracks-cfdna-origin-singlera-commercialize#.X9P0pmiQGUk.

Avraham, et al., "Tissue Specific DNA Methylation in Normal Human Breast Epithelium and in Breast Cancer," *PLOS One*, 9(3):1-8 (2014).

Bejar, R., et al., "Clinical Effect of Point Mutations in Myelodysplastic Syndromes," *N. Eng. J. Med.*, pp. 2496-2506 (2011).

Brandon, et al., "Mitochondrial mutations in cancer," *Oncogene*, 25(34):4647-4662 (2006).

Burnham, et al., "Single-Stranded DNA library preparation uncovers the origin and diversity of ultrashort cell-free DNA in plasma," *Scientific Reports*, 6(27859):1-9 (2016).

Chan, et al., "Noninvasive detection of cancer-associated genome-wide hypomethylation and copy number aberrations by plasma DNA bisulfite sequencing," *Proc. Natl. Acad. Sci. USA*, 110(47):18761-18768 (2013).

Cheuk, et al., "Detection of Methylated Circulating DNA as Non-invasive Biomarkers for Breast Cancer Diagnosis," *J. Breast Cancer*, 20(1):12-17 (2017).

Chhibber, et al. "Single-molecule polymerase chain reaction reduces bias: Application to DNA methylation analysis by bisulfite sequencing," *Anal. Biochem.*, 377(1):46-54 (2008).

Clinical Trail.gov Identifier: NCT03085888 (//clinicaltrials.gov/ct2/show/NCT03085888)) The STRIVE Study: Development of a Blood Test for Early Detection of Multiple Cancer Types (accessed Oct. 20, 2021).

Cohen, et al., "Detection and localization of surgically resectable cancers with a multi-analyte blood test," *Science*, 359(6378):926-930 (2018).

Diep, et al., "Library-free methylation sequencing with bisulfite padlock probes," *Nature Methods*, 9(3):270-272 (2012).

EZ DNA Methylation-Lightning Kit, Instruction Manual. Zymo Research, ver. 1.0.5.

Frimer, "HPV16 methylation is a consistent biomarker of cervical intraepithelial neoplasia (CIN) 3 using a novel next-generation bisulfite-sequencing technology," *Gynecologic Oncology*, 130(1):e51-e52 (2013).

GenBank submission AC067721, Mar. 7, 2003 [online]. [Retrieved on Jun. 17, 2020]. Retrieved from the internet <URL: https://www.ncbi.nlm.nih.gov/nuccore/AC067721>.

GenBank submission AC093151.2, Jun. 25, 2002 [online]. [Retrieved on Jun. 17, 2020]. Retrieved from the internet <URL: https://www.ncbi.nlm.nih.gov/nuccore/AC093151>.

Genome Reference Consortium with a reference No. GRCh37/hg19, and also available from Genome Browser provided by Santa Cruz Genomics Institute, Nucleic Acids Research, 2021, vol. 49, Nov. 22, 2020.

Guo, et al., "Identification of metylation haplotype blocks aids in deconvolution of heterogeneous tissue samples and tumor tissue-of-origin mapping from plasma DNA," *Nature Genetics*, 49(4):635-643 (2017).

Handbook of Chemistry and Physics, 49th Edition, 1968, Weast (ed.), The Chemical Rubber Co., Cleveland, Ohio, p. 245.

Hao, et al., "DNA methylation markers for diagnosis and prognosis of common cancers," *Proc. Natl. Acad. Sci. USA*, 114(28): 7414-7419 (w/Supplemental Information) (2017).

Harris, et al., "Single-Molecule DNA Sequencing of a Viral Genome," *Science*, 320:106-109 (2008).

Hashimoto et al., "5'-end SAGE for the analysis of transcriptional start sites," *Nature Biotechnology*, 22:1146-1149 (2004).

Huang, et al., *The Epigenome: Molecular Hide and Seek*, Chapter 3, pp. 39-64 (2003).

Husseiny, et al., "Development of a Quantitative Methylation-Specific Polymerase Chain Reaction Method for Monitoring Beta Cell Death in Type 1 Diabetes," *PLOS One*, 7(10):1-11 (2012).

Husseiny, et al., "Tissue-Specific Methylation of Human Insulin Gene and PCR Assay for Monitoring Beta Cell Death," *PLOS One*, 9(4):1-9 (2014).

Illumina, Data Sheet; Epigenetics "Infinium HumanMethylation450 BeadChip", 4 pgs., 2012.

Kang, et al., "CancerLocator: non-invasive cancer diagnosis and tissue-of-origin prediction using methylation profiles of cell-free DNA," *Genome Biology*, 18(1):Article No. 53 (2017).

Kivioja, et al., "Counting absolute Nos. of molecules using unique molecular identifiers," *Nat. Methods*, 9(1):72-74 (2011).

Laird, "Early Detection: The power and the promise of DNA methylation markers," *Nat. Rev. Cancer*, 3:253-266 (2003).

Lebastchi et al., "Immune Therapy and β-Cell Death in Type 1 Diabetes," *Diabetes*, 62(5):1676-6380 (2013).

Lehmann-Wehman, et al., "Identification of tissue-specific cell death using methylation patterns of circulating DNA," *Proc. Natl. Acad. Sci. USA*, 113:E1826-1834 (2016).

Leygo, et al., "DNA Methylation as a Noninvasive Epigenetic Biomarker for the Detection of Cancer" *Dis. Markers*, 3726595 (2017).

Li, et al., "Post-conversion targeted capture of modified cytosines in mammalian and plant genomes," *NAR*, 43(12):e81, 16 pages (2015).

Li, et al., "CancerDetector: ultrasensitive and non-invasive cancer detection at the resolution of individual reads using cell-free DNA methylation sequencing data," *Nucleic Acids Research*, 46(15):e89 (2018).

(56) References Cited

OTHER PUBLICATIONS

Liu, et al., "An Efficient one-step site-directed deletion, insertion, single and multiple-site plasmid mutagensis protocol," *BMC Biotechnol.*, 8:91 (2008).
Liu, et al., "Methylation-sensitive enrichment of minor DNA alleles using a double-strand DNA-specific nuclease," *Nucleic Acids Research*, 45(6):e39 (2017).
Liu, et al., "Targeted methylation sequencing of plasma cell-free DNA for cancer detection and classification," *Annals of Oncology*, 29:1445-1453 (2018).
Liu, Y., et al., "Identify tissue-of-origin incancer cfDNA by whole genome sequencing", AACR meeting, Abstract, 5689/13, Apr. 2017.
Madi, et al., "The determination of tissue-specific DNA methylation patterns in forensic biofluids using bisulfite modification and pyrosequencing," *Electrophoresis*, 33(12):1736-1745 (2012).
Mardis, E. R., et al., "Recurring Mutations Found by Sequencing an Acute Myeloid Leukemia Genome," *N. Eng. J. Med.*, pp. 1058-1066 (2009).
Masser, et al., "Bisulfite oligonucleotide-capture sequencing for targeted base and strandspecific absolute 5-methylcytosine quantitation" *AGE*, 38:49 (2016).
Mcinnes, "Genome-wide methylation analysis identifies a core set of hypermethylated genes in CIMP-H colorectal cancer," *BMC Cancer*, 17(1):228 (2017).
Miura et al., "Highly sensitive targeted methylome sequencing by post-bi sulfite adaptor tagging," *DNA Research*, 22(1):13-18 (2014).
Mouliere, et al., "Selecting short DNA fragments in plasma improves detection of circulating tumour DNA," *bioRxiv*, 134437 (2017). doi: https://doi.org/10.1101/134437.
Okamura, et al., "Lists of HumanMethylation450 BeadChip probes with nucleotide-variant information obtained from the Phase 3 data of the 1000 Genomes Project," Genomics Data 7, pp. 67-69 (2016).
Oncomine™, cfDNA Assays Part I: Library Preparation User Guide, (2016).
Oncomine™cfDNA Assays part II: Plan a Run, Template Preparation, and Sequencing User Guide, (2016).
Papaemmanuil, E., et al., "Somatic SF3B1 Mutation in Myelodysplasia with Ring Sideroblasts," *N. Eng. J. Med.*, pp. 1384-1395 (2011).
Pidsley, et al. "Critical evaluation of the Illumina MethylationEPIC BeadChip microarray for whole-genome DNA methylation profiling," *Genome Biology*, 17:208 (2016).
Poon, et al., "Differential DNA Mehtylation between Fetus and Mother as a Strategy for Detecting Fetal DNA in Maternal Plasma," *Clinical Chemistry*, 48(1):35-41 (2002).
Raine, et al. "Splinted Ligation Adapter Tagging (SPLAT), a novel library preparation method for whole genome bisulphie sequencing," *Nucleic Acids Research*, 110:1-15 (2016).
Reidmiller M, Braun H. Rprop—A Fast Adaptive Learning Algorithm. Proceedings of the International Symposium on Computerand Information Science VII, (1992).
Ross, et al., "Identification of differentially methylated regions using streptavidin bisulfite ligand methylation enrichment (SuBLiME), a new method to enrich for methylated DNA prior to deep bisulfite genomic sequencing," *Epigenetics*, 8(1):113-127 (2013).
Shen, et al., "FACETS: allele-specific copy number and clonal heterogeneity analysis tool for high-throughput DNA sequencing," *Nucleic Acids Research*, 44(16):e131 (2016).
Shoemaker, et al., "Allele-specific methylation is prevalent and is contributed by CpG-SNPs in the human genome," *Genome Research*, 20:883-889 (2010).
Tanic, et al., "Epigenome-wide association studies for cancer biomarker discovery in circulating cell-free DNA: technical advances and challenges," *Current Opinion in Genetics & Development*, 42:48-55 (2017).
The Circulating Cell-free Genome Atlas Study ("CCGA"; Clinical Trial.gov identifier NCT02889978) (accessed Oct. 20, 2021).
Tost, "Current and Emerging Technologies for the Analysis of the Genome-Wide and Locus-Specific DNA Methylation Patterns" *DNA Methyltransferases—Role and Function*, Springer International Publishing, Jeltsch et al. eds., pp. 343-430 (2016).
Toyota, et al., "Identification of Differentially Methylated Sequences in Colorectal Cancer by Methylated CpG Island Amplification," *Cancer Research*, 59(10):2307-2312 (1999).
Varley, et al., "Bisulfite Patch PCR enables multiplexed sequencing of promoter methylation across cancer samples," *Genome Research*, 20:1279-1287 (2010).
Vrba, "A suite of DNA methylation markers that can detect most common human cancers" *Epigenetics*, 1-13 (2018).
Walter, M., "Clonal Architecture of Secondary Acute Myeloid Leukemia," *N. Eng. J. Med.*, pp. 1090-1098 (2012).
Warton et al., "Methylation of cell-free circulating DNA in the diagnosis of cancer," *Frontiers in Molecular Biosciences*, 2:Article 13 (2015).
Widschewendter, et al., "Methylation patterns in serum DNA for early identification of disseminated breast cancer," *Genome Medicine*, 9:Article 115 (2017).
Yong, "Written in Blood: DNA circulating in the bloodstream could guide cancer treatment—if researchers can work out how best to use it," *Nature*, 511:524-526 (2014).
Zhai, et al., "Genome-wide DNA Methylation Profiling of Cell-Free Serum DNA in Esophageal Adenocarcinoma and Barrett Esophagus," *Neoplasia*, 14(1):29-33 (2012).
Co-pending U.S. Appl. No. 17/214,038, inventors Gross et al, filed Mar. 26, 2021.
Co-pending U.S. Appl. No. 17/214,682, inventors Xiang et al, filed Mar. 26, 2021.
Illumina, Data Sheet; Epigenetics "Infinium MethylationEPIC BeadChip", 4 pgs., 2012. Retrieved from the internet on Dec. 12, 2022: <https://filgen.jp/Product/Bioscience/Methyl/humanmethylationepic-data-sheet-1070-2015-008.pdf>.

Calculate P-Value with Markov Chain Model
500

Test Methylation State Vector
505

$< M_{23}, M_{24}, M_{25}, U_{26} >$

↓ 410
↓ 420

| P | $< M_{23}, M_{24}, M_{25}, M_{26} >$ | $= P(M_{26} \mid M_{23}, M_{24}, M_{25}) * P(M_{25} \mid M_{23}, M_{24}) * P(M_{24} \mid M_{23}) * P(M_{23})$ |
| P | $< M_{23}, M_{24}, M_{25}, U_{26} >$ | $\approx P(M_{26} \mid M_{24}, M_{25}) * P(M_{25} \mid M_{23}, M_{24}) * P(M_{24} \mid M_{23}) * P(M_{23})$ |
| ... | | |
| P | $< U_{23}, U_{24}, U_{25}, U_{26} >$ | $= P(U_{26} \mid U_{23}, U_{24}, U_{25}) * P(U_{25} \mid U_{23}, U_{24}) * P(U_{24} \mid U_{23}) * P(U_{23})$ |
|   |                                    | $\approx P(U_{26} \mid U_{24}, U_{25}) * P(U_{25} \mid U_{23}, U_{24}) * P(U_{24} \mid U_{23}) * P(U_{23})$ |

Probabilities of Possible Methylation State Vectors
515

↓ 430

| p-value | $< M_{23}, M_{24}, M_{25}, U_{26} >$ | $= \sum [\text{All probabilities} \leq P(\; <M_{23}, M_{24}, M_{25}, U_{26}>\;)\;]$ |

P-Value of Test Methylation State Vector
525

FIG. 5

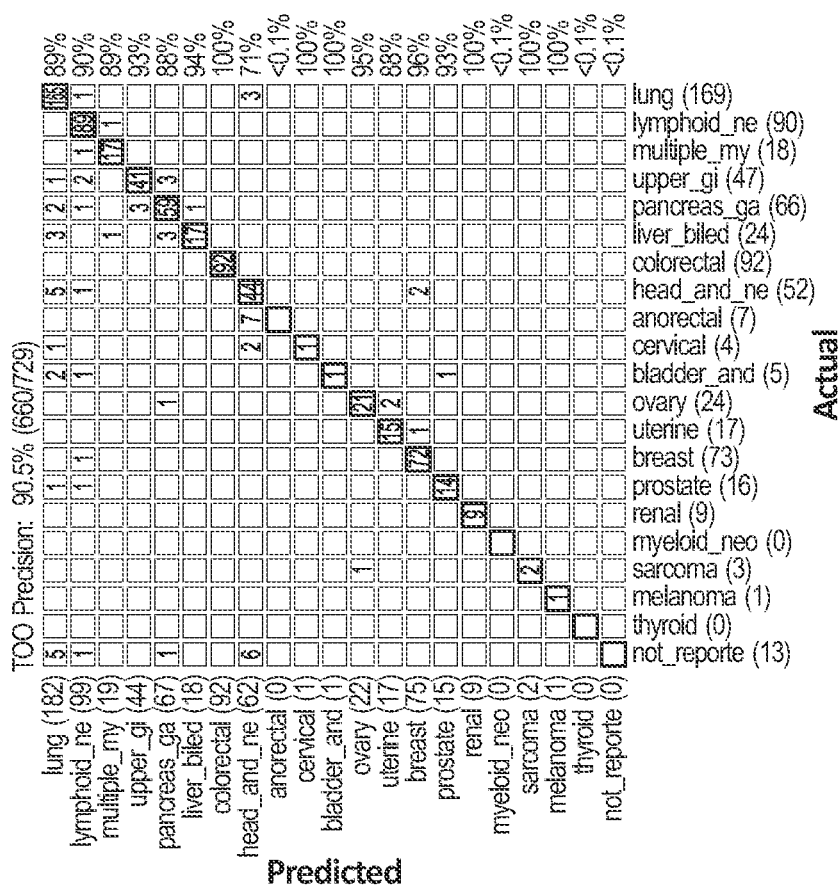
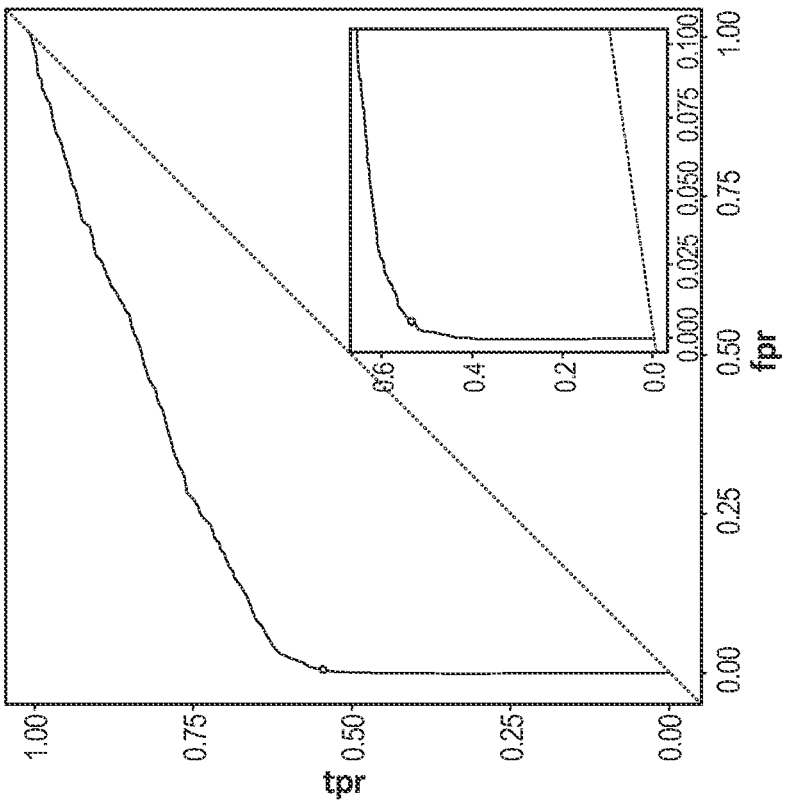
FIG. 25B
FIG. 25A

METHYLATION MARKERS AND TARGETED METHYLATION PROBE PANEL

1. CROSS-REFERENCE

This is a continuation application of U.S. application Ser. No. 17/832,375, filed on Jun. 3, 2022, which is a continuation of U.S. application Ser. No. 17/214,190, filed on Mar. 26, 2021, which is a continuation of International Appl. No. PCT/US2019/053509, filed on Sep. 27, 2019, which claims the benefit of U.S. Provisional Application No. 62/737,836, filed Sep. 27, 2018, and also claims priority to continuation-in-part of International Appl. No. PCT/US2019/025358, filed on Apr. 2, 2019, all of which are hereby incorporated by reference in their entireties.

2. SEQUENCE LISTING

The Sequence Listing titled 202323-613304_SL.xml, which was created on Dec. 15, 2022, and is 235,687,658 bytes in size, is hereby incorporated by reference in its entirety. The Sequence Listing is submitted on compact discs recorded on Dec. 16, 2022, which are labeled "CRF", "COPY 1", and "COPY 2", each disc containing only one identical copy of said Sequence Listing. Said compact discs are hereby incorporated by reference in their entireties.

Reference is also made to the Sequence Listing filed with U.S. application Ser. No. 17/214,190, which was submitted electronically in ASCII format and is also hereby incorporated by reference in its entirety. Said ASCII copy, created on Sep. 26, 2019, is named 50251-846_601 SL.txt and is 52,371,626 bytes in size.

3. BACKGROUND

DNA methylation plays an important role in regulating gene expression. Aberrant DNA methylation has been implicated in many disease processes, including cancer. DNA methylation profiling using methylation sequencing (e.g., whole genome bisulfate sequencing (WGBS)) is increasingly recognized as a valuable diagnostic tool for detection, diagnosis, and/or monitoring of cancer. For example, specific patterns of differentially methylated regions may be useful as molecular markers for various diseases.

However, WGBS is not currently suitable for a product assay. The reason is that the vast majority of the genome is either not differentially methylated in cancer, or the local CpG density is too low to provide a robust signal. Only a few percent of the genome is likely to be useful in classification. With WGBS, deep sequencing (up to ~1000×) can be done in only a small set of genomic regions, perhaps 0.1% of the genome at current sequencing costs, because of cost constraints.

Furthermore, there have been various challenges in identifying differentially methylated regions in various diseases. First off, determining differentially methylated regions in a disease group only holds weight in comparison with a group of control subjects, such that if the control group is small in number, the determination loses confidence with the small control group. Additionally, among a group of control subjects, methylation status can vary which can be difficult to account for when determining the regions that are differentially methylated in a disease group. On another note, methylation of a cytosine at a CpG site is strongly correlated with methylation at a subsequent CpG site. To encapsulate this dependency is a challenge in itself.

Accordingly, a cost-effective method of accurately diagnosing a disease by analyzing DNA from differentially methylated regions has not yet been available.

4. SUMMARY

Early detection of cancer in subjects is important as it allows for earlier treatment and therefore a greater chance for survival. Targeted detection of cancer-specific methylation patterns using cell-free DNA (cfDNA) fragments can make early detection of cancer possible by providing cost-effective and non-invasive method for getting information relevant to detecting the presence or absence of cancer, a cancer tissue of origin, or cancer type. By using a targeted genomic region panel rather than sequencing all nucleic acids in a test sample, also known as "whole genome sequencing," the method can increase sequencing depth of the target regions.

Towards that end, the present description provides cancer assay panels (alternatively referred to as "bait sets") for detection of cancer-specific methylation patterns in targeted genomic regions, along with methods of using the cancer assay panels for diagnosis of cancer. Further provided herein are methods of designing and making the cancer assay panel by identifying genomic sites having cancer-specific methylation patterns as well as a list of genomic sites or genomic regions that can be used for various methods provided herein. The methods described herein further include methods of designing probes to enrich for cfDNA corresponding to or derived from selected genomic regions efficiently without pulling down an excessive amount of undesired DNA.

In one aspect, provided herein is a bait set for hybridization capture, the bait set comprising a plurality of different oligonucleotide-containing probes, wherein each of the oligonucleotide-containing probes comprises a sequence of at least 30 bases in length that is complementary to either: (1) a sequence of a genomic region; or (2) a sequence that varies from the sequence of (1) only by one or more transitions, wherein each respective transition of the one or more transitions occurs at a cytosine in the genomic region, and wherein each probe of the different oligonucleotide-containing probes is complementary to a sequence corresponding to a CpG site that is differentially methylated in cancer samples relative to non-cancer samples.

The bait set can comprise at least 500, 1,000, 2,000, 2,500, 5,000, 6,000, 7,500, 10,000, 15,000, 20,000, 25,000, 50,000 or 100,000 different oligonucleotide-containing probes. In one aspect, the CpG site is considered to be differentially methylated in cancer samples relative to non-cancer samples based on criteria comprising a number of cancer samples that comprise an anomalously methylated cfDNA fragment that overlaps the CpG site. In one aspect, the CpG site is considered to be differentially methylated in cancer samples relative to non-cancer samples based on criteria comprising $N_{cancer}$ and $N_{non-cancer}$, wherein: $N_{cancer}$ is a number of cancer samples that include a cfDNA fragment covering the CpG site that (1) has at least X CpG sites, wherein at least Y % of the CpG sites are methylated or unmethylated, wherein X is at least 4 and Y is at least 70, and (2) has a p-value rarity in non-cancerous samples of below a threshold value; and $N_{non-cancer}$ is a number of cancer samples that include a cfDNA fragment covering the CpG site that (1) has at least M CpG sites, wherein at least N % of the sites are methylated or unmethylated, wherein M is at least 4 and N is at least 70, and (2) has a p-value rarity in non-cancerous samples of below a threshold value. In one aspect, N equals X and N equals Y. In one aspect, the CpG site is considered to be differentially methylated based on criteria positively correlated with $N_{cancer}$ and negatively correlated with $N_{non-cancer}$. In one aspect, the CpG site is considered to be differentially methylated based on a ranked score of $(N_{cancer}+1)/(N_{cancer}+N_{non-cancer}+2)$.

In one aspect, in each of the different oligonucleotide-containing probes, the sequence of at least 30 bases in length can be complementary to either (1) a sequence within a genomic region selected from the genomic regions set forth in any one of Lists 1-8; or (2) a sequence that varies from the sequence of (1) only by one or more transitions, wherein each respective transition of the one or more transitions occurs at a cytosine in the genomic region. In one aspect, the plurality of different oligonucleotide-containing probes can be each conjugated to an affinity moiety. The affinity moiety can be biotin. In one aspect, for at least one of the different oligonucleotide-containing probes, the sequence of at least 30 bases can be complementary to the sequence that varies from the sequence of (1) only by one or more transitions, wherein each respective transition of the one or more transitions occurs at a cytosine in the genomic region. In another aspect, for at least 500, 1,000, 2,000, 2,500, 5,000, 6,000, 10,000, 15,000, 20,000, 25,000, or 50,000 of each of the different oligonucleotide-containing probes, the sequence of at least 30 bases can be complementary to the sequence that varies from the sequence of (1) only by one or more transitions, wherein each respective transition of the one or more transitions occurs at a cytosine in the genomic region. In one aspect, at least 80%, 90%, or 95% of the oligonucleotide-containing probes in the bait set do not include an at least 30, at least 40, or at least 45 base sequence that has 20 or more off-target regions of the genome. In another aspect, the oligonucleotide-containing probes in the bait set do not include an at least 30, at least 40, or at least 45 base sequence that has 20 or more off-targets regions of the genome. The sequence of at least 30 bases can be at least 40 bases, at least 45 bases, at least 50 bases, at least 60 bases, at least 75, or at least 100 bases in length. Each of the oligonucleotide-containing probes can have a nucleic acid sequence of at least 45, 40, 75, 100, or 120 bases in length. Each of the oligonucleotide-containing probes can have a nucleic acid sequence of no more than 300, 250, 200, or 150 bases in length.

In one aspect, the different oligonucleotide-containing probes comprise at least 500, at least 1000, at least 2,000, at least 2,500, at least 5,000, at least 6,000, at least 7,500, and least 10,000, at least 15,000, at least 20,000, or at least 25,000 different pairs of probes, wherein each pair of probes comprises a first probe and second probe, wherein the second probe differs from the first probe and overlaps with the first probe by an overlapping sequence that is at least 30, at least 40, at least 50, or at least 60 nucleotides in length. In one aspect, the bait set can include oligonucleotide-containing probes that are configured to target at least 20%, at least 25%, at least 30%, at least 40%, at least 50%, at least 60%, at least 70%, at least 80%, at least 90%, at least 95%, or 100% of the genomic regions identified in any one of Lists 1-8. In another aspect, the bait set can include oligo-nucleotide-containing probes that are configured to target at least 20%, at least 25%, at least 30%, at least 40%, at least 50%, at least 60%, at least 70%, at least 80%, at least 90%, at least 95%, or 100% of the genomic regions identified in List 1. The bait set can include oligonucleotide-containing probes that are configured to target at least 20%, at least 25%, at least 30%, at least 40%, at least 50%, at least 60%, at least 70%, at least 80%, at least 90%, at least 95%, or 100% of the genomic regions identified in List 3. An entirety of oligonucleotide probes in the bait set can be configured to hybridize to fragments obtained from cfDNA molecules corresponding to at least 30%, 40%, 50%, 60%, 70%, 80%, 90% or 95% of the genomic regions in a list selected from any one of Lists 1-8. An entirety of oligonucleotide-containing probes in the bait set can be configured to hybridize to fragments obtained from cfDNA molecules corresponding to at least 500, 1,000, 5000, 10,000, 15,000, 20,000, at least 25,000, or at least 30,000 genomic regions in any one of Lists 1-8. An entirety of oligonucleotide-containing probes in the bait set can be configured to hybridize to fragments obtained from cfDNA molecules corresponding to at least 50, 60, 70, 80, 90, 100, 120, 150, or 200 genomic regions in any one of Lists 1-8.

The plurality of oligonucleotide-containing probes can comprise at least 500, 1,000, 5,000, or 10,000 different subsets of probes, wherein each subset of probes comprises a plurality of probes that collectively extend across a genomic region selected from the genomic regions of any one of Lists 1-8 in a 2×tiled fashion. The plurality of probes that collectively extend across the genomic region in a 2× tiled fashion can comprise at least one pair of probes that overlap by a sequence of at least 30 bases, at least 40 bases, at least 50 bases, or at least 60 bases in length. The plurality of probes can collectively extend across portions of the genome that collectively can be a combined size of between 0.2 and 15 MB, between 0.5 MB and 15 MB, between 1 MB and 15 MB, between 3 MB and 12 MB, between 3 MB and 7, MB, between 5 MB and 9 MB, or between 7 MB and 12 MB. A subset of the different oligonucleotide-containing probes in the bait set can be designed to hybridize to cfDNA fragments derived from one or more genomics region from either List 4 or List 6. A subset of the different oligonucle-otide-containing probes in the bait set can be designed to target at least 2, at least 10, at least 50, at least 100, at least 1000, or at least 5000, at least 8000, at least 10,000 or at least 20,000 of the genomic regions from either List 4 or List 6. The different oligonucleotide-containing probes can each comprise less than 20, 15, 10, 8, or 6 CpG detection sites. In one aspect, at least 80%, 85%, 90%, 92%, 95%, or 98% of the plurality of oligonucleotide-containing probes in the bait set can have exclusively either CpG or CpA on all CpG detection sites. The oligonucleotide-containing probes of the bait set can correspond with a number of genomic regions selected from the genomic regions of any one of Lists 1-8, wherein at least 30% of the genomic regions that correspond with the probes in the bait set are in exons or introns. The oligonucleotide-containing probes of the bait set can correspond with a number of genomic regions, wherein at least 15% or at least 20% of the genomic regions that correspond with probes in the bait set are in exons. The oligonucleotide-containing probes of the bait set can correspond with a number of genomic regions, wherein less than 10% of the genomic regions that correspond with probes in the bait set are intergenic regions. In one aspect, for each of the different oligonucleotide-containing probes, the at least 30 nucleotide sequence can be complementary to a sequence that varies from the sequence of the genomic region by one or more transitions at all CpG sites within the sequence. In another aspect, for oligonucleotide-containing probes that vary with respect to the sequence within the genomic region by one or more transitions, a transition can occur at each CpG site within the genomic region. The different oligonucleotide-containing probes can be complementary to cfDNA fragments that have been converted to replace cytosine with uracil, wherein the cfDNA fragments are found at least 2-fold, 10-fold, 20-fold, 50-fold, 100-fold, or 1000-fold more frequently in cfDNA from cancer subjects than from cfDNA from non-cancer subjects.

In one embodiment, provided herein is a mixture comprising a bait set and converted cfDNA. The converted cfDNA can comprise bisulfate-converted cfDNA. The converted cfDNA can comprise cfDNA that has been converted via cytosine deaminase. In one aspect, provided herein is a method for enriching a converted cfDNA sample comprising contacting the cell-free DNA sample with the bait set and enriching the sample for a first set of genomic regions by hybridization capture.

In another aspect, provided herein is a method for providing sequence information informative of a presence or absence of a cancer, a stage of cancer, or a type of cancer, the method comprising: processing cell-free DNA from a biological sample with a deaminating agent to generate a cell-free DNA sample comprising deaminated nucleotides; and enriching the cell-free DNA sample for informative cell-free DNA molecules, wherein enriching the cell-free DNA sample for informative cell-free DNA molecules comprises contacting the cell-free DNA with a plurality of probes that are configured to hybridize to cell-free DNA molecules that correspond to regions identified in any one of Lists 1-8; and sequencing the enriched cell-free DNA molecules, thereby obtaining a set of sequence reads informative of a presence or absence of a cancer, a stage of cancer, or a type of cancer. The plurality of probes can comprise a plurality of primers, and enriching the cell-free DNA comprises amplifying, via PCR, the cell-free DNA fragments using the primers. In one aspect, enriching the cell-free DNA does not involve hybridization capture. In one aspect, the plurality of probes can be configured to hybridize to converted fragments obtained from the cfDNA molecules corresponding to or derived from at least 30%, 40%, 50%, 60%, 70%, 80%, 90% or 95% of the genomic regions in any one of Lists 1-8. The plurality of probes can comprise a plurality of oligonucleotide-containing probes.

In another aspect, the method further comprises determining a cancer classification by evaluating the set of sequence reads, wherein the cancer classification is (a) a presence or absence of cancer;
(b) a stage of cancer; or (c) a presence or absence of a type of cancer. The cancer classification can be a presence or absence of cancer. The cancer classification can be a stage of cancer. The stage of cancer can be selected from Stage I, Stage II, Stage III, and Stage IV. The cancer classification can be a presence or absence of a type of cancer. In one aspect, the step of determining a cancer classification can further comprise: (a) generating a test feature vector based on the set of sequence reads; and (b) applying the test feature vector to a classifier. In one aspect, the classifier further comprises a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments. The classifier can have an area under a receiver operating characteristic curve of greater than 0.70, greater than 0.75, greater than 0.77, greater than 0.80, greater than 0.81, greater than 0.82, or greater than 0.83. At 99% specificity, the classifier can have a sensitivity of at least 35%, at least 40%, at least 45% or at least 50%. In one aspect, the step of determining a cancer classification further comprises: (a) generating a test feature vector based on the set of sequence reads; and (b) applying the test feature vector to a classifier. In one aspect, the classifier comprises a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments.

In one aspect, the type of cancer can be selected from the group consisting of head and neck cancer, liver/bile duct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. In one aspect, the classifier, at 99.4% specificity, has a sensitivity of at least 70%, at least 80%, at least 85%, or at least 87% in classifying head and neck cancer. The classifier, at 99.4% specificity can have a sensitivity of at least 60%, at least 65%, at least 70%, or at least 73% in classifying liver/bile duct cancer. The classifier, at 99.4% specificity, can have a sensitivity of at least 70%, at least 75%, at least 80%, or at least 85% in classifying upper GI tract cancer. The classifier, at 99.4% specificity, can have a sensitivity of at least 70%, at least 80%, at least 85%, or at least 90% in classifying pancreatic/gall bladder cancer. The classifier, at 99.4% specificity can have a sensitivity of at least 70%, at least 80%, at least 90%, at least 95%, or at least 98% in classifying colorectal cancer. The classifier, at 99.4% specificity, can have a sensitivity of at least 70%, at least 80%, at least 85%, or at least 87% in classifying ovarian cancer. The classifier, at 99.4% specificity, can have a sensitivity of at least 70%, at least 80%, at least 90%, at least 95%, or at least 97% in classifying lung cancer. The classifier, at 99.4% specificity, can have a sensitivity of at least 70%, at least 80%, at least 85%, or at least 90% or at least 93% in classifying multiple myeloma. The classifier, at 99.4% specificity, can have a sensitivity of at least 70%, at least 80%, at least 90%, or at least 95% or at least 98% in classifying lymphoid neoplasm. The classifier, at 99.4% specificity, can have a sensitivity of at least 70%, at least 80%, at least 90%, or at least 95% or at least 98% in classifying melanoma. The classifier, at 99.4% specificity, can have a sensitivity of at least 35%, at least 40%, at least 45%, or at least 50% in classifying sarcoma. The classifier, at 99.4% specificity, can have a sensitivity of at least 70%, at least 80%, at least 90%, or at least 95% or at least 98% in classifying breast cancer. The classifier, at 99.4% specificity, can have a sensitivity of at least 70%, at least 80%, at least 90%, or at least 95% or at least 97% in classifying uterine cancer.

In another aspect, provided herein a method for determining a cancer classification comprising the steps of a) generating a test feature vector based on the set of sequence reads; and b) applying the test feature vector to a model obtained by a training process with a cancer set of fragments from one or more training subjects with a cancer and a non-cancer set of fragments from one or more training subjects without cancer, wherein both the cancer set of fragments and the non-cancer set of fragments comprise a plurality of training fragments. The training process can comprise: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each training subject, generating a training feature vector based on the hypomethylated training fragments and hypermethylated training fragments, and (d) training the model with the training feature vectors from the one or more training subjects without cancer and the training feature vectors from the one or more training subjects with cancer. In another aspect, the training process comprises: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; (d) for each training fragment, generating an aggregate hypomethylation score based on the hypomethylation score of the CpG sites in the training fragment and an aggregate hypermethylation score based on the hypermethylation score of the CpG sites in the training fragment; (e) for each training subject: ranking the plurality of training fragments based on aggregate hypomethylation score and ranking the plurality of training fragments based on aggregate hypermethylation score; and generating a feature vector based on the ranking of the training fragments; (0 obtaining training feature vectors for one or more training subjects without cancer and training feature vectors for the one or more training subjects with cancer; and (g)training the model with the feature vectors for the one or more training subjects without cancer and the feature vectors for the one or more training subjects with cancer. The model can comprise one of a kernel logistic regression classifier, a random forest classifier, a mixture model, a convolutional neural network, and an autoencoder model. In another aspect, the method further comprises the steps of: obtaining a cancer probability for the test sample based on the model; and comparing the cancer probability to a threshold probability to determine whether the test sample is from a subject with cancer or without cancer. The method can further comprise administering an anti-cancer agent to the subject.

In another aspect, provided herein is a method of treating a cancer patient, the method comprising, identified as a cancer subject by the methods above and administering an anti-cancer agent to a subject. The anti-cancer agent can be a chemotherapeutic agent selected from the group consisting of alkylating agents, antimetabolites, anthracyclines, anti-tumor antibiotics, cytoskeletal disruptors (taxans), topoisomerase inhibitors, mitotic inhibitors, corticosteroids, kinase inhibitors, nucleotide analogs, and platinum-based agents.

Provided herein is a method for assessing whether a subject has a cancer, the method comprising:

obtaining cfDNA from the subject; isolating a portion of the cfDNA from the subject by hybridization capture; obtaining sequence reads derived from the captured cfDNA to determine methylation states cfDNA fragments; applying a classifier to the sequence reads; and determining whether the subject has cancer based on application of the classifier; wherein the classifier has an area under the receiver operator characteristic curve of greater than 0.70, greater than 0.75, greater than 0.77, greater than 0.80, greater than 0.81, greater than 0.82, or greater than 0.83. In one aspect, the method further comprises converting unmethylated cytosines in the cfDNA to uracil prior to isolating the portion of the cfDNA from the subject by hybridization capture. In another aspect, the method further comprises converting unmethylated cytosines in the cfDNA to uracil after isolating the portion of the cfDNA from the subject by hybridization capture. The classifier can be a binary classifier. In one aspect, isolating a portion of the cfDNA from the subject by hybridization capture comprises contacting the cell-free DNA with a bait set comprising a plurality of different oligonucleotide-containing probes.

In another aspect, provided herein is a method for identifying genomic regions that exhibit differential methylation in cancer samples relative to non-cancer samples, the method comprising: (a) obtaining sequence reads of converted cfDNA from both cancer subjects and non-cancer subjects; (b) identifying, based on the sequence reads, cfDNA fragments that: (i) have a p-value rarity in non-cancerous samples of below a threshold value; and (ii) have at least X CpG sites, wherein at least Y % of the CpG sites are methylated, wherein X is at least 4, 5, 6, 7, 8, 9, or 10 and Y is at least 70; and (c) for each of a plurality of CpG sites in a reference genome, counting both (1) a number of cancer subjects ($N_{cancer}$) and (2) a number of non-cancer subjects ($N_{noncancer}$) that have a fragment identified in step (b); (d) for each of the plurality of CpG sites in the reference genome, determining whether the CpG site is differentially methylated in cancer samples based on criteria comprising $N_{cancer}$ and $N_{non-cancer}$; (e) identifying a genomic region as differentially methylated in cancer based, at least in part, on inclusion of a differentially methylated CpG site within the genomic region. In another aspect, provided herein is a method for identifying genomic regions that exhibit differential methylation in cancer samples relative to non-cancer samples, the method comprising:

(a) obtaining sequence reads of converted cfDNA from both cancer subjects and non-cancer subjects; (b) identifying, based on the sequence reads, cfDNA fragments that: (i) have at least X CpG sites, wherein at least Y % of the CpG sites are unmethylated, wherein X is 4, 5, 6, 7, 8, 9, or 10 and Y is at least 70; and (ii) have a p-value rarity in non-cancerous samples of below a threshold value;

(c) for each of a plurality of CpG sites in a reference genome, counting both (1) a number of cancer subjects ($N_{cancer}$) and (2) a number of non-cancer subjects ($N_{noncancer}$) that have a fragment identified in step (b); (d) for each of the plurality of CpG sites in the reference genome, determining whether the CpG site is differentially methylated in cancer samples based on criteria comprising $N_{cancer}$ and $N_{non-cancer}$; (e) identifying a genomic region as differentially methylated in cancer based, at least in part, on inclusion of a differentially methylated CpG site within the genomic region. In one aspect, the CpG site is considered to be differentially methylated based on criteria positively correlated with $N_{cancer}$ and negatively correlated with $N_{non-cancer}$. In one aspect, the CpG site is considered to be differentially methylated when $(N_{cancer+1})/(N_{cancer}+N_{non-cancer+2})$ is greater than a threshold value. Each of the identified genomic regions can have at least X CpG sites, wherein X is 4, 5, or 6. In one aspect, at least 10%, at least 20%, at least 30%, at least 40%, at least 50%, at least 60%, at least 70%, at least 80%, or at least 90% of the identified regions are from any one of Lists 1-8.

In one aspect, provided herein is a method for developing a bait set for hybridization capture of cfDNA from genomic regions that are differentially methylated between cancer and non-cancer, the method comprising: identifying at least 1000, at least 5,000, at least 10,000, at least 25,000, or at least 30,000 differentially methylated genomic regions of the genome by comparison of one or more parameters derived from cfDNA fragments from cancer subject to one or more parameters derived from cfDNA fragments from non-cancer subjects; and designing, in silico, a plurality of oligonucleotide-containing probes that include a sequence of at least 30 bases in length that is complementary to either (1) a sequence of a genomic region or (2) a sequence that differs from the sequence of the genomic region only by one or more transitions, wherein each respective transition occurs at a cytosine in the genomic region. The method can further comprise removing, in silico, probes that have at least X off-target regions, wherein X is at least one. X can be at least 5, at least 10, or at least 20. The method can further comprise synthesizing the oligonucleotide-containing probes that were designed in silico.

In one aspect, provided herein is a method for selecting probes for hybridization capture of cfDNA, the method comprising: identifying a first set of genomic regions that are preferentially hypermethylated in cfDNA from cancer subjects relative to non-cancer subjects; identifying a second set of genomic regions that are preferentially hypomethylated in cfDNA from cancer subjects relative to non-cancer subjects; and selecting probes for hybridization capture of cfDNA corresponding to the first set of genomic regions and the second set of genomic regions, wherein the probes comprise a first set of probes for hybridization capture of cfDNA corresponding to the first set of genomic regions and a second set of probes for hybridization capture of cfDNA corresponding to the second set of genomic regions; wherein the probes comprise at least 500, at least 1,000, at least 2,500, at least 5,000, at least 10,000, at least 20,000 subsets of probes, wherein each subset of probes comprises a plurality of probes that extend across a genomic region in a 2× tiled fashion. The second set of probes for hybridization capture can comprise selecting probes that differ from a sequence in the genomic region only by one or more transitions, wherein each transition occurs at a nucleotide corresponding to a cytosine in the genomic region. In one aspect, selecting probes for hybridization capture can comprise filtering out probes that have more than a threshold number of off-target regions. Each subset of probes can comprise at least three probes. Each probe can be between 75 and 200, between 100 and 150, between 110 and 130, or 120 nucleotides in length.

In another aspect, provided herein is an assay panel for enriching cfDNA molecules for cancer diagnosis, the assay panel comprising: at least 500 different pairs of polynucleotide probes, wherein each pair of the at least 500 pairs of probes (i) comprises two different probes configured to overlap with each other by an overlapping sequence of 30 or more nucleotides and (ii) is configured to hybridize to a modified fragment obtained from processing of the cfDNA molecules, wherein each of the cfDNA molecules corresponds to or is derived from one or more genomic regions, wherein each of the one or more genomic regions comprises at least five methylation sites and has an anomalous methylation pattern in cancerous training samples relative to non-cancerous training samples. The overlapping sequence can comprise at least 40, 50, 75, or 100 nucleotides. The assay panel can comprise at least 1,000, 2,000, 2,500, 5,000, 6,000, 7,500, 10,000, 15,000, 20,000, or 25,000 pairs of probes.

In another aspect, provided herein is an assay panel for enriching cfDNA molecules for cancer diagnosis, the assay panel comprising: at least 1,000 polynucleotide probes, wherein each of the at least 1,000 probes is configured to hybridize to a modified polynucleotide obtained from processing of the cfDNA molecules, wherein each of the cfDNA molecules corresponds to or is derived from, one or more genomic regions, wherein each of the one or more genomic regions comprises at least five methylation sites, and has an anomalous methylation pattern in cancerous training samples relative to non-cancerous samples. The processing of the cfDNA molecules can comprise converting unmethylated C (cytosine) to U (uracil) in the cfDNA molecules. Each of the polynucleotide probes on the panel can be conjugated to an affinity moiety. The affinity moiety can be a biotin moiety. Each of the one or more genomic regions can be either hypermethylated or hypomethylated in the cancerous training samples relative to non-cancerous reference samples. In one aspect, at least 80%, 85%, 90%, 92%, 95%, or 98% of the probes on the panel can have exclusively either CpG or CpA on CpG detection sites. Each of the probes on the panel can comprise less than 20, 15, 10, 8, or 6 CpG detection sites. Each of the probes on the panel can be designed to have fewer than 20, 15, 10, or 8 off-target genomic regions. In one aspect, the fewer than 20 off-target genomic regions can be identified using a k-mer seeding strategy. In another aspect, the fewer than 20 off-target genomic regions can be identified using k-mer seeding strategy combined to local alignment at seed locations.

The assay panel can comprise at least 1,000, 2,000, 2,500, 5,000, 10,000, 12,000, 15,000, 20,000, or 25,000 probes. In one aspect, at least 500 pairs of probes or the at least 1,000 probes together can comprise at least 0.2 million, 0.4 million, 0.6 million, 0.8 million, 1 million, 2 million, 4 million, or 6 million nucleotides. Each of the probes on the panel can comprise at least 50, 75, 100, or 120 nucleotides. Each of the probes on the panel can comprise less than 300, 250, 200, or 150 nucleotides. Each of the probes on the panel can comprise 100-150 nucleotides. In one aspect, at least 30% of the genomic regions are in exons or introns. In another aspect, at least 15% of the genomic regions can be in exons. In another aspect, at least 20% of the genomic regions can be in exons. Each of the one or more genomic regions can be selected from one of Lists 1-8. An entirety of probes on the assay panel together can be configured to hybridize to modified fragments obtained from the cfDNA molecules corresponding to or derived from at least 30%, 40%, 50%, 60%, 70%, 80%, 90% or 95% of the genomic regions in one or more of Lists 1-8. An entirety of probes on the assay panel together are configured to hybridize to modified fragments obtained from the cfDNA molecules corresponding to or derived from at least 500, 1,000, 5000, 10,000 or 15,000 genomic regions in one or more of Lists 1-8. The processing of the cfDNA molecules can comprise converting unmethylated C (cytosine) to U (uracil) in the cfDNA molecules. Each of probes on the panel can be conjugated to an affinity moiety. The affinity moiety can be biotin. At least 80%, 85%, 90%, 92%, 95%, or 98% of the probes on the panel can have exclusively either CpG or CpA on CpG detection sites.

In another aspect, provided herein is a method of providing sequence information informative of a presence or absence of cancer, the method comprising the steps of: (a) obtaining a test sample comprising a plurality of cfDNA test molecules; (b) processing the cfDNA test molecules, thereby obtaining converted test fragments; (c) contacting the converted test fragments with an assay panel, thereby enriching a subset of the converted test fragments by hybridization capture; and (d) sequencing the subset of the converted test fragments, thereby obtaining a set of sequence reads. The converted test fragments can be bisulfite-converted test fragments. In another aspect, the method further comprises determining a cancer classification by evaluating the set of sequence reads, wherein the cancer classification is (a) a presence or absence of cancer; (b) a stage of cancer; (c) a presence or absence of a type of cancer. In one aspect, the step of determining a cancer classification can comprise: (a) generating a test feature vector based on the set of sequence reads; and (b) applying the test feature vector to a classifier. The classifier can comprise a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments. The classifier can have an area under a receiver operating characteristic curve of greater than 0.70, greater than 0.75, greater than 0.77, greater than 0.80, greater than 0.81, greater than 0.82, or greater than 0.83. At 99% specificity, the classifier can have a sensitivity of at least 35%, at least 40%, at least 45% or at least 50%. In another aspect, the step of determining a cancer classification further comprises: (a) generating a test feature vector based on the set of sequence reads; and (b) applying the test feature vector to a classifier. The classifier can comprise a model trained by a training process with a cancer set of fragments from one or more training subjects with cancer and a non-cancer set of fragments from one or more training subjects without cancer, wherein both cancer set of fragments and the non-cancer set of fragments comprise a plurality of training fragments.

The type of cancer can be selected from the group consisting of head and neck cancer, liver/bile duct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. In one aspect, the classifier, at 99.4% specificity, has a sensitivity of at least 70%, at least 80%, at least 85%, or at least 87% for classifying head and neck cancer. The classifier, at 99.4% specificity can have a sensitivity of at least 60%, at least 65%, at least 70%, or at least 73% for classifying liver/bile duct cancer. The classifier, at 99.4% specificity, can have a sensitivity of at least 70%, at least 75%, at least 80%, or at least 85% for classifying upper GI tract cancer. The classifier, at 99.4% specificity, can have a sensitivity of at least 70%, at least 80%, at least 85%, or at least 90% for classifying pancreatic/gall bladder cancer. The classifier, at 99.4% specificity can have a sensitivity of at least 70%, at least 80%, at least 90%, at least 95%, or at least 98% in classifying colorectal cancer. The classifier, at 99.4% specificity, can have a sensitivity of at least 70%, at least 80%, at least 85%, or at least 87% in classifying ovarian cancer. The classifier, at 99.4% specificity, can have a sensitivity of at least 70%, at least 80%, at least 90%, at least 95%, or at least 97% in classifying lung cancer. The classifier, at 99.4% specificity, can have a sensitivity of at least 70%, at least 80%, at least 85%, or at least 90% or at least 93% in classifying multiple myeloma. The classifier, at 99.4% specificity, can have a sensitivity of at least 70%, at least 80%, at least 90%, or at least 95% or at least 98% in classifying lymphoid neoplasm. The classifier, at 99.4% specificity, can have a sensitivity of at least 70%, at least 80%, at least 90%, or at least 95% or at least 98% in classifying melanoma. The classifier, at 99.4% specificity, can have a sensitivity of at least 35%, at least 40%, at least 45%, or at least 50% in classifying sarcoma. The classifier, at 99.4% specificity, can have a sensitivity of at least 70%, at least 80%, at least 90%, or at least 95% or at least 98% in classifying breast cancer. The classifier, at 99.4% specificity, can have a sensitivity of at least 70%, at least 80%, at least 90%, or at least 95% or at least 97% in classifying uterine cancer.

In one aspect, the method of cancer classification further comprises the steps of: (a) generating a test feature vector based on the set of sequence reads; and (b) applying the test feature vector to a model obtained by a training process with a cancer set of fragments from one or more training subjects with a cancer and a non-cancer set of fragments from one or more training subjects without cancer, wherein both the cancer set of fragments and the non-cancer set of fragments comprise a plurality of training fragments. The training process can comprise: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each training subject, generating a training feature vector based on the hypomethylated training fragments and a training feature vector based on the hypermethylated training fragments, and (d) training the model with the training feature vectors from the one or more training subjects without cancer and the training feature vectors from the one or more training subjects with cancer. The training process can further comprise: (a) obtaining sequence information of training fragments from a plurality of training subjects; (b) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (c) for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; (d) for each training fragment, generating an aggregate hypomethylation score based on the hypomethylation score of the CpG sites in the training fragment and an aggregate hypermethylation score based on the hypermethylation score of the CpG sites in the training fragment; (e) for each training subject: ranking the plurality of training fragments based on aggregate hypomethylation score and ranking the plurality of training fragments based on aggregate hypermethylation score; and generating a feature vector based on the ranking of the training fragments; (f) obtaining training feature vectors for one or more training subjects without cancer and training feature vectors for the one or more training subjects with cancer; and (g) training the model with the feature vectors for the one or more training subjects without cancer and the feature vectors for the one or more training subjects with cancer. The model can comprise one of a kernel logistic regression classifier, a random forest classifier, a mixture model, a convolutional neural network, and an autoencoder model. In one aspect, the method of cancer classification can further comprise the steps of: (a) obtaining a cancer probability for the test sample based on the model; and (b) comparing the cancer probability to a threshold probability to determine whether the test sample is from a subject with cancer or without cancer. In one aspect, the method of identifying a cancer subject can further comprise administering an anti-cancer agent to the subject. The anti-cancer agent can be a chemotherapeutic agent selected from the group consisting of alkylating agents, antimetabolites, anthracyclines, anti-tumor antibiotics, cytoskeletal disruptors (taxans), topoisomerase inhibitors, mitotic inhibitors, corticosteroids, kinase inhibitors, nucleotide analogs, and platinum-based agents.

In another aspect, provided herein is a method comprising the steps of: (a) obtaining a set of sequence reads of modified test fragments, wherein the modified test fragments are or have been obtained by processing a set of nucleic acid fragments from a test subject, wherein each of the nucleic acid fragments corresponds to or is derived from a plurality of genomic regions selected from any one of Lists 1-8; and (b) applying the set of sequence reads or a test feature vector obtained based on the set of sequence reads to a model obtained by a training process with a cancer set of fragments from one or more training subjects with cancer and a non-cancer set of fragments from one or more training subjects without cancer, wherein both cancer set of fragments and the non-cancer set of fragments comprise a plurality of training fragments. The method can further comprise the step of obtaining the test feature vector comprising: (a) for each of the nucleic acid fragments, determining whether the nucleic acid fragment is hypomethylated or hypermethylated, wherein each of the hypomethylated and hypermethylated nucleic acid fragments comprises at least a threshold number of CpG sites with at least a threshold percentage of the CpG sites being unmethylated or methylated, respectively; (b) for each of a plurality of CpG sites in a reference genome: quantifying a count of hypomethylated nucleic acid fragments which overlap the CpG site and a count of hypermethylated nucleic acid fragments which overlap the CpG site; and generating a hypomethylation score and a hypermethylation score based on the count of hypomethylated nucleic acid fragments and hypermethylated nucleic acid fragments; (c) for each nucleic acid fragment, generating an aggregate hypomethylation score based on the hypomethylation score of the CpG sites in the nucleic acid fragment and an aggregate hypermethylation score based on the hypermethylation score of the CpG sites in the nucleic acid fragment; (d) ranking the plurality of nucleic acid fragments based on aggregate hypomethylation score and ranking the plurality of nucleic acid fragments based on aggregate hypermethylation score; and (e) generating the test feature vector based on the ranking of the nucleic acid fragments. The training process can comprise: (a) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (b) for each training subject, generating a training feature vector based on the hypomethylated training fragments and a training feature vector based on the hypermethylated training fragments, and (c) training the model with the training feature vectors from the one or more training subjects without cancer and the feature vectors from the one or more training subjects with cancer. The training process can comprise: (a) for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, (b) for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; (c) for each training fragment, generating an aggregate hypomethylation score based on the hypomethylation score of the CpG sites in the training fragment and an aggregate hypermethylation score based on the hypermethylation score of the CpG sites in the training fragment; (d) for each training subject:

ranking the plurality of training fragments based on aggregate hypomethylation score and ranking the plurality of training fragments based on aggregate hypermethylation score; and generating a feature vector based on the ranking of the training fragments; (e) obtaining training feature vectors for one or more training subjects without cancer and training feature vectors for the one or more training subjects with cancer; and (0 training the model with the feature vectors for the one or more training subjects without cancer and the feature vectors for the one or more training subjects with cancer.

In one aspect, the method can further comprise quantifying a count of hypomethylated training fragments which overlap that CpG site and a count of hypermethylated training fragments which overlap that CpG site for each CpG site in a reference genome comprising the steps of: (a) quantifying a cancer count of hypomethylated training fragments from the one or more training subjects with cancer that overlap that CpG site and a non-cancer count of hypomethylated training fragments from the one or more training subjects without cancer that overlap that CpG site; and (b) quantifying a cancer count of hypermethylated training fragments from the one or more training subjects with cancer that overlap that CpG site and a non-cancer count of hypermethylated training fragments from the one or more training subjects without cancer that overlap that CpG site. For each CpG site in a reference genome, generating a hypomethylation score and a hypermethylation score based on the count of hypomethylated training fragments and hypermethylated training fragments further comprises: (a) for generating the hypomethylation score, calculating a hypomethylation ratio of the cancer count of hypomethylated training fragments over a hypomethylation sum of the cancer count of hypomethylated training fragments and the non-cancer count of hypomethylated training fragments; and (b) for generating the hypermethylation score, calculating a hypermethylation ratio of the cancer count of hypermethylated training fragments over a hypermethylation sum of the cancer count of hypermethylated training fragments and the non-cancer count of hypermethylated training fragments. The model can comprise one of a kernel logistic regression classifier, a random forest classifier, a mixture model, a convolutional neural network, and an autoencoder model. In one aspect, the set of sequence reads can be obtained by using the assay panel described in this invention.

In one aspect, provided herein is a method of designing an assay panel for cancer diagnosis, comprising the steps of: (a) identifying a plurality of genomic regions, wherein each of the plurality of genomic regions (i) comprises at least 30 nucleotides, and (ii) comprises at least five methylation sites, (b) selecting a subset of the genomic regions, wherein the selection is made when cfDNA molecules corresponding to or derived from each of the genomic regions in cancer training samples have an anomalous methylation pattern, wherein the anomalous methylation pattern comprises at least five methylation sites known to be, or identified as, either hypomethylated or hypermethylated, and (c) designing the assay panel comprising a plurality of probes, wherein each of the probes is configured to hybridize to a modified fragment obtained from processing cfDNA molecules corresponding to or derived from one or more of the subset of the genomic regions. The processing of the cfDNA molecules can comprise converting unmethylated C (cytosine) to U (uracil) in the cfDNA molecules.

In another aspect, provided herein is a cancer assay panel, comprising: at least 500 pairs of probes, wherein each pair of the at least 500 pairs comprises two probes configured to overlap each other by an overlapping sequence, wherein the overlapping sequence comprises a 30-nucleotide sequence, and wherein the 30-nucleotide sequence is configured to have sequence complementarity with one or more genomic regions, wherein the one or more genomic regions have at least five methylation sites, and wherein the at least five methylation sites have an abnormal methylation pattern in non-cancerous samples or cancerous samples. The overlapping sequence comprises at least 40, 50, 75, or 100 nucleotides. The cancer assay panel can comprise at least 1,000, 2,000, 2,500, 5,000, 6,000, 7,500, 10,000, 15,000, 20,000 or 25,000 pairs of probes.

In another aspect, provided herein is a cancer assay panel, comprising: at least 1,000 probes, wherein each of the probes is designed as a hybridization probe complementary to one or more genomic regions, wherein each of the genomic regions comprises: (i) at least 30 nucleotides, and (ii) at least five methylation sites, wherein the at least five methylation sites have an abnormal methylation pattern and are either hypomethylated or hypermethylated in cancerous samples or non-cancerous samples. The abnormal methylation pattern can have at least a threshold p-value rarity in the non-cancerous samples. In one aspect, each of the probes is designed to have less than 20 off-target genomic regions. In one aspect, the less than 20 off-target genomic regions are identified using a k-mer seeding strategy. In another aspect, the less than 20 off-target genomic regions are identified using k-mer seeding strategy combined to local alignment at seed locations.

In one aspect, each of the genomic regions can be selected based on criteria comprising: (a) a number ($N_{cancer}$) of the cancerous samples including at least one cfDNA fragment having the abnormal methylation pattern; and (b) a number (Nₙₒₙ-cancer) of the non-cancerous samples including at least one cfDNA fragment having the abnormal methylation pattern. Each of the genomic regions can be selected based on criteria positively correlated to $N_{cancer}$ and inversely correlated to the sum of $N_{cancer}$ and $N_{non-cancer}$, comprising at least 1,000, 2,000, 2,500, 5,000, 10,000, 12,000, 15,000, 20,000, 30,000, 40,000, or 50,000 probes. In one aspect, the at least 500 pairs of probes or the at least 1,000 probes together comprise at least 0.2 million, 0.4 million, 0.6 million, 0.8 million, 1 million, 2 million, 3 million, 4 million, 5 million, or 6 million nucleotides. Each of the probes can comprise at least 50, 75, 100, or 120 nucleotides. Each of the probes can comprise less than 300, 250, 200, or 150 nucleotides. Each of the probes can comprise 100-150 nucleotides. Each of the probes can comprise less than 20, 15, 10, 8, or 6 methylation sites. In one aspect, at least 80%, 85%, 90%, 92%, 95%, or 98% of the at least five methylation sites are either methylated or unmethylated in the cancerous samples.

In one aspect, each of the probes is configured to have less than 20, 15, 10, or 8 off-target genomic regions. In one aspect, at least 30% of the genomic regions are in exons or introns. In another aspect, at least 15% of the genomic regions are in exons. In another aspect, at least 20% of the genomic regions are in exons. In another aspect, less than 10% of the genomic regions are in intergenic regions. The genomic regions can be selected from any one of Lists 1-8. The genomic regions can be selected from List 3. The genomic regions can be selected from List 8. The genomic regions can comprise at least 20%, 30%, 40%, 50%, 60%, 70%, 80%, 90% or 95% of the genomic regions in any one of Lists 1-8. The genomic regions can comprise at least 20%, 30%, 40%, 50%, 60%, 70%, 80%, 90% or 95% of the genomic regions in List 3. The genomic regions can comprise at least 20%, 30%, 40%, 50%, 60%, 70%, 80%, 90% or 95% of the genomic regions in List 5. The genomic regions can comprise at least 20%, 30%, 40%, 50%, 60%, 70%, 80%, 90% or 95% of the genomic regions in List 8. In one aspect, the at least 1,000 or at least 2,000 probes are configured to be complementary to at least 500, 1,000, 5000, 10,000 or 15,000 genomic regions in any one of Lists 1-8. In another aspect, the at least 1,000 or at least 2,000 probes are configured to be complementary to at least 500, 1,000, 5000, 10,000 or 15,000 genomic regions in List 3. In another aspect, the at least 1,000 or at least 2,000 probes are configured to be complementary to at least 500, 1,000, 5000, 10,000 or 15,000 genomic regions in List 5. In another aspect, the at least 1,000 or at least 2,000 probes are configured to be complementary to at least 1,000, 5000, 10,000 or 15,000 genomic regions in List 8. The 30-nucleotide sequence can comprise at least five CpG detection sites, wherein at least 80% of the at least five CpG detection sites comprise CpG, UpG, or CpA.

Provided herein is a cancer assay method comprising: receiving a sample comprising a plurality of nucleic acid fragments; treating the plurality of nucleic acid fragments to convert unmethylated cytosine to uracil, thereby obtaining a plurality of converted nucleic acid fragments; hybridizing the plurality of converted nucleic acid fragments with the probes on the cancer assay panel of any of above claims; enriching a subset of the plurality of converted nucleic acid fragments; and sequencing the enriched subset of the converted nucleic acid fragments, thereby providing a set of sequence reads. The method can further comprise the step of: determining a health condition by evaluating the set of sequence reads, wherein the health condition is (i) a presence or absence of cancer, or (ii) a stage of cancer. The set of nucleic acid fragments can be obtained from a human subject.

In another aspect, provided herein is a method for diagnosing cancer, comprising the steps of:

(a) obtaining a set of sequence reads by sequencing a set of nucleic acid fragments from a subject;

(b) determining methylation status of a plurality of genomic regions, the plurality of genomic regions comprise genomic regions selected from the genomic regions in any one of Lists 1-8; and (c) determining a health condition of the subject by evaluating the methylation status, wherein the health condition is (i) a presence or absence of cancer; or (ii) a stage of cancer. The genomic regions can be selected from List 3. The genomic regions can be selected from List 5. The genomic regions can be selected from List 8.

In another aspect, provided herein is a method for diagnosing cancer, comprising the steps of:

(a) obtaining a set of sequence reads by sequencing a set of nucleic acid fragments from a subject;

(b) determining methylation status of a plurality of genomic regions, the plurality of genomic regions comprise at least 20%, 30%, 40%, 50%, 60%, 70%, 80%, 90% or 95% of the genomic regions in any one of Lists 1-8; and (c) determining a health condition of the subject by evaluating the methylation status, wherein the health condition is (i) a presence or absence of cancer; or (ii) a stage of cancer. The genomic regions can comprise at least 20%, 30%, 40%, 50%, 60%, 70%, 80%, 90% or 95% of the genomic regions in List 3. The genomic regions can comprise at least 20%, 30%, 40%, 50%, 60%, 70%, 80%, 90% or 95% of the genomic regions in List 5. The genomic regions can comprise at least 20%, 30%, 40%, 50%, 60%, 70%, 80%, 90% or 95% of the genomic regions in List 8.

In another aspect, provided herein is a method for diagnosing cancer, comprising the steps of:

(a) obtaining a set of sequence reads by sequencing a set of nucleic acid fragments from a subject;

(b) determining methylation status of a plurality of at least 1,000, 2,000, 2,500, 5,000, 6,000, 7,500, 10,000, 15,000, 20,000 or 25,000 genomic regions among genomic regions in any one of Lists 1-8; and (c) determining a health condition of the subject by evaluating the methylation status, wherein the health condition is (i) a presence or absence of cancer; or (ii) a stage of cancer. In one aspect, at least 1,000, 2,000 probes can be configured to be complementary to at least 500, 1,000, 5000, 10,000 or 15,000 genomic regions in List 3. In one aspect, at least 1,000, 2,000 probes can be configured to be complementary to at least 500, 1,000, 5000, 10,000 or 15,000 genomic regions in List 5. In one aspect, at least 1,000, 2,000 probes can be configured to be complementary to at least 500, 1,000, 5000, 10,000 or 15,000 genomic regions in List 8.

In another aspect, provided herein is a method of designing a cancer assay panel comprising the steps of: identifying a plurality of genomic regions, wherein each of the plurality of genomic regions (i) comprises at least 30 nucleotides, and (ii) comprises at least five methylation sites, wherein the at least five methylation sites are either hypomethylated or hypermethylated, comparing methylation status of the at least five methylation sites in each of the plurality of genomic regions between cancerous samples and non-cancerous samples, selecting a subset of the genomic regions, wherein at least five methylation sites of the subset of the genomic regions have an abnormal methylation pattern in cancerous samples relative to non-cancerous samples, and designing a cancer assay panel comprising a plurality of probe sets, wherein each of the plurality of probe sets comprises at least a pair of probes configured to target one of the subset of the genomic regions. In one aspect, the abnormal methylation pattern matches that of a cfDNA fragment from the cancerous samples overlapping at least one of the at least five methylation sites, wherein the cfDNA has at least a threshold p-value rarity relative to a training data set of the non-cancerous samples. In one aspect, the method further comprises the step of selecting based on criteria comprising: (a) a number $N_{cancer}$ of the cancerous samples including cfDNA fragments having the abnormal methylation pattern; and (b) a number $N_{non-cancer}$ of the non-cancerous samples including cfDNA fragments having the abnormal methylation pattern. In one aspect, the step of selecting is based on criteria positively correlated to $N_{cancer}$ and inversely correlated to the sum of $N_{cancer}$ and $N_{non-cancer}$. Each of the plurality of probes can have less than 20, 15, 10 or 8 off-target genomic regions. In one aspect, the less than 20, 15, 10, or 8 off-target genomic regions are identified using a k-mer seeding strategy. In one aspect, the less than 20, 15, 10 or 8 off-target genomic regions are identified using k-mer seeding strategy combined to local alignment at seed locations. The method can further comprise the step of making the cancer assay panel comprising the plurality of probes.

In another aspect, provided herein is a cancer assay panel comprising a plurality of probes made by the method described above. The subset of genomic regions in the cancer assay panel can comprise genomic regions of any one of Lists 1-8. The subset of genomic regions in the cancer assay panel can comprise genomic regions of List 3. The subset of genomic regions in the cancer assay panel can comprise genomic regions of List 5. The subset of genomic regions in the cancer assay panel can comprise genomic regions of List 8. The subset of the genomic regions in the cancer assay panel can comprise at least 20%, 30%, 40%, 50%, 60%, 70%, 80%, or 90% of the genomic regions in one or more of any one of Lists 1-8. The subset of the genomic regions in the cancer assay panel can comprise at least 20%, 30%, 40%, 50%, 60%, 70%, 80%, or 90% of the genomic regions in List 3. The subset of the genomic regions in the cancer assay panel can comprise at least 20%, 30%, 40%, 50%, 60%, 70%, 80%, or 90% of the genomic regions in List 5. The subset of the genomic regions in the cancer assay panel can comprise at least 20%, 30%, 40%, 50%, 60%, 70%, 80%, or 90% of the genomic regions in List 8. The subset of the genomic regions can comprise at least 500, 1,000, 5000, 10,000, 15,000, 20,000 or 25,000 genomic regions in any one of Lists 1-8. The subset of the genomic regions can comprise at least 500, 1,000, 5000, 10,000, 15,000, 20,000 or 25,000 genomic regions in List 3. The subset of the genomic regions can comprise at least 500, 1,000, 5000, 10,000, 15,000, 20,000 or 25,000 genomic regions in List 5. The subset of the genomic regions can comprise at least 500, 1,000, 5000, 10,000, 15,000, 20,000 or 25,000 genomic regions in List 8.

In another aspect, provided herein is a cancer assay panel comprising a plurality of probes, wherein each of the plurality of probes is configured to overlap with one of the genomic regions in any one of Lists 1-8, and the plurality of probes together overlap with at least 90%, 95% or 100% of the genomic regions in any one of Lists 1-8. In another aspect, provided herein is a cancer assay panel comprising a plurality of probes, wherein each of the plurality of probes is configured to overlap with one of the genomic regions in any one of Lists 1-8, and the plurality of probes together overlap with at least 500, 1,000, 5000, 10,000 or 15,000 genomic regions in any one of Lists 1-8.

The present description provides: a cancer assay panel comprising at least 500 pairs of probes, wherein each pair of the at least 500 pairs comprises two probes configured to overlap each other by an overlapping sequence, wherein the overlapping sequence comprises a 30-nucleotide fragment, the 30-nucleotide fragment comprises at least five CpG sites, wherein at least 80% of the at least five CpG sites comprise either CpG or at least 80% of the at least five CpG sites comprise UpG, and wherein the 30-nucleotide fragment is configured to bind to one or more genomic regions in cancerous samples, wherein the one or more genomic regions have at least five methylation sites, wherein the at least five methylation sites have an abnormal methylation pattern in non-cancerous samples or cancerous samples.

In some embodiments, the overlapping sequence comprises at least 40, 50, 75, or 100 nucleotides. In some embodiments, the cancer assay panel comprises at least 1,000, 2,000, 2,500, 5,000, 6,000, 7,500, 10,000, 15,000, 20,000 or 25,000 pairs of probes.

Another aspect of the present description provides a cancer assay panel, comprising: at least 1,000 probes, wherein each of the probes is designed as a hybridization probe complementary to one or more genomic regions, wherein each of the genomic regions comprises: (i) at least 30 nucleotides, and (ii) at least five methylation sites, wherein the at least five methylation sites have an abnormal methylation pattern and are either hypomethylated or hypermethylated in cancerous samples or non-cancerous samples.

In some embodiments, the abnormal methylation pattern has at least a threshold p-value rarity in the non-cancerous samples. In some embodiments, each of the probes is designed to be complementary to less than 20 off-target genomic regions.

In some embodiments, each of the genomic regions was selected based on criteria comprising: a number ($N_{cancer}$) of the cancerous samples including cfDNA fragments having the abnormal methylation pattern; and a number ($N_{non-cancer}$) of the non-cancerous samples including cfDNA fragments having the abnormal methylation pattern.

In some embodiments, each of the genomic regions was selected based on criteria positively correlated to $N_{cancer}$ and inversely correlated to the sum of $N_{cancer}$ and $N_{non-cancer}$.

In some embodiments, the cancer assay panel comprises at least 1,000, 2,000, 2,500, 5,000, 10,000, 12,000, 15,000, 20,000, 30,000, 40,000, 50,000, or 100,000 probes. In some embodiments, the at least 1,000 pairs of probes or the at least 2,000 probes together comprise at least 0.2 million, 0.4 million, 0.6 million, 0.8 million, 1 million, 2 million, 3 million, 4 million, 5 million, 6 million nucleotides, 7 million nucleotides, 8 million nucleotides, 9 million nucleotides, or 10 million nucleotides. In some embodiments, each of the probes comprises at least 50, 75, 100, or 120 nucleotides. In some embodiments, each of the probes comprises less than 300, 250, 200, or 150 nucleotides. In some embodiments, each of the probes comprises 100-150 nucleotides. In some embodiments, each of the probes comprises less than 20, 15, 10, 8, or 6 methylation sites. In some embodiments, at least 80%, 85%, 90%, 92%, 95%, or 98% of the at least five methylation sites are either methylated or unmethylated in the cancerous samples. In some embodiments, each of the probes is configured to be complementary to less than 20, 15, 10 or 8 off-target genomic regions.

In some embodiments, at least 15%, 20%, 30%, or 40% of the genomic regions are in exons or introns. In some embodiments, at least 5%, 10%, 15%, 20%, 30% or 40% of the genomic regions are in exons. In some embodiments, less than 5%, 10%, 15%, 20%, 25%, or 30% of the genomic regions are in intergenic regions. In some embodiments, between 20% and 60%, between 30% and 50%, or between 35% and 55% of the genomic regions are in introns or exons. In some embodiments, between 5% and 30% between 10% and 25%, or between 12% and 20% of the genomic regions are in exons. In some embodiments, between 5% and 20% of the genomic regions are in intergenic regions.

In some embodiments, the genomic regions are selected from any one of Lists 1-8. In some embodiments, the genomic regions comprise at least 20%, 30%, 40%, 50%, 60%, 70%, 80%, 90% or 95% of the genomic regions in any one of Lists 1-8. In some embodiments, the at least 1,000 probes are configured to be complementary to at least 500, 1,000, 5000, 10,000 or 15,000 genomic regions in any one of Lists 1-8.

In another aspect, the present description provides a cancer assay method comprising receiving a sample comprising a plurality of nucleic acid fragments; treating the plurality of nucleic acid fragments to convert unmethylated cytosine to uracil, thereby obtaining a plurality of converted nucleic acid fragments; hybridizing the plurality of converted nucleic acid fragments with the probes on the cancer assay panel of any of the above claims; enriching a subset of the converted nucleic acid fragments; and sequencing the enriched subset of the converted nucleic acid fragments, thereby providing a set of sequence reads.

In some embodiment, the method further comprises the step of determining a health condition by evaluating the set of sequence reads, wherein the health condition is a presence or absence of cancer and/or, cancer stage.

In some embodiments, the set of nucleic acid fragments is obtained from a human subject.

In other aspect, the present description provides a method of diagnosing cancer, comprising the steps of: (a) obtaining a set of sequence reads by sequencing a set of nucleic acid fragments from a subject; (b) determining methylation status of a plurality of genomic regions, the plurality of genomic regions comprise genomic regions of any one of Lists 1-8; and (c) determining a health condition of the subject by evaluating the methylation status, wherein the health condition is (i) a presence or absence of cancer; or (ii) a stage of cancer. In other aspect, the present description provides a method for diagnosing cancer, comprising the steps of: (a) obtaining a set of sequence reads by sequencing a set of nucleic acid fragments from a subject; (b) determining methylation status of a plurality of genomic regions, the plurality of genomic regions comprise at least 20%, 30%, 40%, 50%, 60%, 70%, 80%, 90% or 95% of the genomic regions in any one of Lists 1-8; and (c) determining a health condition of the subject by evaluating the methylation status, wherein the health condition is (i) a presence or absence of cancer; or (ii) a stage of cancer. In other aspects, the present description provides a method for diagnosing cancer, comprising the steps of: (a) obtaining a set of sequence reads by sequencing a set of nucleic acid fragments from a subject; (b) determining methylation status of a plurality of at least 1,000, 2,000, 2,500, 5,000, 6,000, 7,500, 10,000, 15,000, 20,000 or 25,000 genomic regions among genomic regions in any one of Lists 1-8; and (c) determining a health condition of the subject by evaluating the methylation status, wherein the health condition is (i) a presence or absence of cancer; or (ii) a stage of cancer.

Yet another aspect provides a method of designing a cancer assay panel comprising the steps of: identifying a plurality of genomic regions, wherein each of the plurality of genomic regions (i) comprises at least 30 nucleotides, and (ii) comprises at least five methylation sites, comparing methylation status of the at least five methylation sites in each of the plurality of genomic regions between cancerous samples and non-cancerous samples, wherein the at least five methylation sites are either hypomethylated or hypermethylated, selecting a subset of the genomic regions, wherein at least five methylation sites of the subset of the genomic regions have an abnormal methylation pattern in cancerous samples relative to non-cancerous samples, and designing a cancer assay panel comprising a plurality of probe sets, wherein each of the plurality of probe sets comprises at least a pair of probes configured to target (e.g., to be complementary to either converted or non-converted fragments corresponding to) one of the subset of the genomic regions.

In some embodiments, the abnormal methylation pattern matches that of a cfDNA fragment from the cancerous samples overlapping at least one of the at least five methylation sites, wherein the cfDNA has at least a threshold p-value rarity relative to a training data set of the non-cancerous samples.

In some embodiments, the step of selecting is performed based on criteria comprising: a number $N_{cancer}$ of the cancerous samples including cfDNA fragments having the abnormal methylation pattern; and a number $N_{non-cancer}$ of the non-cancerous samples including cfDNA fragments having the abnormal methylation pattern. In some embodiments, the step of selecting is based on criteria positively correlated to $N_{cancer}$ and inversely correlated to the sum of $N_{cancer}$ and $N_{non-cancer}$.

In some embodiments, each of the plurality of probes has less than 20, 15, 10 or 8 off-target genomic regions. In some embodiments, the method further comprises the step of: making the cancer assay panel comprising the plurality of probes.

Another aspect of the present description provides a cancer assay panel made by the method provided herein. In some embodiments, the subset of genomic regions comprises genomic regions of any one of Lists 1-8. In some embodiments, the subset of the genomic regions comprises at least 20%, 30%, 40%, 50%, 60%, 70%, 80%, or 90% of the genomic regions in any one of Lists 1-8. In some embodiments, the subset of the genomic regions comprises at least 500, 1,000, 5000, 10,000 or 15,000 genomic regions in any one of Lists 1-8.

Another aspect of the present description provides a cancer assay panel comprising a plurality of probes, wherein each of the plurality of probes is configured to overlap with one of the genomic regions in any one of Lists 1-8, and the plurality of probes together overlap with at least 90%, 95% or 100% of the genomic regions in any one of Lists 1-8. In yet another aspect, the present description provides a cancer assay panel comprising a plurality of probes, wherein each of the plurality of probes is configured to overlap with one of the genomic regions in any one of Lists 1-8, and the plurality of probes together overlap with at least 500, 1,000, 5000, 10,000 or 15,000 genomic regions in any one of Lists 1-8.

5. BRIEF DESCRIPTION OF THE DRAWINGS

FIG. 5 is an illustration of an example p-value score calculation, according to an embodiment.

Figure 8A:
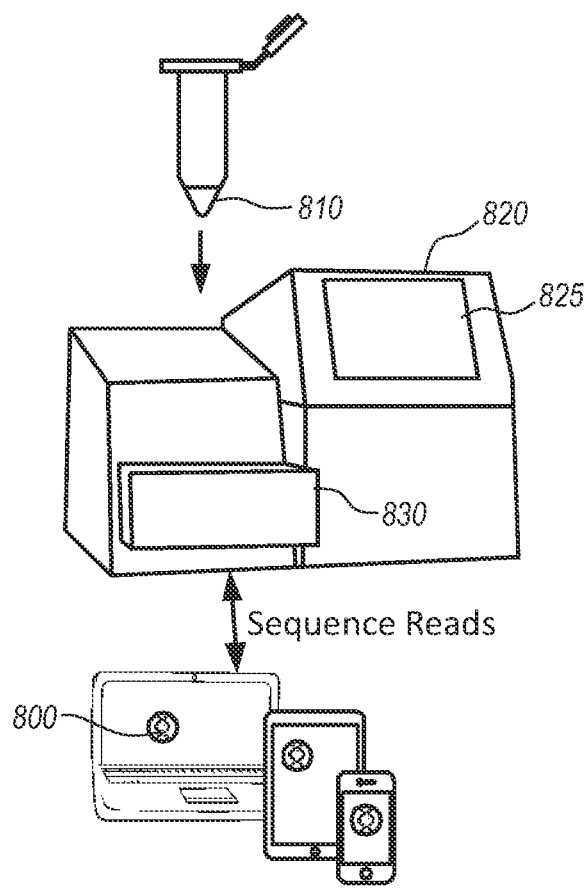
FIG. 8A is a flowchart of devices for sequencing nucleic acid samples according to one embodiment.
Figure 8B:
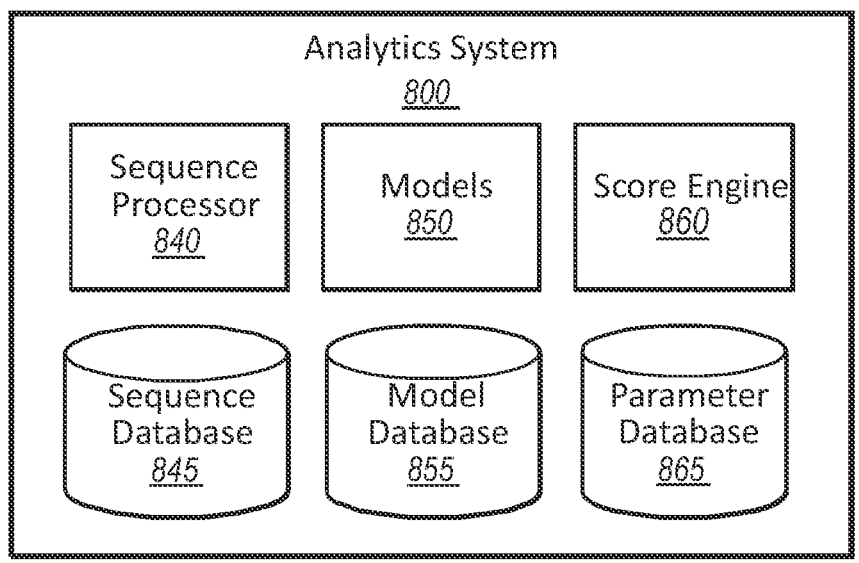

FIG. 8B provides an analytic system that analyzes methylation status of cfDNA according to one embodiment.

Figure 9A:
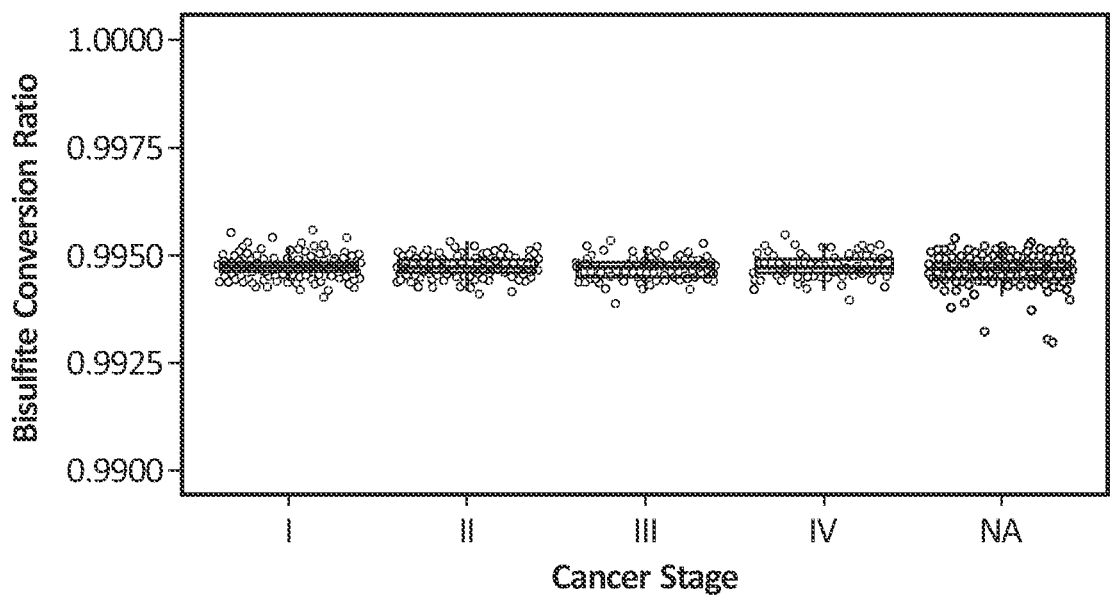
Figure 9B:
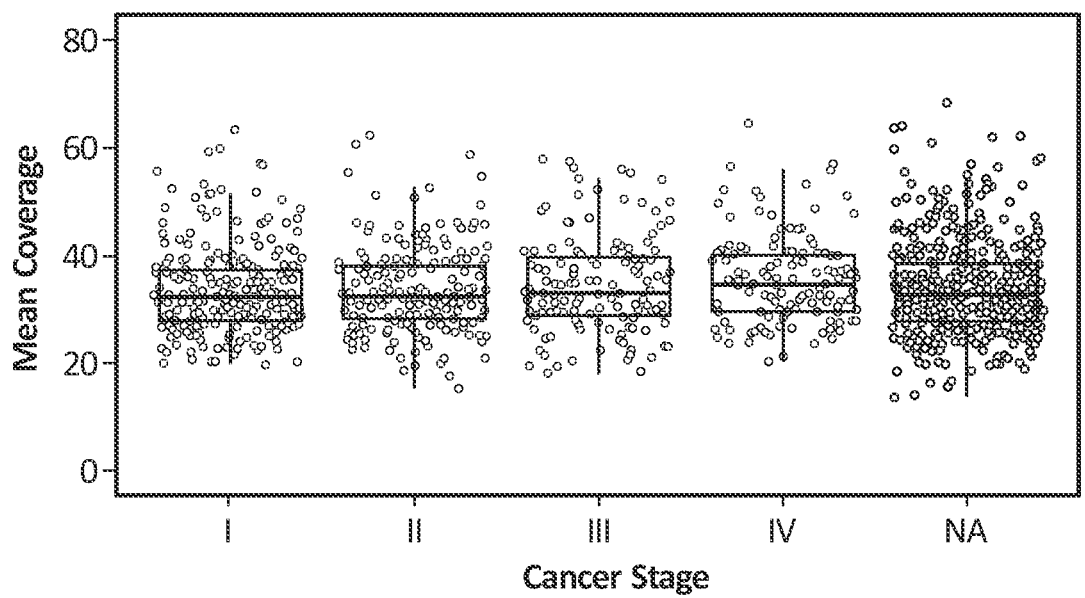
Figure 9C:
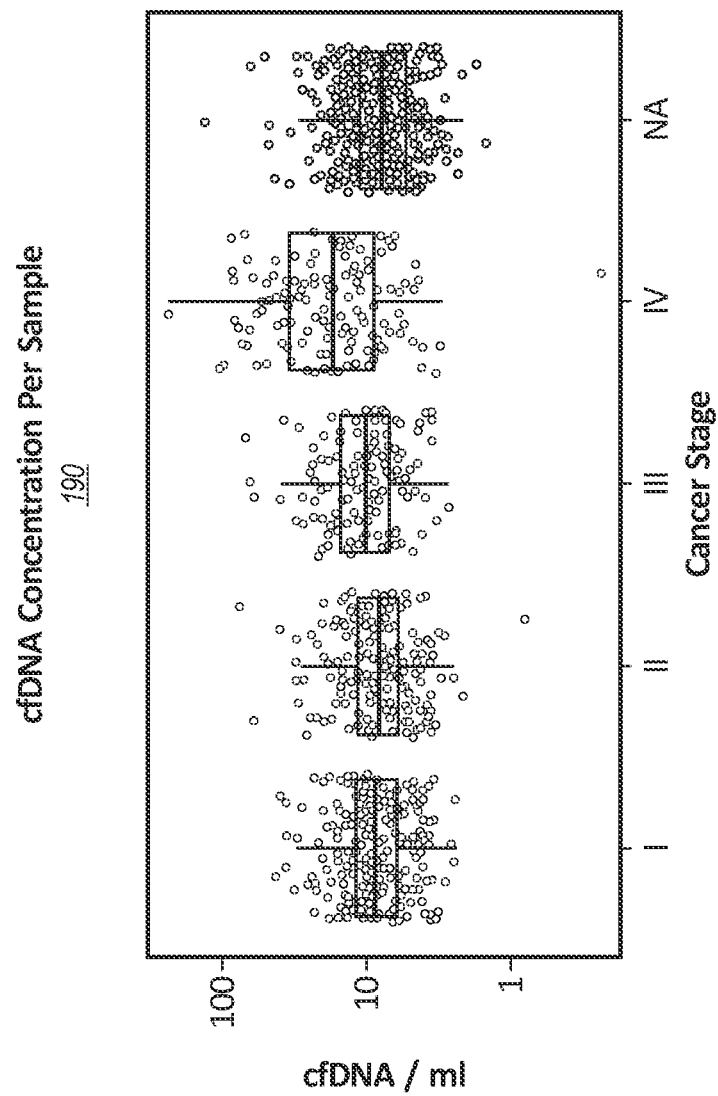

FIGS. 9A-9C show three graphs of data validating the consistency of sequencing from a control group.

Figure 10:
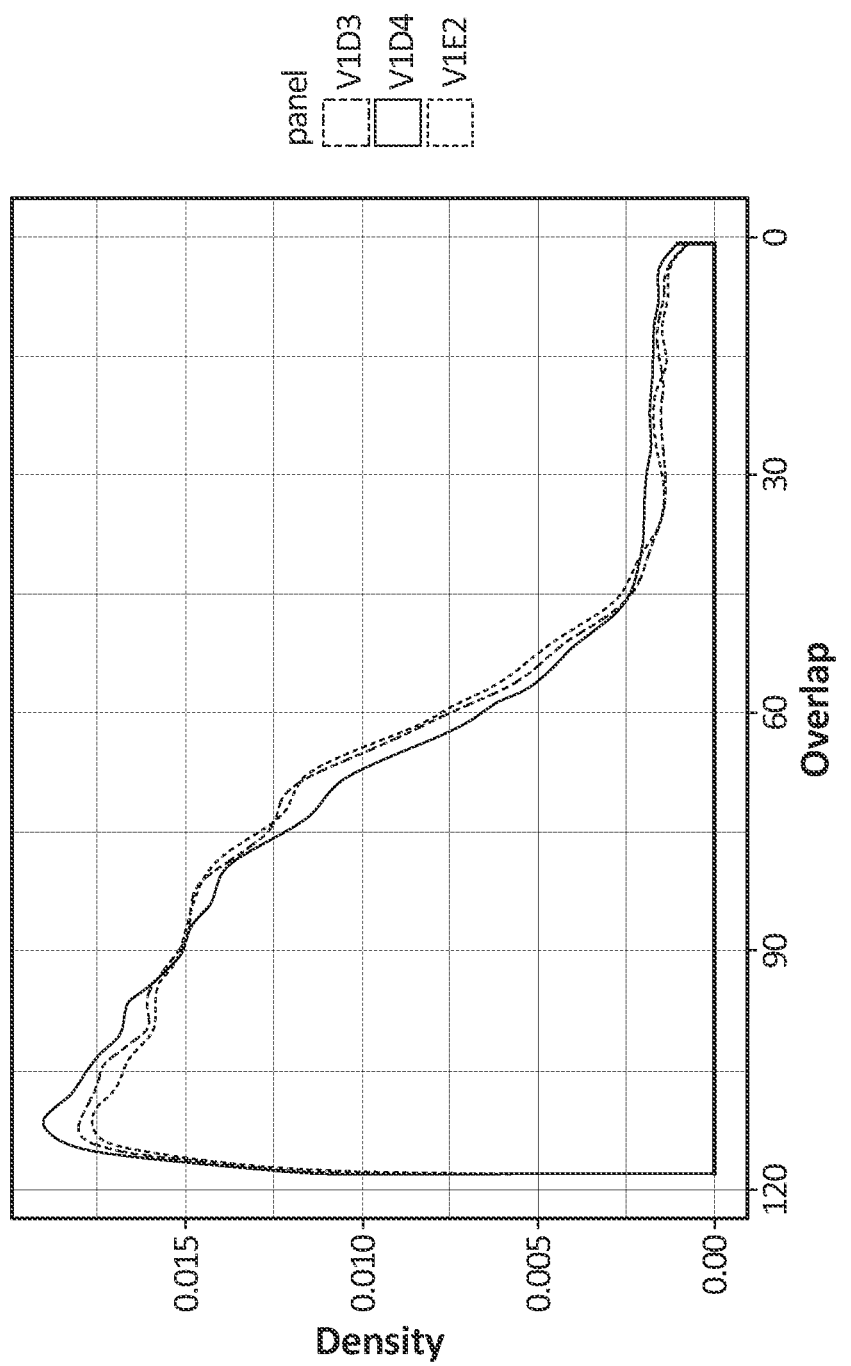

FIG. 10 is a graph of the amounts of DNA fragments binding to probes depending on the sizes of overlaps between the DNA fragments and the probes.

Figure 11:
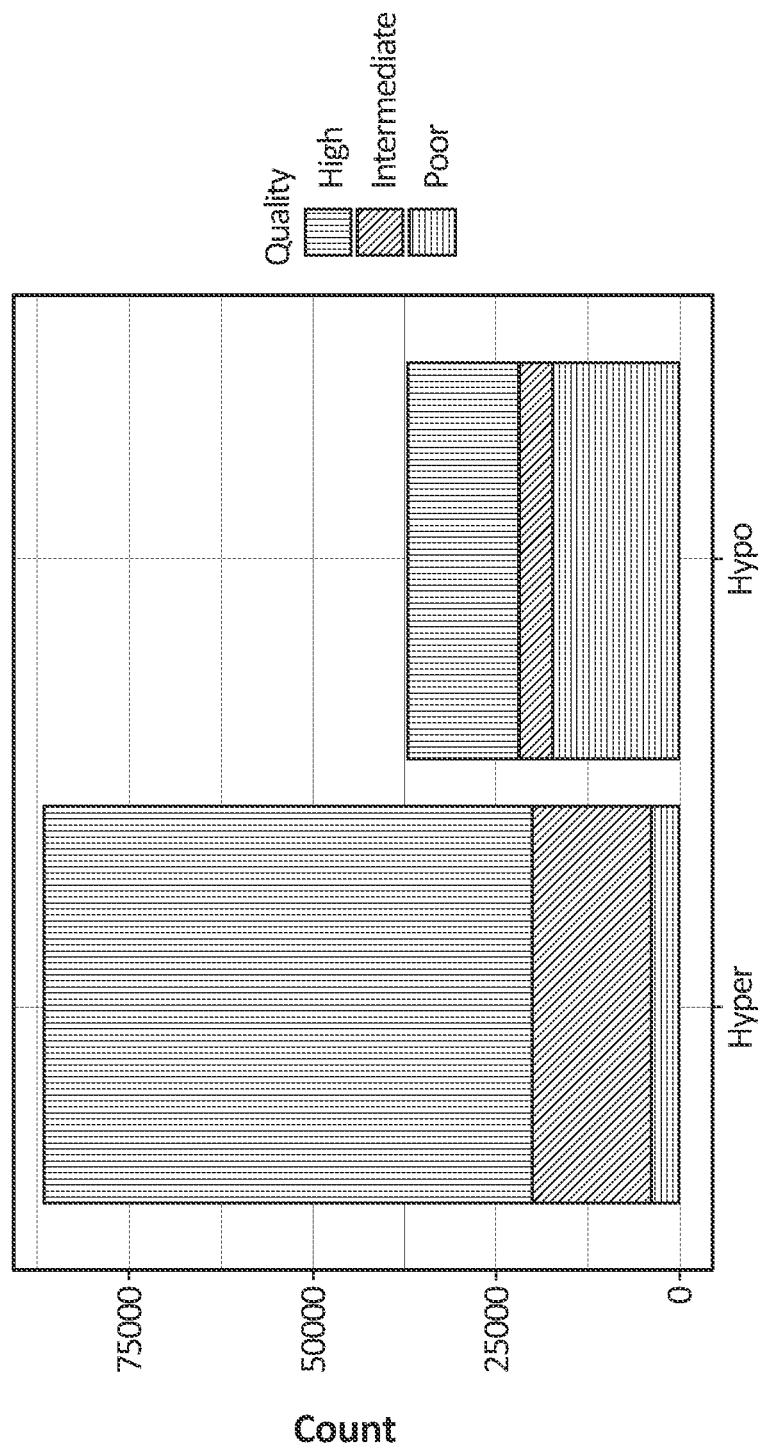

FIG. 11 compares the numbers of high quality, intermediate quality, and poor quality probes among the probes targeting hypermethylated fragments (Hyper) or hypomethylated fragments (Hypo).

Figure 12B:
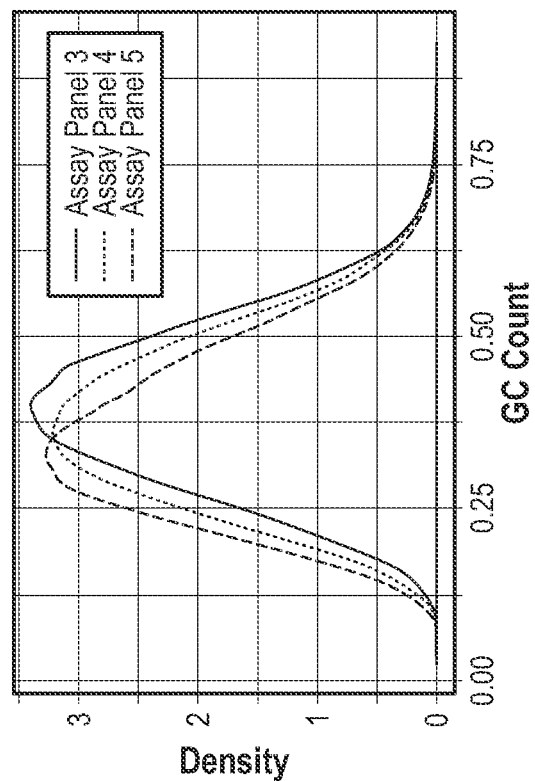
Figure 12A:
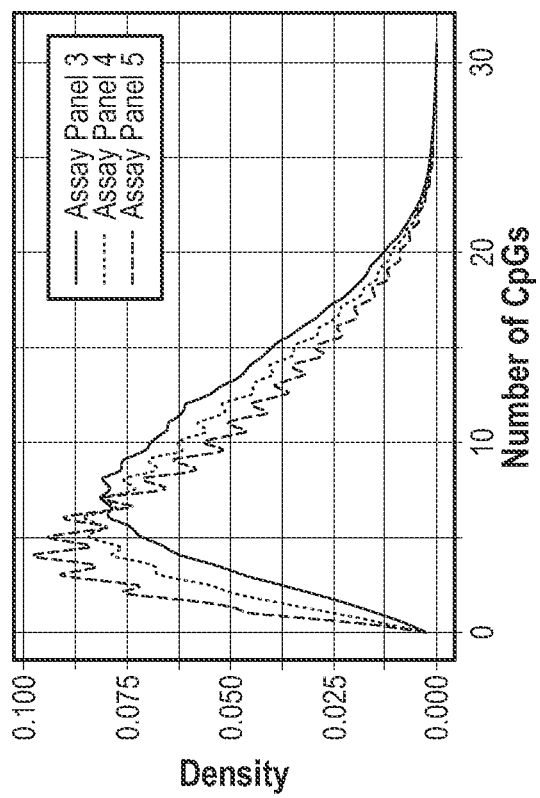

FIG. 12A shows the number, for various assay panels, the number of CpGs as a function of density.

FIG. 12B shows, for various assay panels, the G/C fraction as a function of density.

Figure 13A:
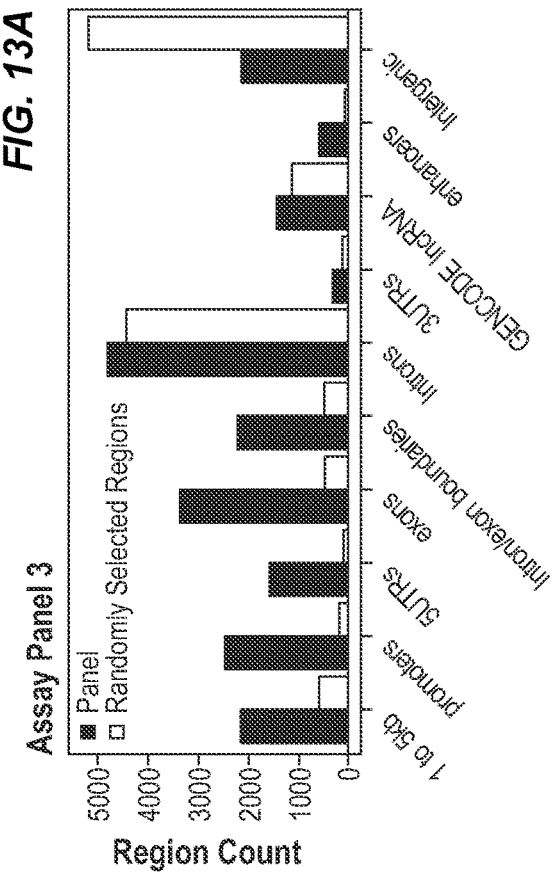
Figure 13C:
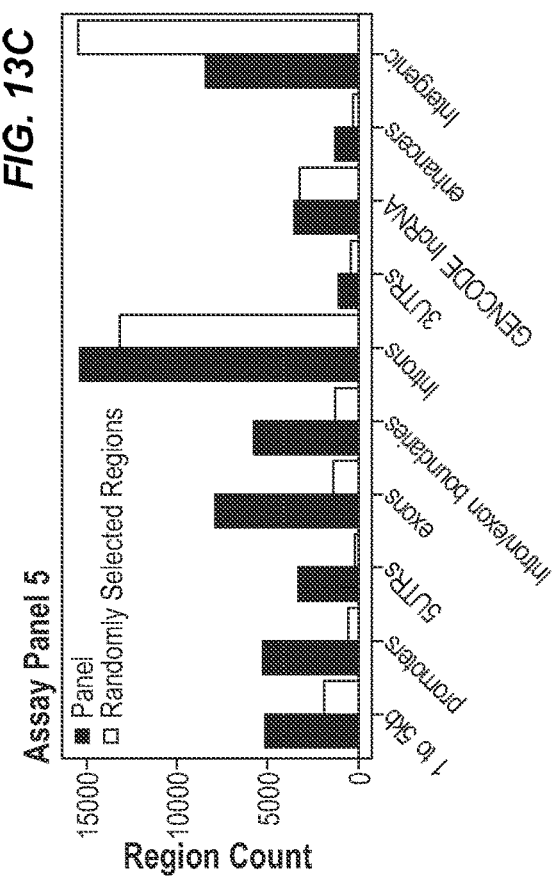
Figure 13B:
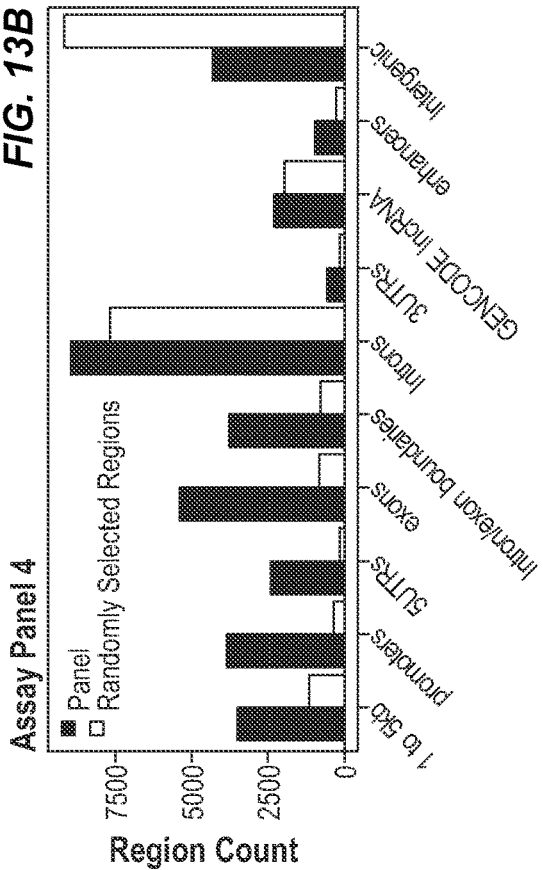

FIGS. 13A-13C summarize frequencies of genomic annotations of targeted genomic regions (black) and randomly selected regions (white) in the indicated Assay Panels.

Figures 14A, 14B:
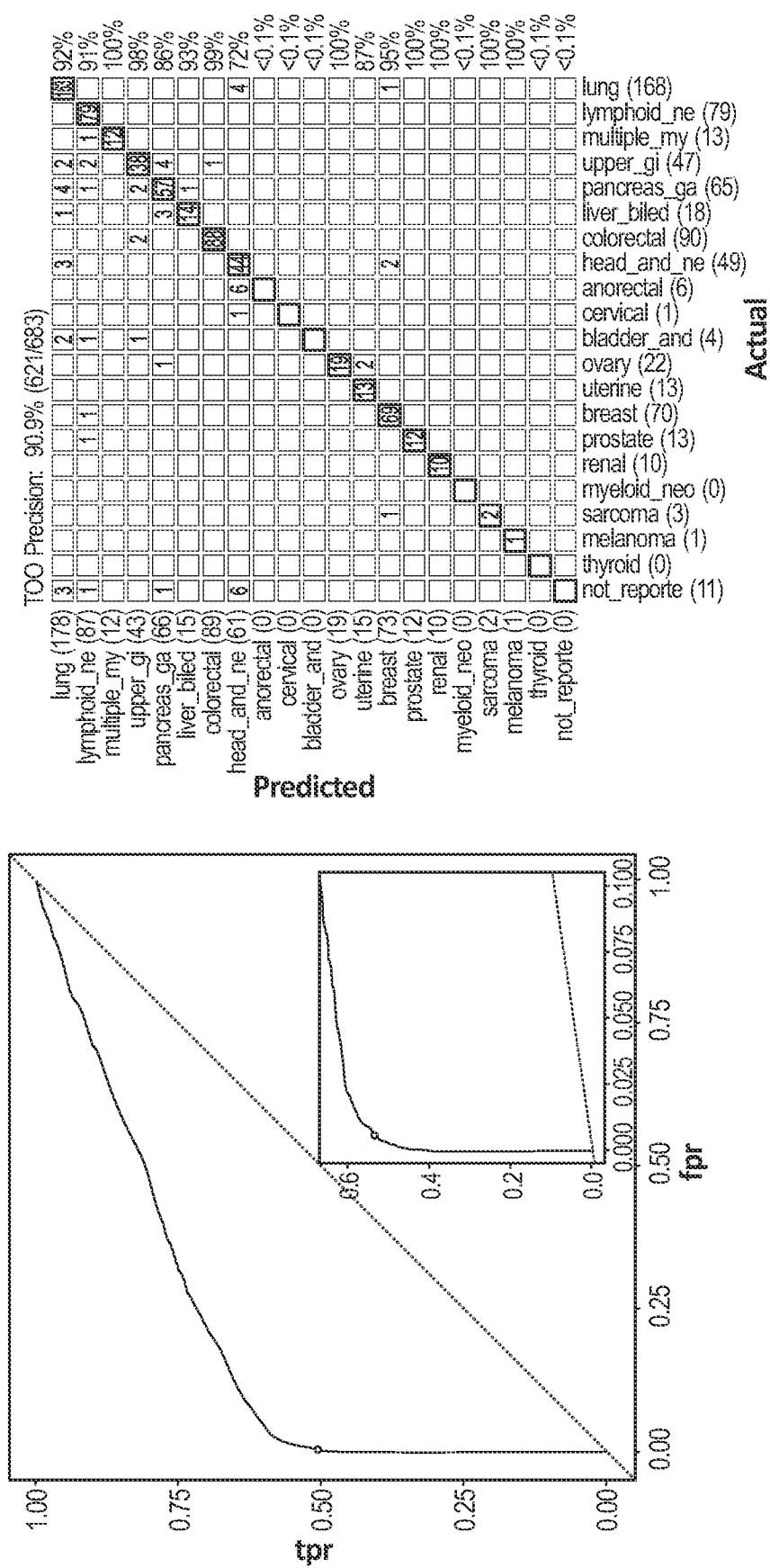

FIG. 14A depicts a receiver operator curve (ROC) showing the sensitivity and specificity of cancer detection using Assay Panel 1.

FIG. 14B is a confusion matrix depicting the accuracy of tissue of origin (TOO) classifications using Assay Panel 1.

Figures 15A, 15B:
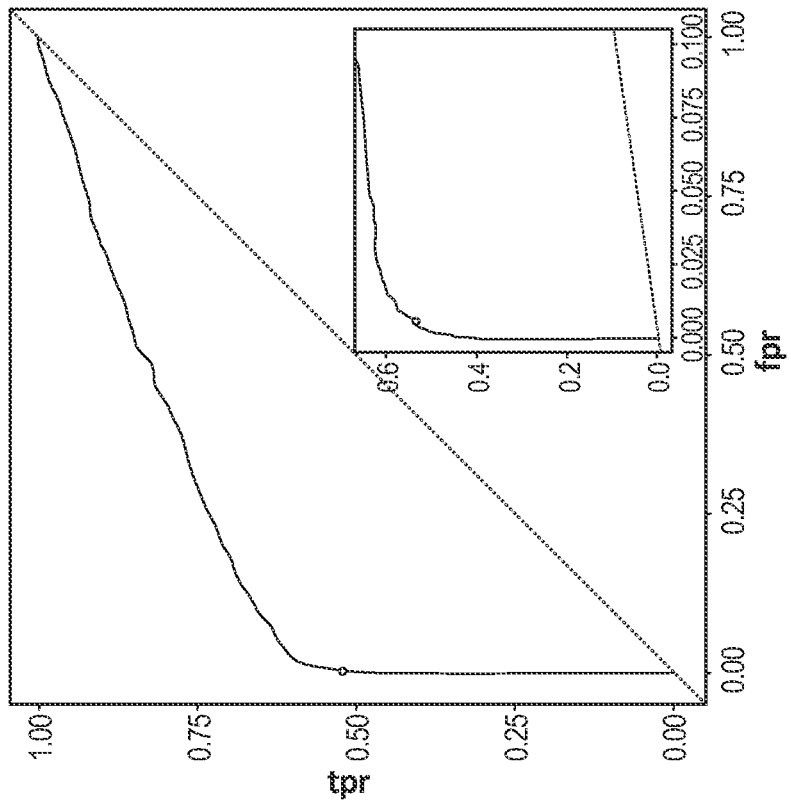

FIG. 15A depicts a receiver operator curve (ROC) showing the sensitivity and specificity of cancer detection using Assay Panel 2.

FIG. 15B is a confusion matrix depicting the accuracy of tissue of origin (TOO) classifications using Assay Panel 2.

Figure 16B:
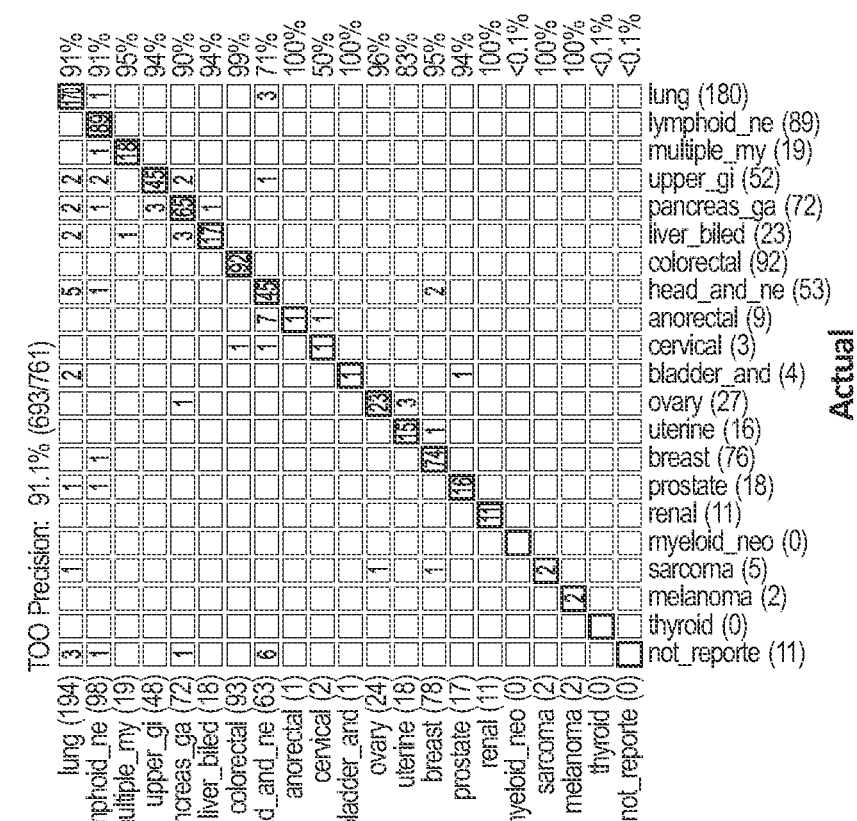
Figure 16A:
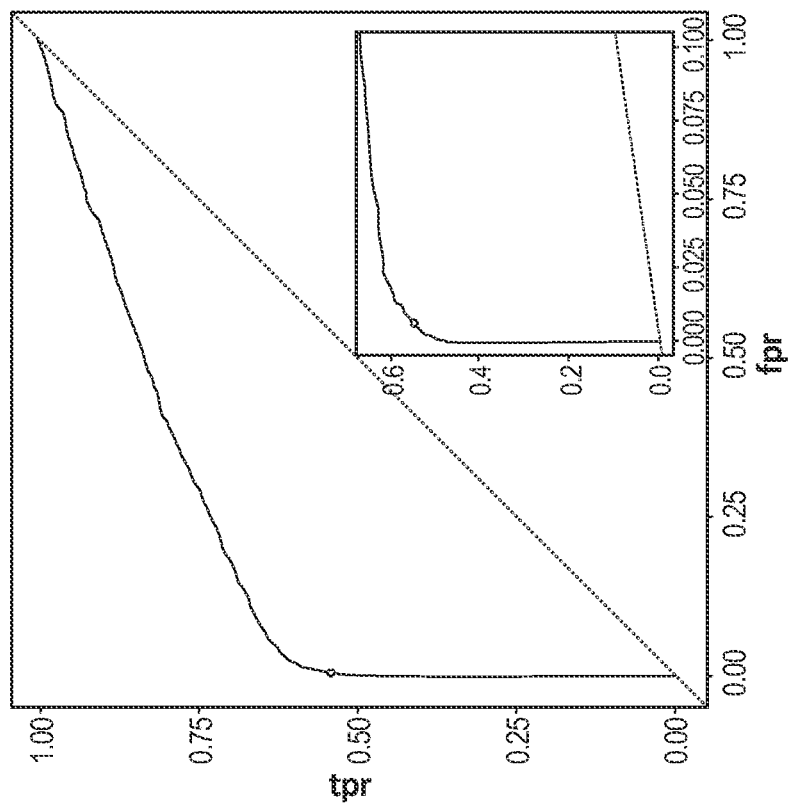

FIG. 16A depicts a receiver operator curve (ROC) showing the sensitivity and specificity of cancer detection using Assay Panel 3.

FIG. 16B is a confusion matrix depicting the accuracy of tissue of origin (TOO) classifications using Assay Panel 3.

Figures 17A, 17B:
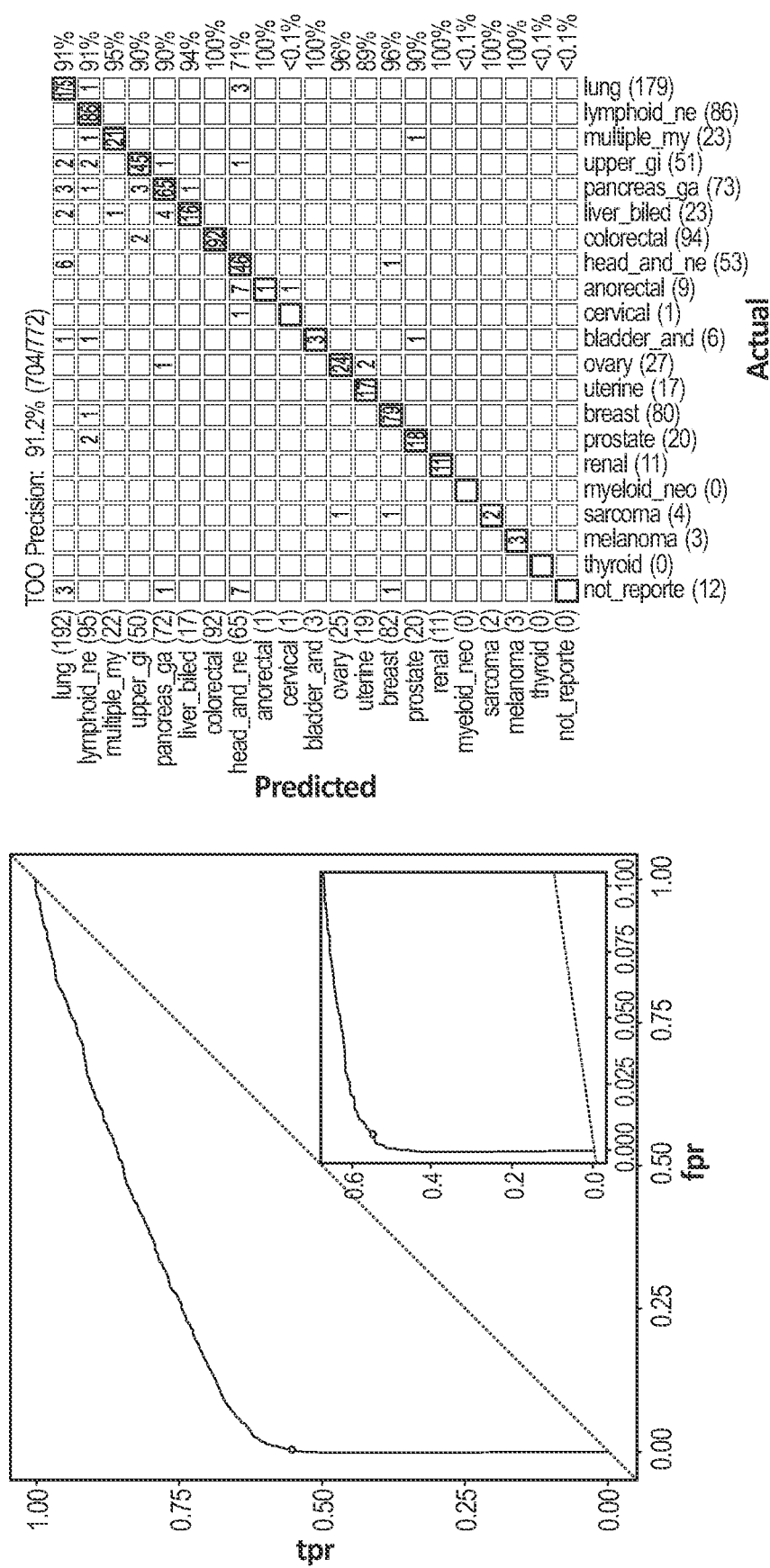

FIG. 17A depicts a receiver operator curve (ROC) showing the sensitivity and specificity of cancer detection using Assay Panel 4.

FIG. 17B is a confusion matrix depicting the accuracy of tissue of origin (TOO) classifications using Assay Panel 4.

Figure 18B:
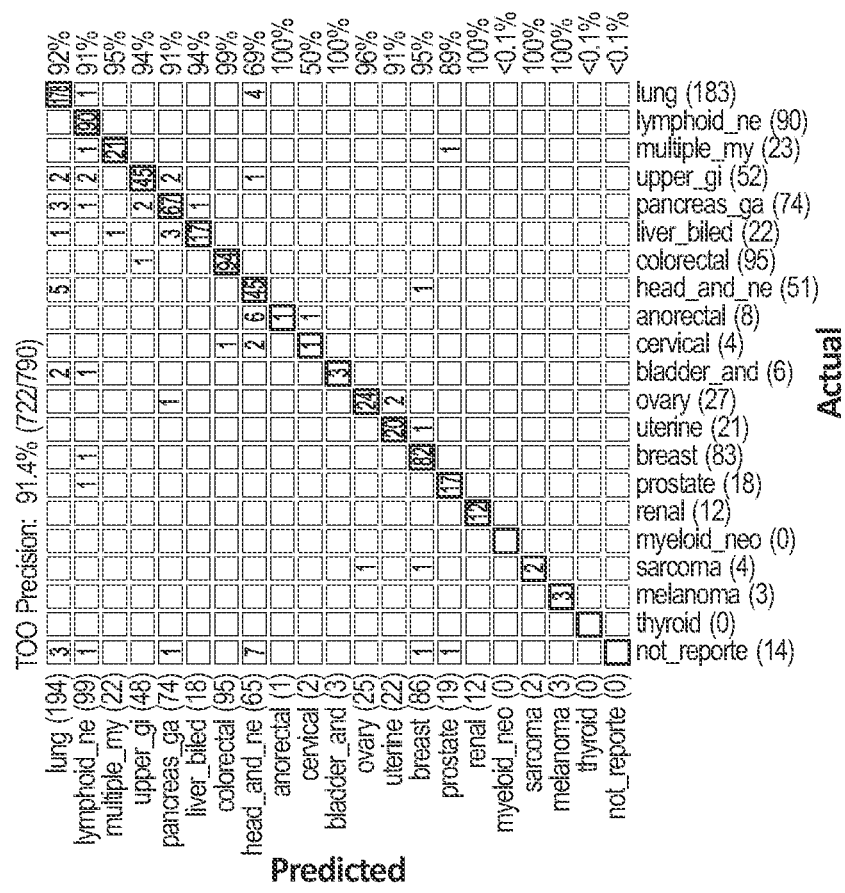
Figure 18A:
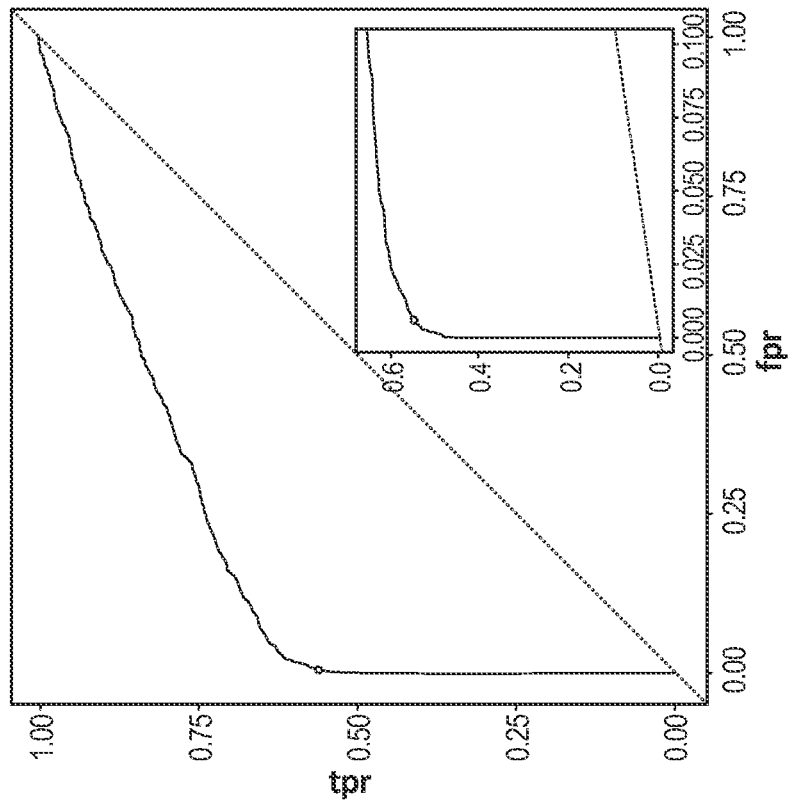

FIG. 18A depicts a receiver operator curve (ROC) showing the sensitivity and specificity of cancer detection using Assay Panel 5.

FIG. 18B is a confusion matrix depicting the accuracy of tissue of origin (TOO) classifications using Assay Panel 5.

Figures 19A, 19B:
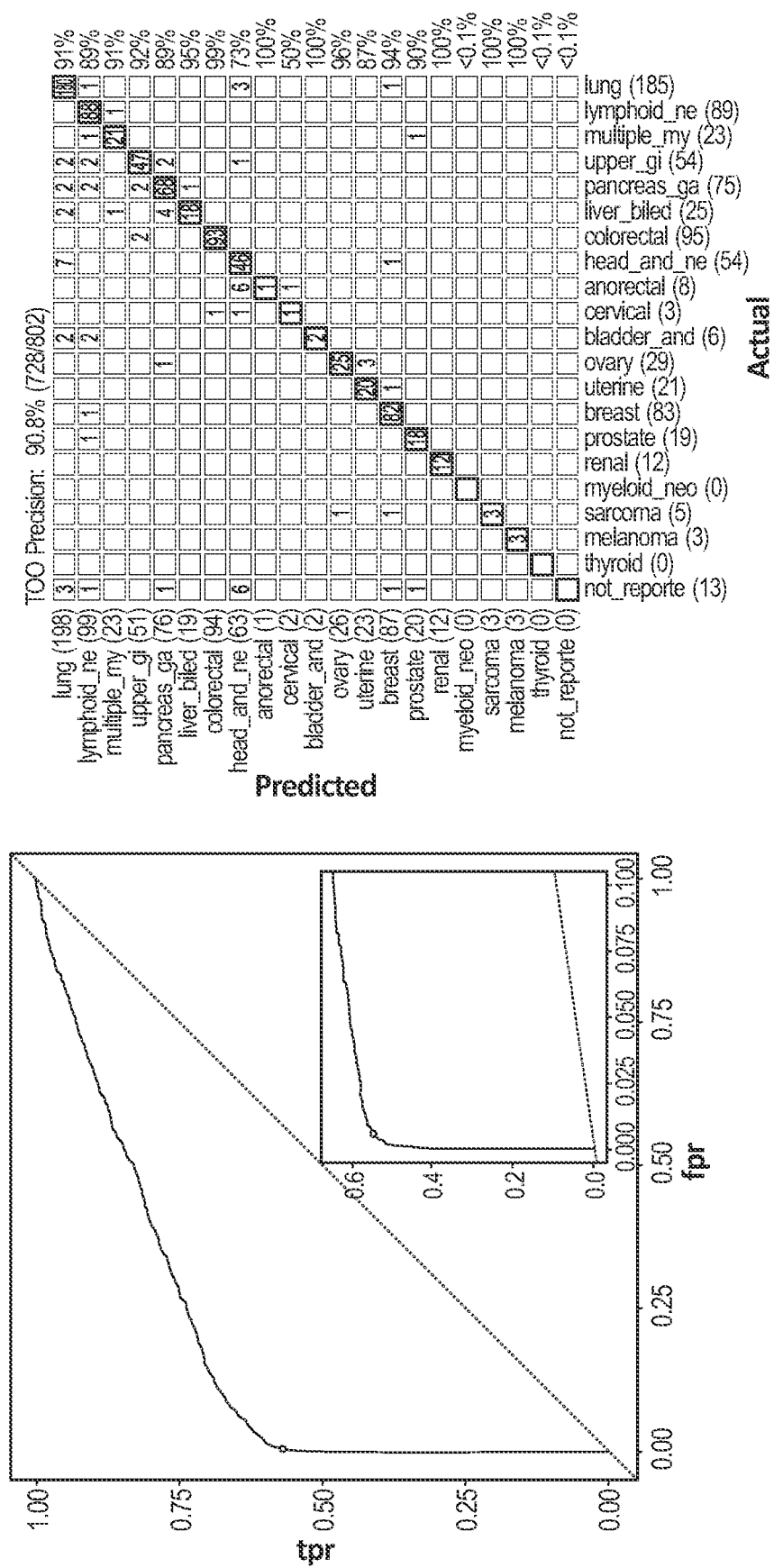

FIG. 19A depicts a receiver operator curve (ROC) showing the sensitivity and specificity of cancer detection using Assay Panel 6.

FIG. 19B is a confusion matrix depicting the accuracy of tissue of origin (TOO) classifications using Assay Panel 6.

Figures 20A, 20B:
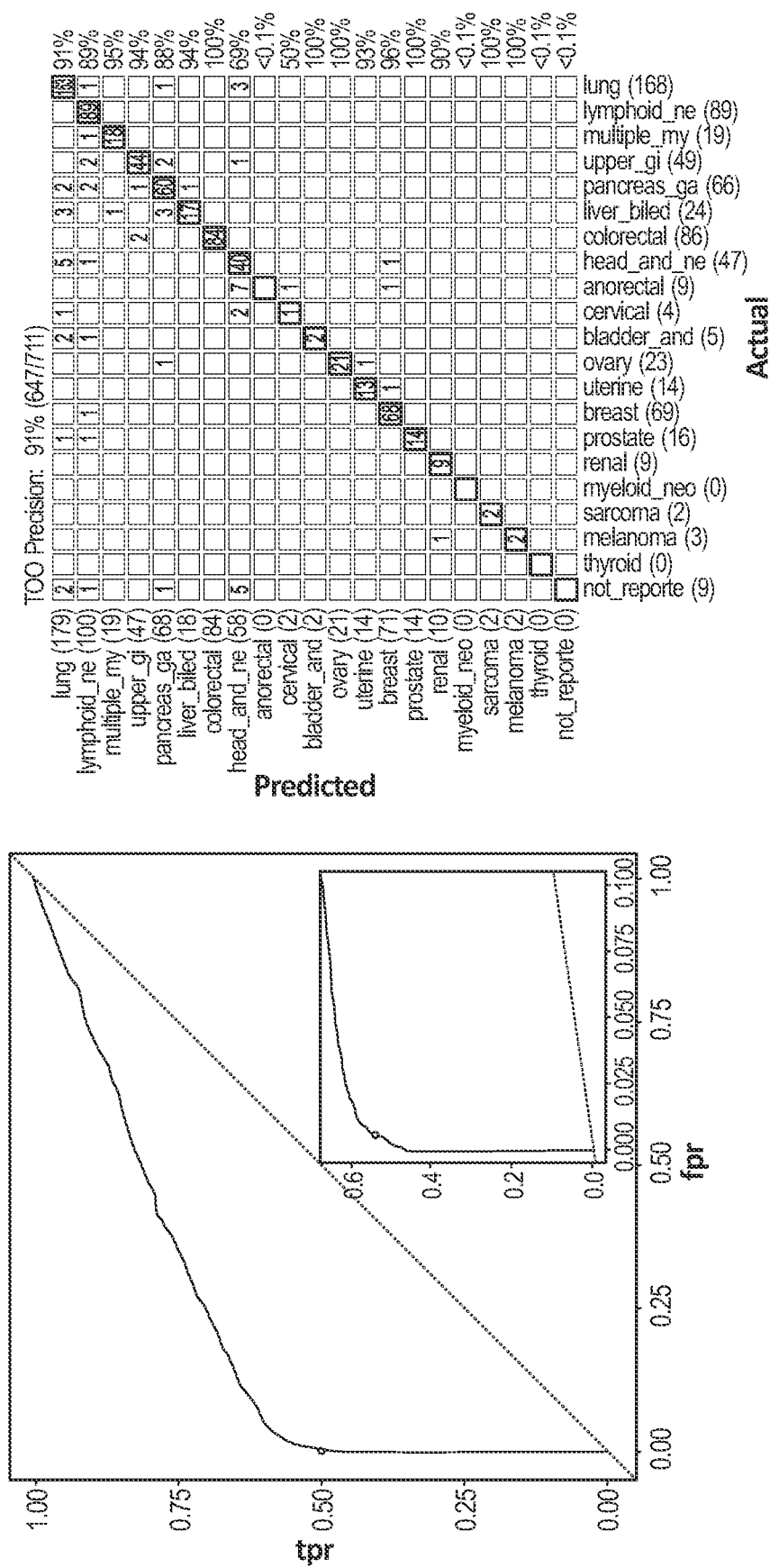

FIG. 20A depicts a receiver operator curve (ROC) showing the sensitivity and specificity of cancer detection using Assay Panel 3A.

FIG. 20B is a confusion matrix depicting the accuracy of tissue of origin (TOO) classifications using Assay Panel 3A.

Figures 21A, 21B:
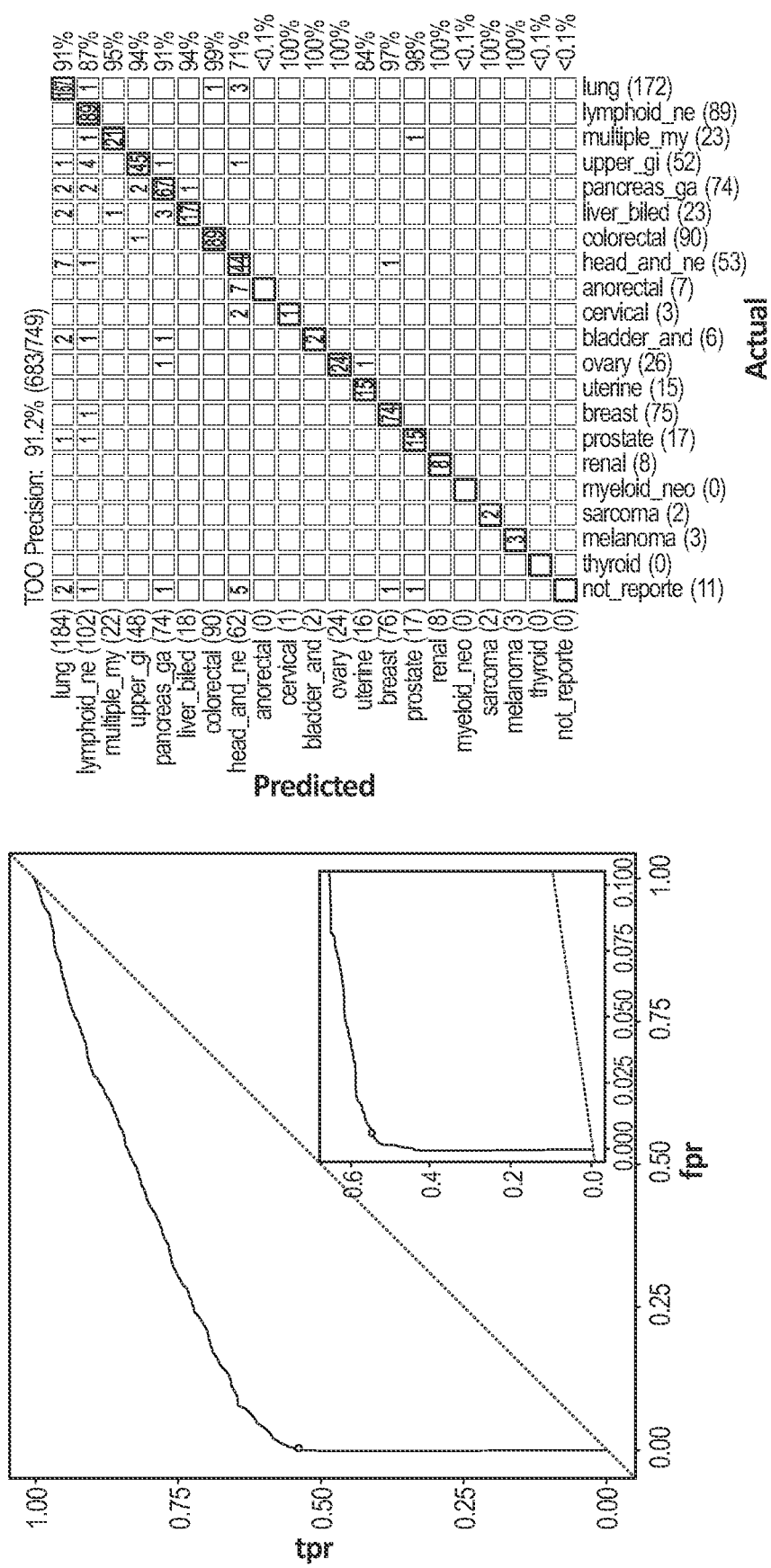

FIG. 21A depicts a receiver operator curve (ROC) showing the sensitivity and specificity of cancer detection using Assay Panel 4A.

FIG. 21B is a confusion matrix depicting the accuracy of tissue of origin (TOO) classifications using Assay Panel 4A.

Figures 22A, 22B:
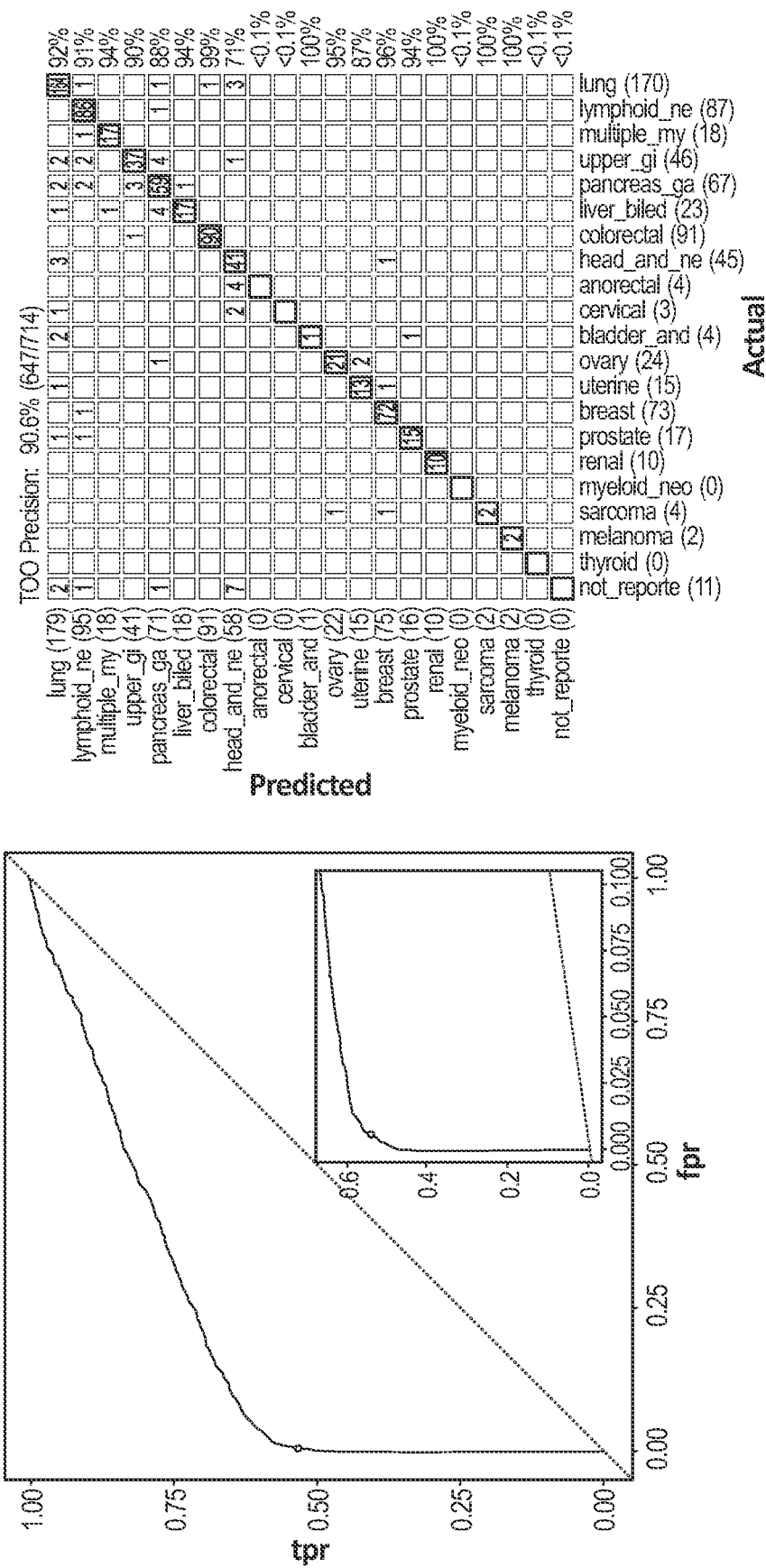

FIG. 22A depicts a receiver operator curve (ROC) showing the sensitivity and specificity of cancer detection using a random selection (subset a) of 40% of the targeted genomic regions in Assay Panel 3.

FIG. 22B is a confusion matrix depicting the accuracy of tissue of origin (TOO) classifications using a random selection (subset a) of 40% of the targeted genomic regions in Assay Panel 3.

Figures 23A, 23B:
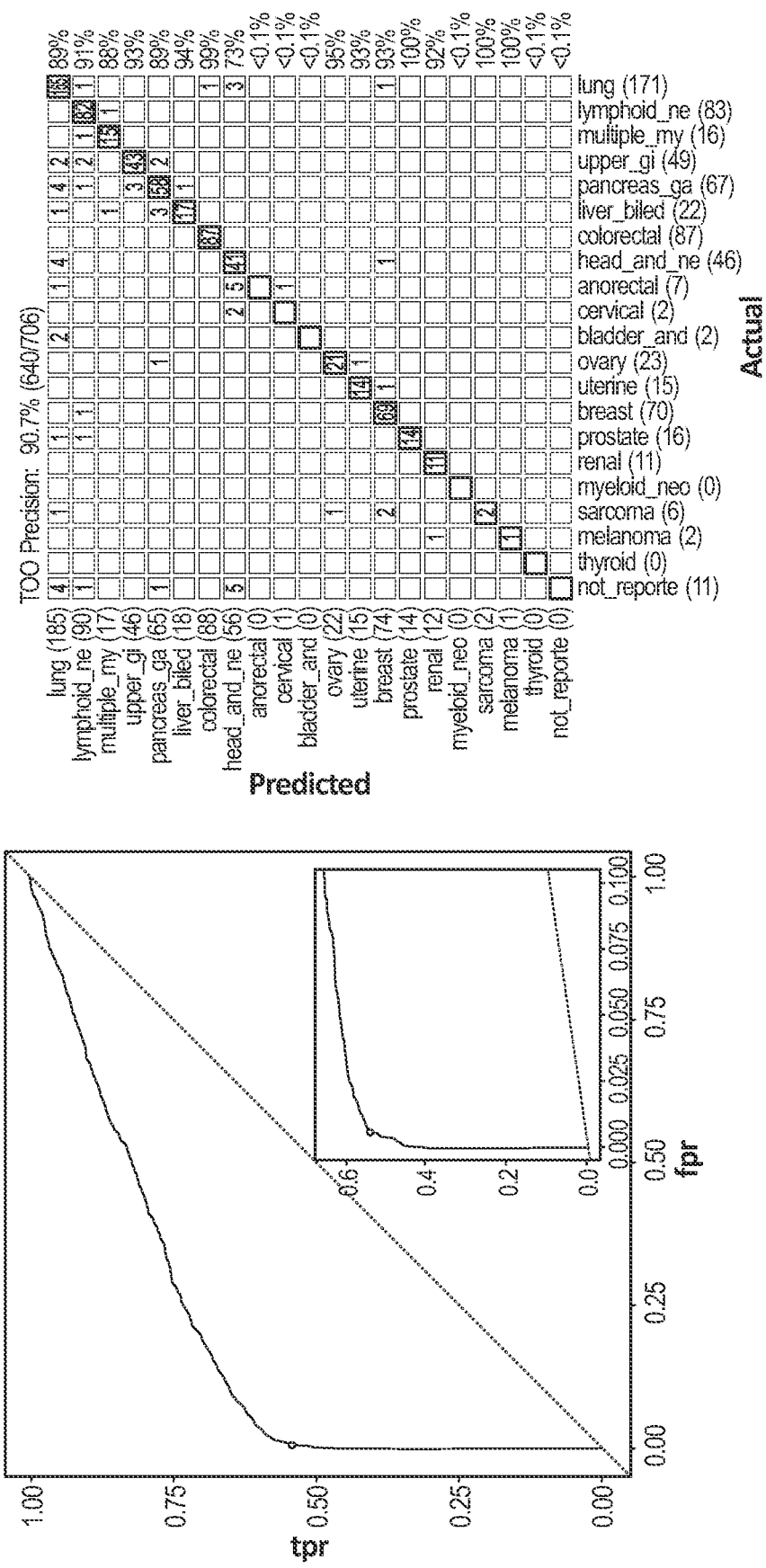

FIG. 23A depicts a receiver operator curve (ROC) showing the sensitivity and specificity of cancer detection using a random selection (subset b) of 40% of the targeted genomic regions in Assay Panel 3.

FIG. 23B is a confusion matrix depicting the accuracy of tissue of origin (TOO) classifications using a random selection (subset b) of 40% of the targeted genomic regions in Assay Panel 3.

Figures 24A, 24B:
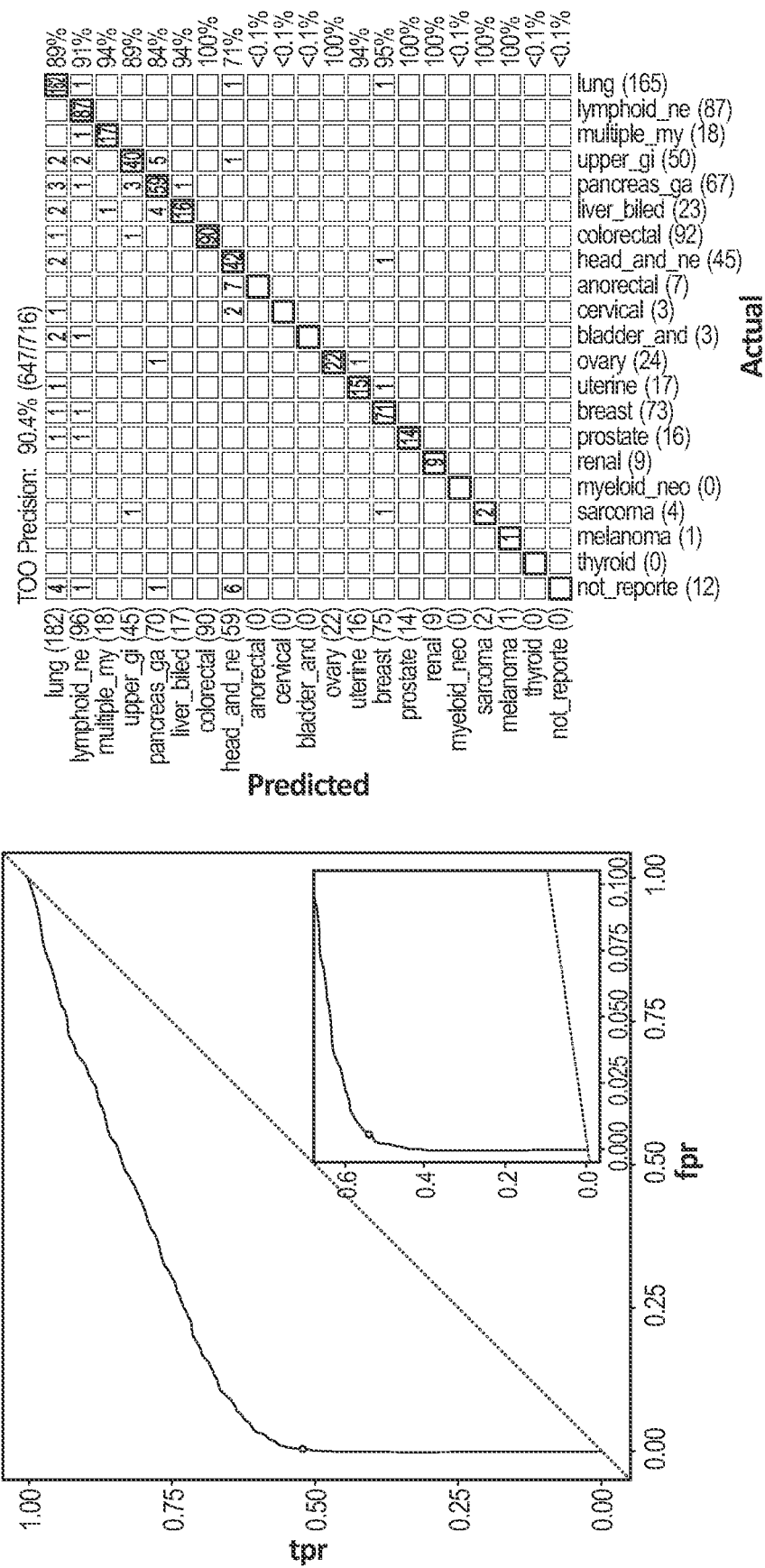

FIG. 24A depicts a receiver operator curve (ROC) showing the sensitivity and specificity of cancer detection using a random selection (subset c) of 40% of the targeted genomic regions in Assay Panel 3.

FIG. 24B is a confusion matrix depicting the accuracy of tissue of origin (TOO) classifications using a random selection (subset c) of 40% of the targeted genomic regions in Assay Panel 3.

FIG. 25A depicts a receiver operator curve (ROC) showing the sensitivity and specificity of cancer detection using a random selection of 60% of the targeted genomic regions in Assay Panel 3.

FIG. 25B is a confusion matrix depicting the accuracy of tissue of origin (TOO) classifications using a random selection of 60% of the targeted genomic regions in Assay Panel 3.

Figures 26A, 26B:
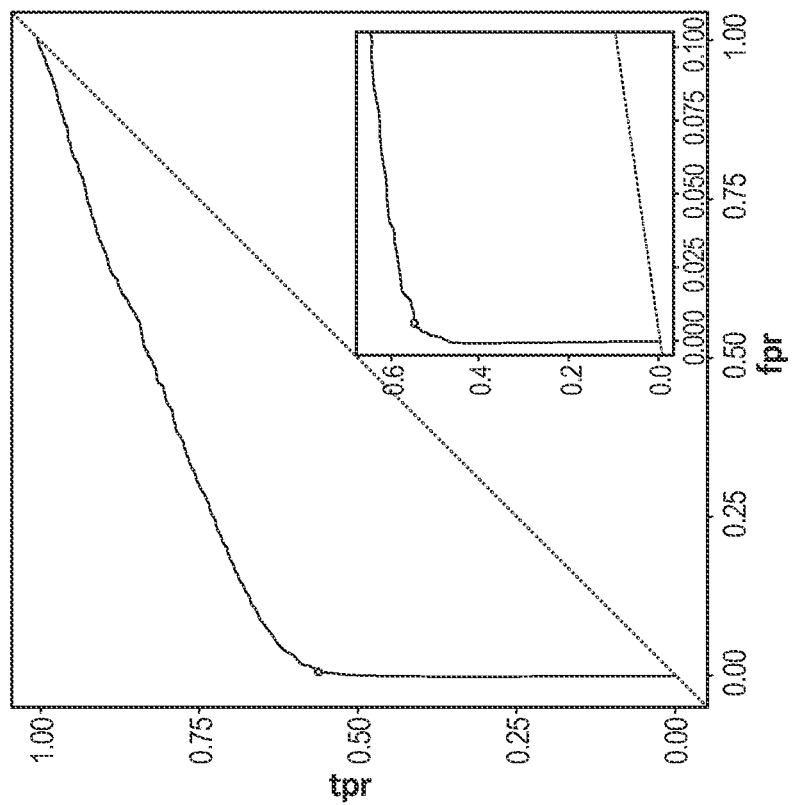

FIG. 26A depicts a receiver operator curve (ROC) showing the sensitivity and specificity of cancer detection using a random selection of 50% of the targeted genomic regions in Assay Panel 4.

FIG. 26B is a confusion matrix depicting the accuracy of tissue of origin (TOO) classifications using a random selection of 50% of the targeted genomic regions in Assay Panel 4.

Figures 27A, 27B:
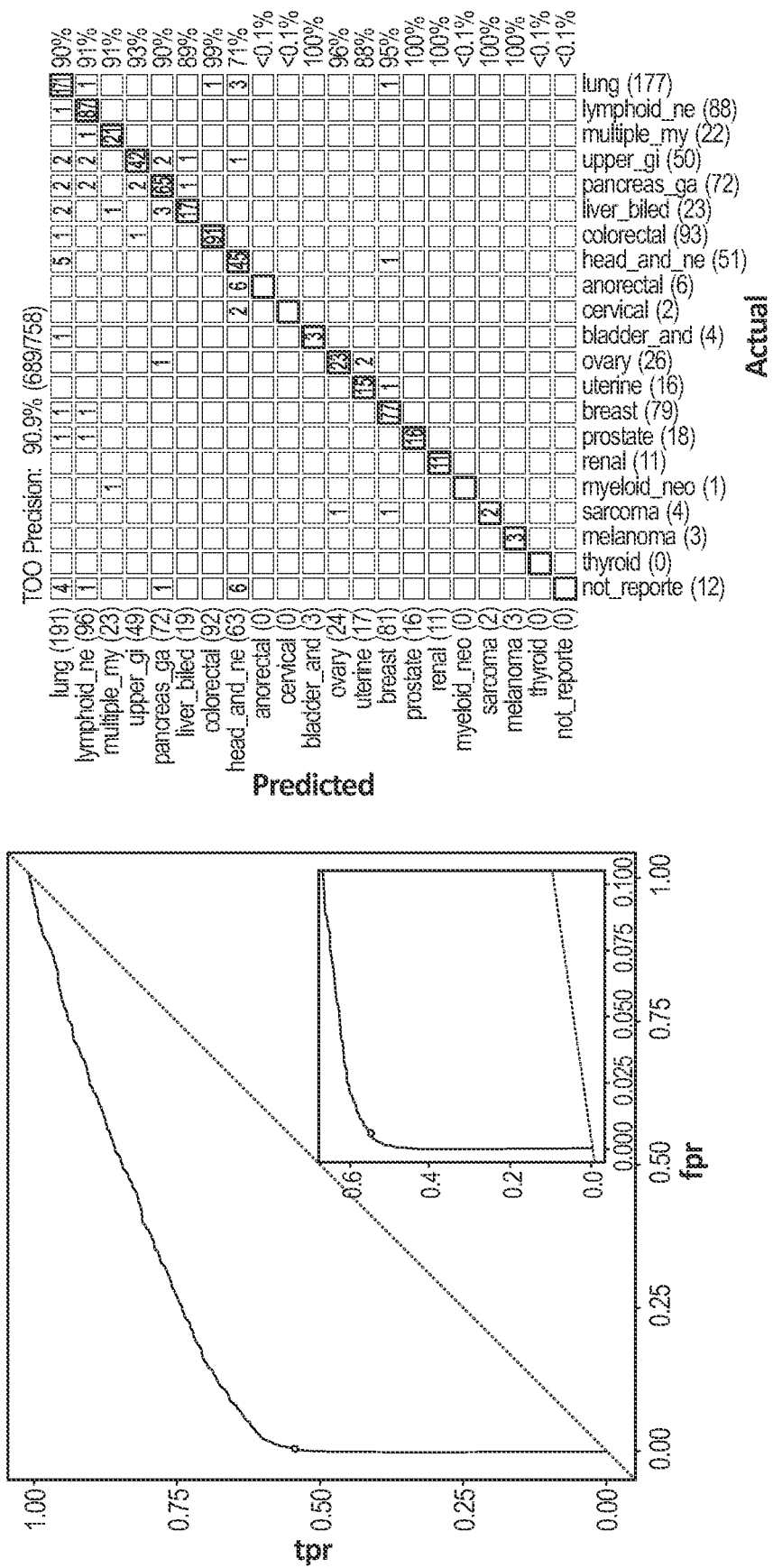

FIG. 27A depicts a receiver operator curve (ROC) showing the sensitivity and specificity of cancer detection using a random selection of 50% of the targeted genomic regions in Assay Panel 5.

FIG. 27B is a confusion matrix depicting the accuracy of tissue of origin (TOO) classifications using a random selection of 50% of the targeted genomic regions in Assay Panel 5.

The figures depict various embodiments of the present description for purposes of illustration only. One skilled in the art will readily recognize from the following discussion that alternative embodiments of the structures and methods illustrated herein may be employed without departing from the principles of the description described herein.

6. DETAILED DESCRIPTION

6.1. Definitions

Unless defined otherwise, all technical and scientific terms used herein have the meaning commonly understood by a person skilled in the art to which this description belongs. As used herein, the following terms have the meanings ascribed to them below.

The term "methylation" as used herein refers to a process by which a methyl group is added to a DNA molecule. For example, a hydrogen atom on the pyrimidine ring of a cytosine base can be converted to a methyl group, forming 5-methylcytosine. The term also refers to a process by which a hydroxymethyl group is added to a DNA molecules, for example by oxidation of a methyl group on the pyrimidine ring of a cytosine base. Methylation and hydroxymethylation tend to occur at dinucleotides of cytosine and guanine referred to herein as "CpG sites.

In such embodiments, the wet laboratory assay used to detect methylation may vary from those described herein as is well known in the art.

The term "methylation site" as used herein refers to a region of a DNA molecule where a methyl group can be added. "CpG" sites are the most common methylation site, but methylation sites are not limited to CpG sites. For example, DNA methylation may occur in cytosines in CHG and CHH, where H is adenine, cytosine or thymine. Cytosine methylation in the form of 5-hydroxymethylcytosine may also assessed (see, e.g., WO 2010/037001 and WO 2011/127136, which are incorporated herein by reference), and features thereof, using the methods and procedures disclosed herein.

The term "CpG site" as used herein refers to a region of a DNA molecule where a cytosine nucleotide is followed by a guanine nucleotide in the linear sequence of bases along its 5' to 3' direction. "CpG" is a shorthand for 5'-C-phosphate-G-3' that is cytosine and guanine separated by only one phosphate group. Cytosines in CpG dinucleotides can be methylated to form 5-methylcytosine.

The term "CpG detection site" as used herein refers to a region in a probe that is configured to hybridize to a CpG site of a target DNA molecule. The CpG site on the target DNA molecule can comprise cytosine and guanine separated by one phosphate group, where cytosine is methylated or unmethylated. The CpG site on the target DNA molecule can comprise uracil and guanine separated by one phosphate group, where the uracil is generated by the conversion of unmethylated cytosine.

The term "UpG" is a shorthand for 5'-U-phosphate-G-3' that is uracil and guanine separated by only one phosphate group. UpG can be generated by a bisulfite treatment of a DNA that converts unmethylated cytosines to uracils. Cytosines can be converted to uracils by other methods known in the art, such as chemical modification, synthesis, or enzymatic conversion.

The term "hypomethylated" or "hypermethylated" as used herein refers to a methylation status of a DNA molecule containing multiple CpG sites (e.g., more than 3, 4, 5, 6, 7, 8, 9, 10, etc.) where a high percentage of the CpG sites (e.g., more than 80%, 85%, 90%, or 95%, or any other percentage within the range of 50%-100%) are unmethylated or methylated, respectively.

The terms "methylation state vector" or "methylation status vector" as used herein refers to a vector comprising multiple elements, where each element indicates the methylation status of a methylation site in a DNA molecule comprising multiple methylation sites, in the order they appear from 5' to 3' in the DNA molecule. For example, $<M_x, M_{x+1}, M_{x+2}>$, $<M_x, M_{x+1}, U_{x+2}>, \ldots, <U_x, U_{x+1}, U_{x+2}>$ can be methylation vectors for DNA molecules comprising three methylation sites, where M represents a methylated methylation site and U represents an unmethylated methylation site.

The term "abnormal methylation pattern" or "anomalous methylation pattern" as used herein refers to the methylation pattern of a DNA molecule or a methylation state vector that is expected to be found in a sample less frequently than a threshold value. In a particular embodiment provided herein, the expectedness of finding a specific methylation state vector in a healthy control group comprising healthy individuals (e.g. individuals who have not been diagnosed with cancer) is represented by a p-value. A low p-value score generally corresponds to a methylation state vector which is relatively unexpected in comparison to other methylation state vectors within samples from healthy individuals. A high p-value score generally corresponds to a methylation state vector which is relatively more expected in comparison to other methylation state vectors found in samples from healthy individuals in the healthy control group. A methylation state vector having a p-value lower than a threshold value (e.g., 0.1, 0.01, 0.001, 0.0001, etc.) can be defined as an abnormal/anomalous methylation pattern. Various methods known in the art can be used to calculate a p-value or expectedness of a methylation pattern or a methylation state vector. Exemplary methods provided herein involve use of a Markov chain probability that assumes methylation statuses of CpG sites to be dependent on methylation statuses of neighboring CpG sites. Alternate methods provided herein calculate the expectedness of observing a specific methylation state vector in healthy individuals by utilizing a mixture model including multiple mixture components, each being an independent-sites model where methylation at each CpG site is assumed to be independent of methylation statuses at other CpG sites.

Methods provided herein characterize DNA fragments as anomalous when they have a methylation pattern that is unusual in comparison to the methylation patterns of DNA fragments in reference samples, such as samples from individuals who have not been diagnosed with cancer. The likelihood of a particular methylation pattern being observed in reference samples can be represented as a p-value score. Exemplary methods provided herein for modeling the likelihood of a particular methylation pattern involve use of a Markov chain probability and a sliding window. If the p-value score falls below a threshold (e.g., 0.1, 0.01, 0.001, 0.0001, etc.), the DNA fragment having that methylation pattern is classified as being anomalous. Multiple p-value scores corresponding to hypermethylated or hypomethylated DNA fragments can be summed or averaged before being compared to the threshold value. Various methods known in the art can be adopted to compare p-value scores corresponding to the genomic region and the threshold value, including but not limited to arithmetic mean, geometric mean, harmonic mean, median, mode, etc.

The term "cancerous sample" as used herein refers to a sample comprising genomic DNAs from an individual diagnosed with cancer. The genomic DNAs can be, but are not limited to, cfDNA fragments or chromosomal DNAs from a subject with cancer. The genomic DNAs can be sequenced and their methylation status can be assessed by methods known in the art, for example, bisulfite sequencing. When genomic sequences are obtained from public database (e.g., The Cancer Genome Atlas (TCGA)) or experimentally obtained by sequencing a genome of an individual diagnosed with cancer, cancerous sample can refer to genomic DNAs or cfDNA fragments having the genomic sequences. The term "cancerous samples" as a plural refers to samples comprising genomic DNAs from multiple individuals, each individual diagnosed with cancer. In various embodiments, cancerous samples from more than 100, 300, 500, 1,000, 10,000, 20,000, 40,000, 50,000, or more individuals diagnosed with cancer are used.

The term "non-cancerous sample" as used herein refers to a sample comprising genomic DNAs from an individual not diagnosed with cancer. The genomic DNAs can be, but are not limited to, cfDNA fragments or chromosomal DNAs from a subject without cancer. The genomic DNAs can be sequenced and their methylation status can be assessed by methods known in the art, for example, bisulfite sequencing. When genomic sequences are obtained from public database (e.g., The Cancer Genome Atlas (TCGA)) or experimentally obtained by sequencing a genome of an individual without cancer, non-cancerous sample can refer to genomic DNAs or cfDNA fragments having the genomic sequences. The term "non-cancerous samples" as a plural refers to samples comprising genomic DNAs from multiple individuals, each individual is not diagnosed with cancer. In various embodiments, cancerous samples from more than 100, 300, 500, 1,000, 10,000, 20,000, 40,000, 50,000, or more individuals without cancer are used.

The term "training sample" as used herein refers to a sample used to train a classifier described herein and/or to select one or more genomic regions for cancer diagnosis. The training samples can comprise genomic DNAs or a modification there of, from one or more healthy subjects and from one or more subjects having a disease condition for diagnosis (e.g., cancer, a specific type of cancer, a specific stage of cancer, etc.). The genomic DNAs can be, but are not limited to, cfDNA fragments or chromosomal DNAs. The genomic DNAs can be sequenced and their methylation status can be assessed by methods known in the art, for example, bisulfite sequencing. When genomic sequences are obtained from public database (e.g., The Cancer Genome Atlas (TCGA)) or experimentally obtained by sequencing a genome of an individual, a training sample can refer to genomic DNAs or cfDNA fragments having the genomic sequences.

The term "test sample" as used herein refers to a sample from a subject, whose health condition was, has been or will be tested using a classifier and/or an assay panel described herein. The test sample can comprise genomic DNAs or a modification there of. The genomic DNAs can be, but are not limited to, cfDNA fragments or chromosomal DNAs.

The term "target genomic region" as used herein refers to a region in a genome selected for selected for analysis in test samples. An assay panel is generated with probes designed to hybridize to (and optionally pull down) nucleic acid fragments derived from the target genomic region or a fragment thereof. A nucleic acid fragment derived from the target genomic region refers to a nucleic acid fragment generated by degradation, cleavage, bisulfite conversion, or other processing of the DNA from the target genomic region.

The term "off-target genomic region" as used herein refers to a region in a genome which has not been selected for analysis in test samples, but has sufficient homology to a target genomic region to potentially be bound and pulled down by a probe designed to target the target genomic region. In one embodiment, an off-target genomic region is a genomic region that aligns to a probe along at least 45 bp with at least a 90% match rate.

The terms "converted DNA molecules," "converted cfDNA molecules," and "modified fragment obtained from processing of the cfDNA molecules" refer to DNA molecules obtained by processing DNA or cfDNA molecules in a sample for the purpose of differentiating a methylated nucleotide and an unmethylated nucleotide in the DNA or cfDNA molecules. For example, in one embodiment, the sample can be treated with bisulfite ion (e.g., using sodium bisulfite), as is well-known in the art, to convert unmethylated cytosines ("C") to uracils ("U"). In another embodiment, the conversion of unmethylated cytosines to uracils is accomplished using an enzymatic conversion reaction, for example, using a cytidine deaminase (such as APOBEC). After treatment, converted DNA molecules or cfDNA molecules include additional uracils which are not present in the original cfDNA sample. Replication by DNA polymerase of a DNA strand comprising a uracil results in addition of an adenine to the nascent complementary strand instead of the guanine normally added as the complement to a cytosine or methylcytosine.

The term "cell free nucleic acid," "cell free DNA," or "cfDNA" refers to nucleic acid fragments that circulate in an individual's body (e.g., bloodstream) and originate from one or more healthy cells and/or from one or more cancerous cells. Additionally, cfDNA may come from other sources such as viruses, fetuses, etc.

The term "circulating tumor DNA" or "ctDNA" refers to nucleic acid fragments that originate from tumor cells, which may be released into an individual's bloodstream as result of biological processes such as apoptosis or necrosis of dying cells or actively released by viable tumor cells.

The term "fragment" as used herein can refer to a fragment of a nucleic acid molecule. For example, in one embodiment, a fragment can refer to a cfDNA molecule in a blood or plasma sample, or a cfDNA molecule that has been extracted from a blood or plasma sample. An amplification product of a cfDNA molecule may also be referred to as a "fragment." In another embodiment, the term "fragment" refers to a sequence read, or set of sequence reads, that have been processed for subsequent analysis (e.g., for in machine-learning based classification), as described herein. For example, as is well known in the art, raw sequence reads can be aligned to a reference genome and matching paired end sequence reads assembled into a longer fragment for subsequent analysis.

The term "individual" refers to a human individual. The term "healthy individual" refers to an individual presumed not to have a cancer or disease.

The term "subject" refers to an individual whose DNA is being analyzed. A subject may be a test subject whose DNA is be evaluated using a targeted panel as described herein to evaluate whether or not the person has cancer or another disease. A subject may also be part of a control group known not to have cancer or another disease. A subject may also be part of a cancer or other disease group known to have cancer or another disease. Control and cancer/disease groups may be used to assist in designing or validating the targeted panel.

The term "sequence reads" as used herein refers to nucleotide sequences reads from a sample. Sequence reads can be obtained through various methods provided herein or as known in the art.

The term "sequencing depth" as used herein refers to the count of the number of times a given target nucleic acid within a sample has been sequenced (e.g., the count of sequence reads at a given target region). Increasing sequencing depth can reduce required amounts of nucleic acids required to assess a disease state (e.g., cancer or cancer tissue of origin).

The term "tissue of origin" or "TOO" as used herein refers to the organ, organ group, body region or cell type that cancer arises or originates from. The identification of a tissue of origin or cancer cell type typically allows for identification of the most appropriate next steps in the care continuum of cancer to further diagnose, stage, and decide on treatment.

The term "transition" generally refers to changes in base composition from one purine to another purine, or from one pyrimidine to another pyrimidine. For instance, the following changes are transitions: C→U, U→C, G→A, A→G, C→T, and T→C.

"An entirety of probes" of a panel or bait set or "an entirety of polynucleotide-containing probes" of a panel or bait set generally refers to all of the probes delivered with a specified panel or bait set. For instance, in some embodiments, a panel or bait set may include both (1) probes having features specified herein (e.g., probes for binding to cell-free DNA fragments corresponding to or derived from genomic regions set forth herein in one or more Lists) and (2) additional probes that do not contain such feature(s). The entirety of probes of a panel generally refers to all probes delivered with the panel or bait set, including such probes that do not contain the specified feature(s).

6.2. Other Interpretational Conventions

Ranges recited herein are understood to be shorthand for all of the values within the range, inclusive of the recited endpoints. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50.

6.3. Cancer Assay Panel

In a first aspect, the present description provides a cancer assay panel (e.g., a bait set) comprising a plurality of probes. The probes can be polynucleotide-containing probes that are specifically designed to target one or more nucleic acid molecules corresponding to or derived from genomic regions that are differentially methylated in cancer compared to non-cancer samples as identified by methods provided herein. The probes are used as baits to collect cfDNA derived from target genomic regions that are differentially methylated in cancer. In a diagnostic assay, enrichment increases sensitivity and accuracy while reducing sequencing expenses.

For designing the cancer assay panel, an analytics system may collect samples corresponding to various outcomes under consideration, e.g., samples known to have cancer, samples considered to be healthy, samples from a known tissue of origin, etc. The sources of the cfDNA and/or ctDNA used to select target genomic regions can vary depending on the purpose of the assay. For example, different sources may be desirable for an assay intended to diagnose cancer generally, a specific type of cancer, a cancer stage, or a tissue of origin. These samples may be processed with whole-genome bisulfate sequencing (WGBS) or obtained from public database (e.g., TCGA). The analytics system may be any generic computing system with a computer processor and a computer-readable storage medium with instructions for executing the computer processor to perform any or all operations described in this present disclosure.

The analytics system may then select target genomic regions based on methylation patterns of nucleic acid fragments. One approach considers pairwise distinguishability between pairs of outcomes for regions or more specifically one or more CpG sites. Another approach considers distinguishability for regions or more specifically one or more CpG sites when considering each outcome against the remaining outcomes. From the selected target genomic regions with high distinguishability power, the analytics system may design probes to target nucleic acid fragments inclusive of the selected genomic regions. The analytics system may generate variable sizes of the cancer assay panel, e.g., where a small sized cancer assay panel includes probes targeting the most informative genomic region, a medium sized cancer assay panel includes probes from the small sized cancer assay panel and additional probes targeting a second tier of informative genomic regions, and a large sized cancer assay panel includes probes from the small sized and the medium sized cancer assay panels and even more probes targeting a third tier of informative genomic regions. With such cancer assay panels, the analytics system may train classifiers with various classification techniques to predict a sample's likelihood of having a particular outcome, e.g., cancer, specific cancer type, other disorder, etc.

Target genomic regions may be selected to maximize classification accuracy, subject to a size limitation (which is determined by sequencing budget and desired depth of sequencing). Potential target genomic regions can be ranked according to their tentative classification potential as described herein and then greedily added to a panel until the size limitation is reached.

A cancer assay panel can be used to detect the presence or absence of cancer generally, the stage (e.g., I, II, III or IV) of cancer, and/or the tissue of origin of a cancer. Depending on the purpose, a panel can include probes targeting genomic regions differentially methylated between general cancerous (pan-cancer) samples and non-cancerous samples. In some embodiments, a cancer assay panel is designed based on bisulfate sequencing data generated from the cfDNA and/or whole genomic DNA of a set of cancer and non-cancer individuals.

Each probe, probe pair, or probe set can be designed to target, by selective hybridization, one or more target genomic regions. The target genomic regions are selected based on several criteria designed to enhance selective enrichment of relevant cfDNA fragments while decreasing noise and non-specific binding. For example, a panel can include probes that can selectively hybridize to (i.e., bind to) and enrich cfDNA fragments that are differentially methylated in cancerous samples. Furthermore, the probes may be further designed to target genomic regions that are determined to have an anomalous methylation pattern comprising hypermethylation or hypomethylation. In some embodiments, a panel comprises both a first set of probes targeting hypermethylated fragments and a second set of probes targeting hypomethylated fragments. In some embodiments, the ratio between the first set of probes targeting hypermethylated fragments and the second set of probes targeting hypomethylated fragments (hyper:hypo ratio) ranges between 0.4 and 2, between 0.5 and 1.8, between 0.5 and 1.6, between 1.4 and 1.6, between 1.2 and 1.4, between 1 and 1.2, between 0.8 and 1, between 0.6 and 0.8 or between 0.4 and 0.6.

Sequencing of the enriched fragments provides information relevant to a diagnosis of cancer. Methods of identifying fragments having abnormal methylation patterns are provided in detail in Section 6.4.2 ("Anomalously methylated fragments") and methods of identifying fragments having hypomethylation or hypermethylation patterns are provided in detail in Section 6.4.3 ("Analysis of hyper or hypomethylated fragments").

For example, genomic regions can be selected when cfDNA and/or ctDNA fragments that align with a genomic region have a methylation pattern with a low p-value according to a Markov model trained on a set of non-cancerous samples. cfDNA and/or ctDNA fragments used to select genomic regions may additionally be required to contain at least a threshold number (e.g., 5) CpG's, and 70%, 75%, 80%, 85%, 90%, 95%, 98%, or 100% of the CPG sites may be required to be either methylated or unmethylated. Each of the probes can target at least 25 bp, 30 bp, 35 bp, 40 bp, 45 bp, 50 bp, 60 bp, 70 bp, 80 bp, 90 bp, 100 bp, 110 bp, or 120 bp of a genomic region. In some embodiments, the genomic regions is required to have less than 20, 15, 10, 8, or 6 methylation sites.

In some embodiments, target genomic region selection involves a calculation performed with respect to each CpG site. Specifically, a first count, $n_{cancer}$, is determined from the number of cancer-containing samples that include an abnormally hypermethylated and/or hypomethylated cfDNA and/or ctDNA fragment overlapping that CpG site, and a second count, $n_{non-cancer}$, is determined from the number of healthy samples that include an abnormally hypermethylated and/or hypomethylated cfDNA and/or ctDNA fragment overlapping that CpG site. Genomic regions can be selected based on criteria positively correlated $n_{cancer}$ and inversely correlated with $n_{non-cancer}$. In other embodiments, target genomic region selection involves a calculation performed with respect to a plurality of CpG sites.

In some embodiments, the number of non-cancerous samples ($n_{non-cancer}$) and the number of cancerous samples ($n_{cancer}$) having an abnormally hypermethylated and/or hypomethylated cfDNA and/or ctDNA fragment overlapping a CpG site are counted. A ranking score is then calculated for the CpG site. In some embodiments, the ranking score is equal to $(n_{cancer}+1)/(n_{cancer}\ n_{non-cancer}+2)$. CpG sites ranked by this metric are greedily added to a panel until the panel size budget is exhausted. The process of selecting genomic regions indicative of cancer is further detailed herein.

Further filtration can be performed to select probes with high specificity for enrichment (i.e., high binding efficiency) of nucleic acids derived from targeted genomic regions. Probes can be filtered to reduce non-specific binding (or off-target binding) to nucleic acids derived from non-targeted genomic regions. In some embodiments, further filtration is performed to select probes for a cancer assay panel that will not pull down off-target genomic regions. In some embodiments, probes that can pull down off-target genomic regions are eliminated. In some embodiments, a threshold is set to define probes with an unacceptably high risk of off-target effects. In one embodiment, probes with more than 80%, 85%, 90%, 95% or 98% identity to a threshold number (e.g., 1, 2, 3, 4, 5, 10, 15, 20, 25 or more) of off-target genomic regions are eliminated from a panel. In some embodiments, probes are eliminated from a cancer assay panel if they comprise a sequence of at least 20, 25, 30, 35, 40, 45, 50, 55, or 60 nt with more than 80%, 85%, 90%, 95% or 98% identity to a threshold number (e.g., 1, 2, 3, 4, 5, 10, 15, 20, 25 or more) of off-target genomic regions. Filtering removes repetitive probes that can pull down off-target fragments, which are not desired and can impact assay efficiency.

A fragment-probe overlap of at least 45 bp enables a non-negligible amount of pulldown under certain hybridization conditions. Thus, in some embodiments, probes are eliminated from a cancer panel if they comprise a sequence of at least 45 nt with more than 80%, 85%, 90%, 95% or 98% identity to 1, 2, 3, 4, 5, 10, 15, 20, 25 or more off-target genomic regions.

In some embodiments, the probes of a cancer assay panel are designed to hybridize to converted cfDNA derived from target genomic regions. After hybridization, target polynucleotides can be recovered and/or isolated, optionally amplified, and sequenced by any suitable method. The sequence reads provide information relevant for detection of cancer, diagnosis of cancer, and assessment of a cancer tissue of origin or type of cancer. To this end, a panel may be designed to include a plurality of probes that can capture fragments that can together provide information relevant to cancer detection and diagnosis of cancer. In some embodiments, a panel includes at least 50, 60, 70, 80, 90, 100, 120, 150, or 200 different pairs of probes. In other embodiments, a panel includes at least at least 500, 1,000, 2,000, 2,500, 5,000, 10,000, 12,000, 15,000, 20,000, 30,000, 40,000, 50,000, or 100,000 probes. The plurality of probes together can comprise at least 20,000, 30,000, 40,000, 50,000, 75,000, 0.1 million, 0.2 million, 0.4 million, 0.6 million, 0.8 million, 1 million, 2 million, 3 million, 4 million, 5 million, 6 million, 7 million, 8 million, 9 million, or 10 million nucleotides. Optionally, the sequence at one or both ends of a probe overlaps with the sequence of other probes targeting the same genomic region or an adjacent genomic region.

Specifically, in some embodiments, the cancer assay panel comprises at least 50 pairs of probes, wherein each pair of the at least 50 pairs comprises two probes configured to overlap each other by an overlapping (e.g., identical) sequence, wherein the overlapping sequence comprises a 30-nucleotide sequence, and wherein the 30-nucleotide sequence is configured to hybridize to a modified fragment obtained from processing of the cfDNA molecules corresponding to one or more genomic regions, wherein each of the genomic regions comprises at least five methylation sites, and wherein the at least five methylation sites have an anomalous methylation pattern in training samples. In other words, when cfDNA molecules in training samples corresponding to the genomic region are analyzed, they have methylation status vectors appearing less frequently than a threshold value in reference samples.

In other embodiments, the cancer assay panel comprises at least 500 pairs of probes, wherein each pair of the at least 500 pairs comprises two probes configured to overlap each other by an overlapping sequence, wherein the overlapping sequence comprises a 30-nucleotide sequence, and wherein the 30-nucleotide sequence is configured to hybridize to a modified fragment obtained from processing of the cfDNA molecules corresponding to one or more genomic regions, wherein each of the genomic regions comprises at least five methylation sites, and wherein the at least five methylation sites have an anomalous methylation pattern in training samples. Again, when cfDNA molecules in training samples corresponding to the genomic region are analyzed, they have methylation status vectors appearing less frequently than a threshold value in reference samples.

In a preferred embodiment, the at least five methylation sites are differentially methylated either between cancerous and non-cancerous samples or between one or more pairs of samples from different cancer types. In some embodiments, the converted cfDNA molecules comprise cfDNA molecules treated (e.g., via bisulfite treatment or enzymatic conversion) to convert unmethylated C (cytosine) to U (uracil). In some cases, the uracil is further converted to thymine (e.g., upon PCR amplification).

The selected target genomic regions are optionally located in various positions in a genome, including but not limited to promoters, enhancers, exons, introns, and intergenic regions. In certain embodiments, the target genomic regions comprise genes and/or transcriptional control regions that are differentially expressed in cancer versus non-cancer, in different stages of cancer, and/or in cancers arising from different tissues of origin.

A cancer assay panel designed by methods provided herein may comprise at least 1,000 pairs of probes, each pair of which comprises two probes configured to overlap each other by an overlapping sequence comprising a 30-nucleotide fragment. The 30-nucleotide fragment comprises at least three, at least four, at least five of more CpG sites, wherein at least 70%, at least 80%, or at least 90% of the at least three, at least four, at least five, or more CpG sites are either CpG or UpG. The 30-nucleotide fragment is configured to bind to one or more cfDNA fragments derived from genomic regions in cancerous samples, wherein the one or more genomic regions have at least three, at least four, at least five or more methylation sites with an abnormal methylation pattern compared to DNA molecules from a non-cancer sample.

Another cancer assay panel comprises at least 2,000 probes, each of which is designed as a hybridization probe complementary to one or more genomic regions. Each of the genomic regions is selected based on the criteria that it comprises (i) at least 30 nucleotides, and (ii) at least three, at least four, at least five, or more methylation sites, wherein the at least five methylation sites have an abnormal methylation pattern and are either hypomethylated or hypermethylated.

In some instances, primers may be used to specifically amplify targets/biomarkers of interest (e.g., by PCR), thereby enriching the sample for desired targets/biomarkers (optionally without hybridization capture). For example, forward and reverse primers can be prepared for each genomic region of interest and used to amplify fragments that correspond to or are derived from the desired genomic region. Thus, while the present disclosure pays particular attention to cancer assay panels and bait sets for hybridization capture, the disclosure is broad enough to encompass other methods for enrichment of cell-free DNA. Accordingly, a skilled artisan, with the benefit of this disclosure, will recognize that methods analogous to those described herein in connection with hybridization capture can alternatively be accomplished by replacing hybridization capture with some other enrichment strategy, such as PCR amplification of cell-free DNA fragments that correspond with genomic regions of interest. In some embodiments, bisulfite padlock probe capture is used to enrich regions of interest, such as is described in Zhang et al. (US 2016/0340740). In some embodiments, additional or alternative methods are used for enrichment (e.g., non-targeted enrichment) such as reduced representation bisulfite sequencing, methylation restriction enzyme sequencing, methylation DNA immunoprecipitation sequencing, methyl-CpG-binding domain protein sequencing, methyl DNA capture sequencing, or microdroplet PCR.

6.3.1. Probes

Cancer assay panels provided herein may include a panel having a set of hybridization probes (also referred to herein as "probes") designed to enrich selected target genomic regions by pulling down nucleic acid fragments of interest. The probes are designed to interrogate the methylation status of target genomic regions (e.g., of a human or other organism) that are suspected to correlate with the presence or absence of cancer generally, cancer stage, and/or tissue of origin.

The probes can be designed to anneal (or hybridize) to a target (complementary) strand of DNA or RNA. The target strand can be the "positive" strand (e.g., the strand transcribed into mRNA and subsequently translated into a protein) or the complementary "negative" strand. In a particular embodiment, a cancer assay panel includes two sets of probes for a target genomic region, one targeting the positive strand and the other targeting the negative strand. In certain embodiments, probes targeting different strands of a DNA sequence can have regions of sequence complementarity to each other.

Probes are optionally designed to hybridize to native DNA or to converted DNA. cfDNA, ctDNA and/or chromosomal DNA can be converted by various methods known in the art to preserve epigenetic marks such as methylation. Optionally, DNA is converted by bisulfite or enzymatic treatment, which converts unmethylated cytosines into uracils. Thus, the methylation pattern determines which cytosines in a CpG sequence are converted to uracil. Unmethylated CpG sites in a target region are converted by bisulfite (or enzymatic means) to UpG sites, If the target DNA is amplified after conversion by a process employing DNA polymerase, UpG sequences are further transformed to TpG sequences, and a complementary probe would have a CpA sequence. Methylated CpG sites in a target region retain their CpG sequence, so a complementary probe would also have a CpG sequence. Cytosines that are not at a CpG sequences are generally not methylated. These cytosines are generally converted to uracils, which are further transformed to thymidine after amplification, so probes complementary to bisulfite converted DNA comprise an A for each converted C that is not in a CpG site.

Probes are optionally designed under an assumption that all CpG sites are methylated in some target genomic regions (perfect hypermethylation), whereas no CpG sites are methylated in other target genomic regions (perfect hypomethylation). Stated differently, probes designed to target a hypomethylated region may be designed to be complementary to a region in which all CpG sites have been converted UpGs, whereas probes designed to target a hypermethylated region may be designed to be complementary to a region in which none of the CpG sites have been converted.

Since the probes may be configured to hybridize to a converted DNA or converted cfDNA molecule derived from one or more genomic regions, the probes can have a sequence different from the targeted genomic region. For example, a DNA molecule containing unmethylated CpG site will be converted to include UpG because unmethylated cytosines are converted to uracils by a conversion reaction (e.g., bisulfite treatment). As a result, a probe is configured to hybridize to a sequence including UpG instead of a naturally existing unmethylated CpG. Accordingly, a complementary site in the probe to the unmethylated site can comprise CpA instead of CpG, and some probes targeting a hypomethylated site where all methylation sites are unmethylated can have no guanine (G) bases. In some embodiments, at least 3%, 5%, 10%, 15%, 20%, 30%, or 40% of the probes lack G (Guanine). In some embodiments, at least 80, 85, 90, 92, 95, 98% of the probes on the panel have exclusively either CpG or CpA on CpG detection sites. Accordingly, in some embodiments, polynucleotide-containing probes have a nucleic acid sequence that is either (1) identical in sequence to a sequence within a target genomic region (e.g., target genomic regions set forth herein in any one of Lists 1-8) or (2) varies with respect to a sequence within the genomic region only one or more transitions (e.g., changes in base composition at a site due to bisulfate conversion or other conversion techniques), wherein each respective transition in the one or more transitions occurs at a nucleotide corresponding to a CpG site in the genomic region.

In some embodiments, probes on the panel comprise less than 20, 15, 10, 8, or 6 CpG detection sites. In some embodiments, probes on the panel comprise more than 5, 6, 7, 8, 9, or 10 CpG detection sites.

In some embodiments, probes are conjugated to a tag (e.g., a non-nucleic acid affinity moiety), such as a biotin moiety. In some embodiments, probes are affixed to a solid support, such as an array.

A cancer assay panel that interrogates methylation status can also be designed to interrogate other genetic or epigenetic marks that are different between cfDNA in cancer and healthy samples. In some embodiments, probes are designed to enrich for all cfDNA from a particular target region regardless of the methylation status of the cfDNA molecule. This might be because the target genomic region is not highly methylated or unmethylated, or for the purpose of targeting small mutations or SCNAs rather than methylation changes.

The probes optionally range in length from 10s to 100s of nucleotides. The probes can comprise at least 20, 30, 50, 75, 100, or 120 nucleotides. The probes can have a length of less than 300, 250, 200, or 150 nucleotides. In some embodiments, the probes comprise 100-150 nucleotides. In one particular embodiment, the probes are 120 nucleotides in length.

In some embodiments, the probes are designed in a "2× tiled" fashion to cover overlapping portions of a target region. Each probe optionally overlaps in coverage at least partially with another probe in the library. In such embodiments, the panel contains multiple pairs of probes, with each probe in a pair overlaping the other by at least 25, 30, 35, 40, 45, 50, 60, 70, 75 or 100 nucleotides. In some embodiments, the overlapping sequence can be designed to be complementary to a target genomic region (or cfDNA derived therefrom) or to be complementary to a sequence with homology to a target region or cfDNA. Thus, in some embodiments, at least two probes are complementary to the same sequence within a target genomic region, and a nucleotide fragment corresponding to or derived from the target genomic region can be bound and pulled down by at least one of the probes. Other levels of tiling are possible, such as 3× tiling, 4× tiling, etc., wherein each nucleotide in a target region can bind to more than two probes.

Figure 1A:
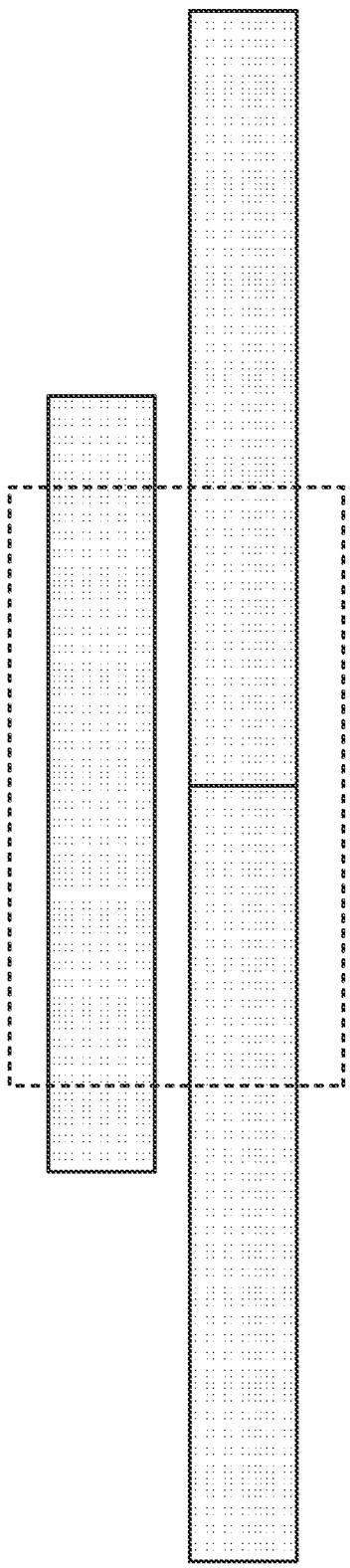
FIGS. 1A-1B illustrate a 2× tiled probe design where, for each strand of DNA, each base in a target region (boxed in the dotted rectangles) is covered by (e.g., complementary to) exactly two probes.
Figure 1B:
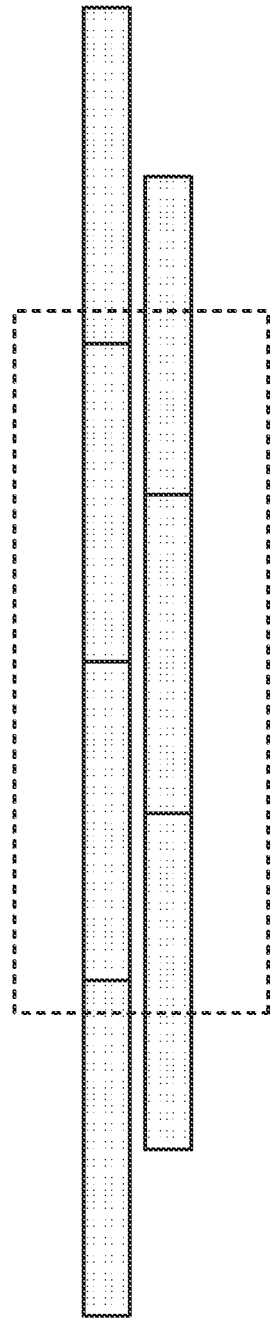

In one embodiment, each base in a target genomic region is overlapped by exactly two probes, as illustrated in FIG. 1. A single pair of probes is enough to pull down a genomic region if the overlap between the two probes is longer than the target genomic region and extends beyond both ends of the target genomic region. In some instances, even relatively small target regions may be targeted with three probes (see FIG. 1A). A probe set comprising three or more probes is optionally used to capture a larger genomic region. See FIG. 1B. In some embodiments, subsets of probes will collectively extend across an entire genomic region (e.g., may be complementary to non-converted or converted fragments from the genomic region). A tiled probe set optionally comprises probes that collectively include at least two probes that overlap every nucleotide in the genomic region. FIGS. 1A and 1B. This is done to ensure that cfDNAs comprising a small portion of a target genomic region at one end will have a substantial overlap extending into the adjacent non-targeted genomic region with at least one probe, to provide for efficient capture.

For example, a 100 bp cfDNA fragment comprising a 30 nt target genomic region can be guaranteed to have at least 65 bp overlap with at least one of the overlapping probes. Other levels of tiling are possible. For example, to increase target size and add more probes in a panel, probes can be designed to expand a 30 bp target region by at least 70 bp, 65 bp, 60 bp, 55 bp, or 50 bp. To capture any fragment that overlaps the target region at all (even if by only 1 bp), the probes can be designed to extend past the ends of the target region on either side.

In one particular embodiment, the smallest target genomic region is 30 bp. When a new CpG site is added to the panel (based on the greedy selection as described above), a new target of 30 nt is centered on the CpG site of interest. Then, it is checked whether each edge of this new target is close enough to other targets such that they can be merged. Merging avoids a panel comprising close but distinct targets with overlapping probes. This is based on a "merge distance" parameter which extends about 100 nt, 150 nt, 200 nt, 250 nt, or 300 nt on either side of every target region. Merger creates a larger target genomic region. If a new CpG site is merged into targets on both sides, the number of target genomic regions is reduced.

In some embodiments, an assay panel provided herein comprises a plurality of polynucleotide probes configured to hybridize to a modified fragment obtained from processing of the cfDNA molecules, wherein each of the cfDNA molecules corresponds to or is derived from one or more genomic regions. In some embodiments, at least 15%, 20%, 30%, or 40% of the genomic regions are in exons or introns. In some embodiments, at least 5%, 10%, 15%, 20%, 30% or 40% of the genomic regions are in exons. In some embodiments, less than 5%, 10%, 15%, 20%, 25%, or 30% of the genomic regions are in intergenic regions.

In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of Lists 1-8. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 1. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 2. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 3. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 5. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 7. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 8. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 4. In some embodiments, the entire probes on the panel together are configured to hybridize to modified fragments obtained from the cfDNA molecules corresponding to or derived from at least 20%, 30%, 40%, 50%, 60%, 70%, 80%, 90% or 95% of the genomic regions in one or more of the genomic regions in List 6. In some embodiments, the entire probes on the panel together are configured to hybridize to modified fragments obtained from the cfDNA molecules corresponding to or derived from at least 500, 1,000, 5000, 10,000 or 15,000 genomic regions in one or more of Lists 1-8.

6.4. Methods of Selecting Target Genomic Regions

In another aspect, methods are provided for identifying anomalously methylated DNA molecules from a sample. In some embodiments, the methods disclosed herein can be used to select target genomic regions for detecting cancer, assessing a cancer tissue of origin, or type of cancer. The targeted genomic regions can be used to design and manufacture probes for a cancer assay panel. Methylation status of the target genomic regions can be screened using the cancer assay panel. In other embodiments, these methods can be used as part of a filtering process to limit a data set (e.g., a sequencing data set) to reduce subsequent processing or analysis requirements. For example, the methods disclosed herein can be used to set a threshold for anomalously methylated fragments, which are likely derived from cancer or cancer cells, and the threshold used as a to filter out sequence reads or fragments that don't meet the threshold, and thus, are more likely derived from healthy cells.

6.4.1. Generation of Data Structure

Figure 2:
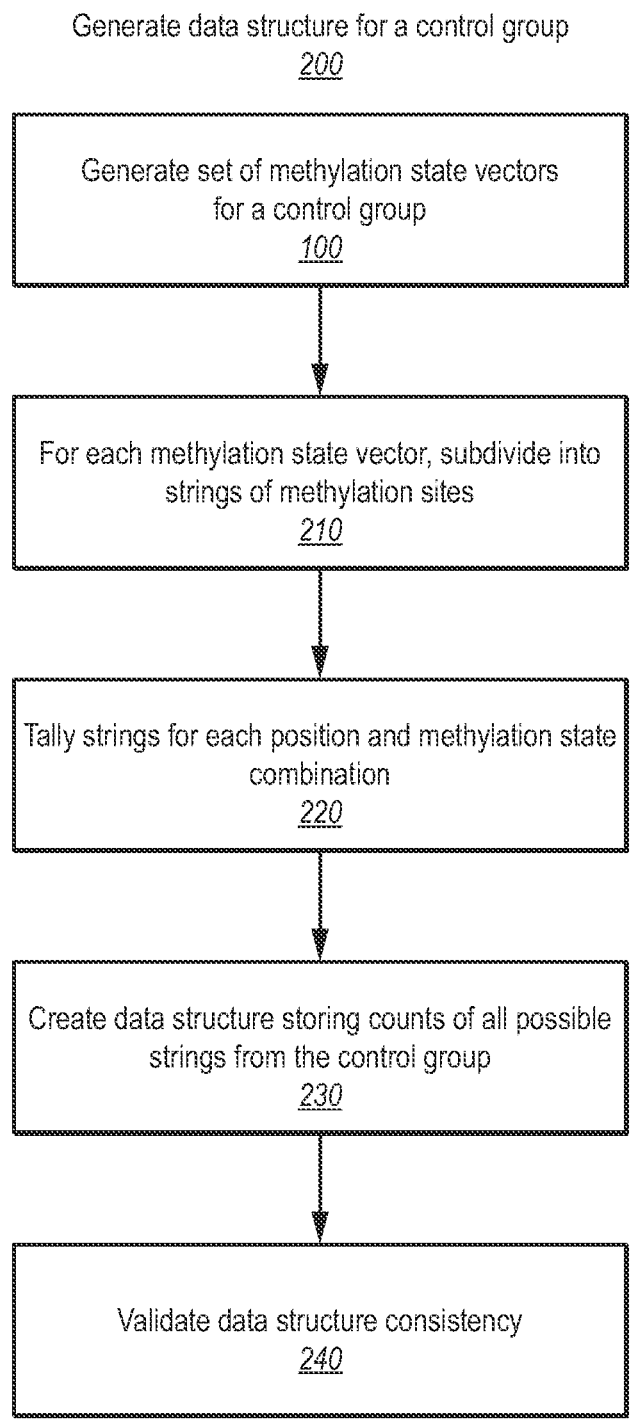
FIG. 2 is a flowchart describing a process of creating a data structure for a control group, according to an embodiment.

FIG. 2 is a flowchart describing a process 200 of generating a data structure for a healthy control group, according to an embodiment. To create a healthy control group data structure, the analytics system receives sequences from a plurality of DNA fragments (e.g., cfDNA and/or ctDNA) from a plurality of healthy subjects. A methylation state vector is identified for each fragment, for example via the process 100.

The analytics system subdivides 210 the methylation state vector of each DNA fragment into strings of CpG sites. In one embodiment, the analytics system subdivides 210 the methylation state vector such that the resulting strings are all less than a given length. For example, dividing a methylation state vector of length 11 may be subdivided into strings of length less than or equal to 3 would result in 9 strings of length 3, 10 strings of length 2, and 11 strings of length 1. In another example, a methylation state vector of length 7 being subdivided into strings of length less than or equal to 4 would result in 4 strings of length 4, 5 strings of length 3, 6 strings of length 2, and 7 strings of length 1. If the methylation state vector resulting from a DNA fragment is shorter than or the same length as the specified string length, then the methylation state vector may be converted into a single string containing all CpG sites of the vector.

The analytics system tallies 220 the strings by counting, for each possible CpG site and possibility of methylation states in the vector, the number of strings present in the control group having the specified CpG site as the first CpG site in the string and having that possibility of methylation states. For a string length of three at a given CpG site, there are 2^3 or 8 possible string configurations. For each CpG site, the analytics system tallies 220 how many occurrences of each possible methylation state vector appear up in the control group. This may involve tallying the following quantities: $<M_x, M_{x+1}, M_{x+2}>, <M_x, M_{x+1}, U_{x+2}>, \ldots, <U_x, U_{x+1}, U_{x+2}>$ for each starting CpG site in the reference genome. The analytics system creates 230 a data structure storing the tallied counts for each string possibility at each starting CpG.

There are several benefits to setting an upper limit on string length. First, depending on the maximum length for a string, the size of the data structure created by the analytics system can dramatically increase in size. For instance, a maximum string length of 4 means that there are at most 2^4 numbers to tally at every CpG. Increasing the maximum string length to 5 doubles the possible number of methylation states to tally. Reducing string size helps reduce the computational and data storage burden of the data structure. In some embodiments, the string size is 3. In some embodiments, the string size is 4. A second reason to limiting the maximum string length is to avoid overfitting downstream models. Calculating probabilities based on large strings of CpG sites can be problematic if the long CpG strings do not have a strong biological effect on the outcome (e.g., predictions of anomalousness that predictive of the presence of cancer), as it requires a significant amount of data that may not be available, and would thus be too sparse for a model to perform appropriately. For example, calculating a probability of anomalousness/cancer conditioned on the prior 100 CpG sites would require counts of strings in the data structure of length 100, ideally some matching exactly the prior 100 methylation states. If only sparse counts of strings of length 100 are available, there will be insufficient data to determine whether a given string of length of 100 in a test sample is anomalous or not.

6.4.1. Validation of Data Structure

Once the data structure has been created, the analytics system may seek to validate 240 the data structure and/or any downstream models making use of the data structure.

This first type of validation ensures that potential cancerous samples are removed from the healthy control group so as to introduce bias into the healthy data structure. This type of validation checks consistency within the control group's data structure. For example, the healthy control group may contain a sample from an individual with an undiagnosed cancer that contains a plurality of anomalously methylated fragments. The analytics system may perform various calculations to determine whether to exclude data from a subject with apparently undiagnosed cancer.

A second type of validation checks the probabilistic model used to calculate p-values with the counts from the data structure itself (i.e., from the healthy control group). A process for p-value calculation is described below in conjunction with FIG. 5. Once the analytics system generates a p-value for the methylation state vectors in the validation group, the analytics system builds a cumulative density function (CDF) with the p-values. With the CDF, the analytics system may perform various calculations on the CDF to validate the control group's data structure. One test uses the fact that the CDF should ideally be at or below an identity function, such that $CDF(x) \leq x$. On the converse, being above the identity function reveals some deficiency within the probabilistic model used for the control group's data structure. For example, if $1/100$ of fragments have a p-value score of $1/1000$ meaning $CDF(1/1000)=1/100>1/1000$, then the second type of validation fails indicating an issue with the probabilistic model. See e.g., U.S. application Ser. No. 16/352,602, published as U.S. Publ. No. 2019/0287652, which is hereby incorporated by reference in its entirety.

A third type of validation uses a healthy set of validation samples separate from those used to build the data structure. This tests if the data structure is properly built and the model works. An exemplary process for carrying out this type of validation is described below in conjunction with FIG. 3. The third type of validation can quantify how well the healthy control group generalizes the distribution of healthy samples. If the third type of validation fails, then the healthy control group does not generalize well to the healthy distribution.

A fourth type of validation tests with samples from a non-healthy validation group. The analytics system calculates p-values and builds the CDF for the non-healthy validation group. With a non-healthy validation group, the analytics systems expects to see the $CDF(x)>x$ for at least some samples or, stated differently, the converse of what was expected in the second type of validation and the third type of validation with the healthy control group and the healthy validation group. If the fourth type of validation fails, then this is indicative that the model is not appropriately identifying the anomalousness that it was designed to identify.

Figure 3:
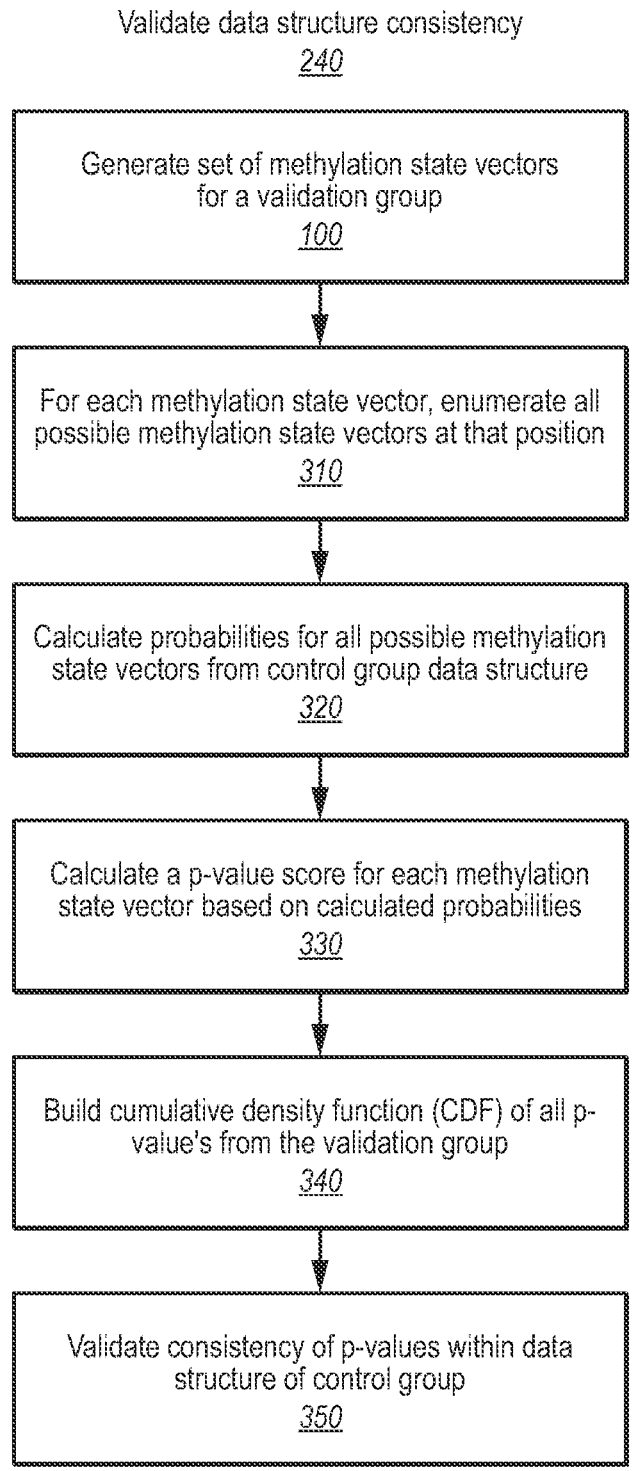
FIG. 3 is a flowchart describing an additional step of validating the data structure for the control group of FIG. 2, according to an embodiment.

FIG. 3 is a flowchart describing an additional step 240 of validating the data structure for the control group of FIG. 2, according to an embodiment. In this step 240 of validating the data structure, the analytics system performs the fourth type of validation test as described above which utilizes a validation group with a supposedly similar composition of subjects, samples, and/or fragments as the control group. For example, if the analytics system selected healthy subjects without cancer for the control group, then the analytics system also uses healthy subjects without cancer in the validation group.

The analytics system takes the validation group and generates 100 a set of methylation state vectors as described in FIG. 2. The analytics system performs a p-value calculation for each methylation state vector from the validation group. The p-value calculation process will be further described in conjunction with FIGS. 4 & 5. For each possible methylation state vector, the analytics system calculates 320 a probability from the control group's data structure. Once the probabilities are calculated for the possibilities of methylation state vectors, the analytics system calculates 330 a p-value score for that methylation state vector based on the calculated probabilities. The p-value score represents an expectedness of finding that specific methylation state vector and other possible methylation state vectors having even lower probabilities in the control group. A low p-value score, thereby, generally corresponds to a methylation state vector which is relatively unexpected in comparison to other methylation state vectors within the control group, whereas a high p-value score generally corresponds to a methylation state vector which is relatively more expected in comparison to other methylation state vectors found in the control group. Once the analytics system generates a p-value score for the methylation state vectors in the validation group, the analytics system builds 340 a cumulative density function (CDF) with the p-value scores from the validation group. The analytics system validates 370 consistency of the CDF as described above in the fourth type of validation tests.

6.4.2. Anomalously Methylated Fragments

Figure 4:
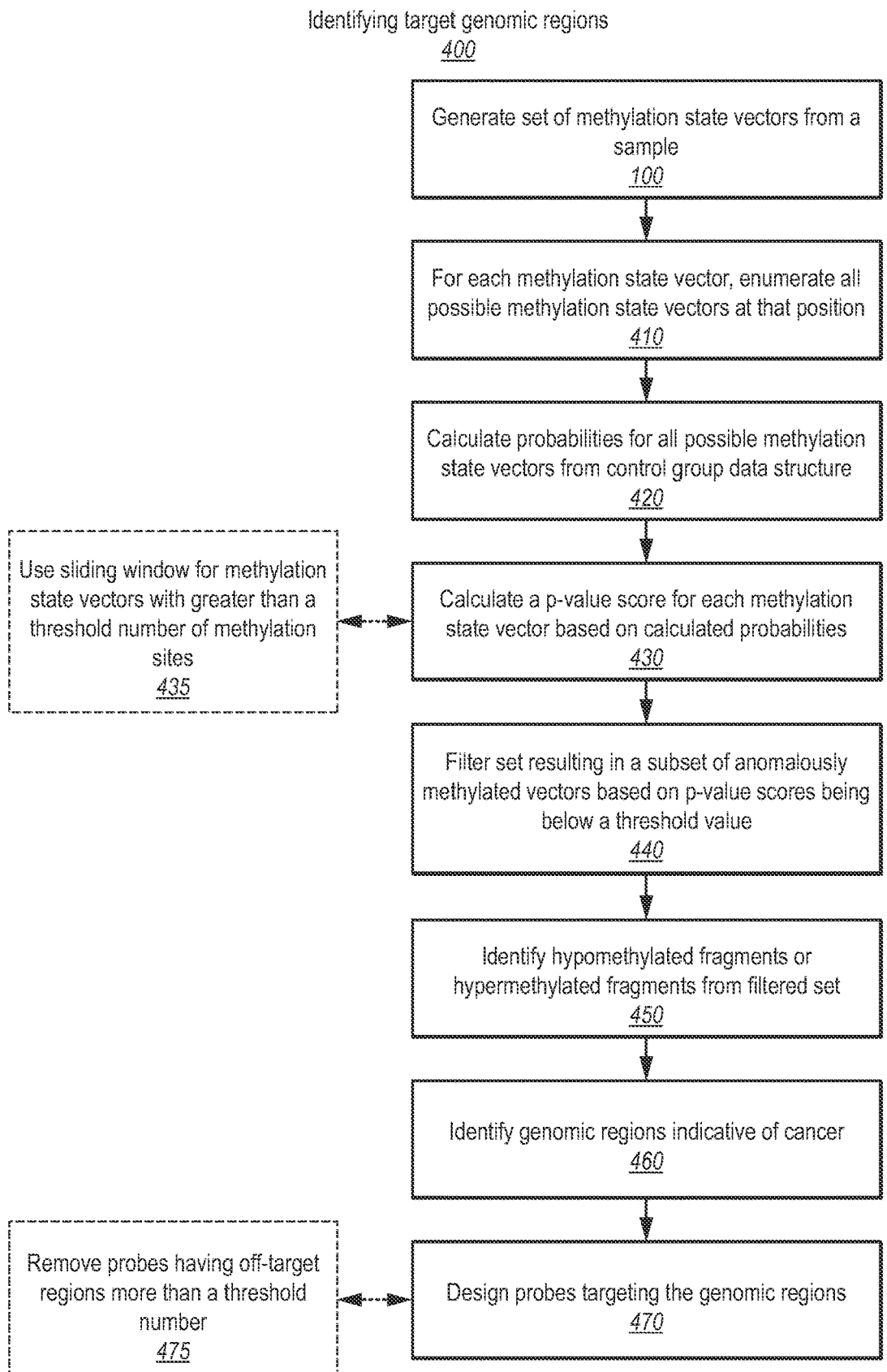
FIG. 4 is a flowchart describing a process for selecting genomic regions for designing probes for a cancer assay panel, according to an embodiment.

Anomalously methylated fragments having abnormal methylation patterns are selected as target genomic regions, according to an embodiment as outlined in FIG. 4. An exemplary process of selected anomalously methylated fragments 440 is visually illustrated in FIG. 5, and is further described below the description of FIG. 4. In process 400, the analytics system generates 100 methylation state vectors from cfDNA fragments of the sample. The analytics system handles each methylation state vector as follows.

In some embodiments, the analytics system filters 405 fragments having indeterminate states at one or more CpG sites. In such embodiments, the analytics system implements a prediction model to identify fragments not likely to have an anomalous methylation pattern for filtering. For a sample fragment, the prediction model calculates a sample probability that the sample fragment's methylation state vector occurs in comparison to the healthy control group data structure. The prediction model randomly samples a subset of possible methylation state vectors encompassing the CpG sites in the sample fragment's methylation state vector. The prediction model calculates a probability corresponding to each of the sampled possible methylation state vectors. Probability calculations for the fragment's methylation state vector and the sampled possible methylation state vectors can be calculated according to a Markov chain model as will be described below in Section 6.4.2.1 ("P-Value Score Calculation"). The prediction model calculates a proportion of the sampled possible methylation state vectors corresponding to probabilities less than or equal to the sample probability. The prediction model generates an estimated p-value score for the fragment based on the calculated proportion. The prediction model may filter fragments corresponding to p-value scores above a threshold and retain fragments corresponding to p-value scores below the threshold. Again, see e.g., U.S. application Ser. No. 16/352,602, published as U.S. Publ. No. 2019/0287652, which is hereby incorporated by reference in its entirety.

In additional embodiments, the prediction model may calculate a confidence probability that is used by the prediction model to determine when to continue or when to terminate sampling. The confidence probability describes how likely it is that a fragment's true p-value score is below a threshold based on the estimated p-value score and the probabilities of the sampled possible methylation state vectors. The prediction model may sample one or more possible additional methylation state vectors while iteratively calculating the estimated p-value score and the confidence probability. The prediction model may then terminate sampling when the confidence probability is above a confidence threshold.

For a given methylation state vector, the analytics system enumerates 410 all possible methylation state vectors having the same starting CpG site and same length (i.e., set of CpG sites) as the methylation state vector. There are only two possible states at each CpG site, methylated or unmethylated, and thus the count of distinct possibilities of methylation state vectors depends on a power of 2, such that a methylation state vector of length n would be associated with $2^n$ possible of methylation state vectors. With methylation state vectors inclusive of indeterminate states for one or more CpG sites, the analytics system may enumerate 410 possibilities of methylation state vectors considering only CpG sites that have observed states.

The analytics system calculates 420 the probability of observing each possible methylation state vector for the identified starting CpG site/methylation state vector length by accessing the healthy control group data structure. In one embodiment, calculating the probability of observing a given possibility uses Markov chain probability to model the joint probability calculation which will be described in greater detail with respect to FIG. 5. In other embodiments, calculation methods other than Markov chain probabilities are used to determine the probability of observing each possible methylation state vector.

The analytics system calculates 430 a p-value score for the methylation state vector using the calculated probabilities for each possibility. In one embodiment, this includes determining the calculated probability corresponding to the possibility that matches the methylation state vector in question. Specifically, this is the probability of having the same set of CpG sites, or the same starting CpG site, length and methylation status as the methylation state vector. The analytics system sums the calculated probabilities of any possibilities having probabilities less than or equal to the identified probability to generate the p-value score.

This p-value represents the probability of observing the methylation state vector of the fragment or other methylation state vectors even less probable in the healthy control group. A low p-value score, thereby, generally corresponds to a methylation state vector which is rare in a healthy subject, and which causes the fragment to be labeled anomalously methylated, relative to the healthy control group. A high p-value score generally relates to a methylation state vector is expected to be present, in a relative sense, in a healthy subject. If the healthy control group is a non-cancerous group, for example, a low p-value indicates that the fragment is anomolously methylated relative to the non-cancer group, and therefore possibly indicative of the presence of cancer in the test subject.

As above, the analytics system calculates p-value scores for each of a plurality of methylation state vectors, each representing a cfDNA and/or ctDNA fragment in the test sample. To identify which of the fragments are anomalously methylated, the analytics system may filter 440 the set of methylation state vectors based on their p-value scores. In one embodiment, filtering is performed by comparing the p-values scores against a threshold and keeping only those fragments below the threshold. This threshold p-value score could be on the order of 0.1, 0.01, 0.001, 0.0001, or similar.

6.4.2.1. P-Value Score Calculation

FIG. 5 is an illustration 500 of an example p-value score calculation, according to an embodiment. To calculate a p-value score given a test methylation state vector 505, the analytics system takes that test methylation state vector 505 and enumerates 410 possibilities of methylation state vectors. In this illustrative example, the test methylation state vector 505 is <$M_{23}$, $M_{24}$, $M_{25}$, $U_{26}$>. As the length of the test methylation state vector 505 is 4, there are $2^4$ possibilities of methylation state vectors encompassing CpG sites 23-26. In a generic example, the number of possibilities of methylation state vectors is $2^n$, where n is the length of the test methylation state vector or alternatively the length of the sliding window (described further below).

The analytics system calculates 420 probabilities 515 for the enumerated possible methylation state vectors. As methylation is conditionally dependent on methylation state of nearby CpG sites, one way to calculate the probability of observing a given methylation state vector possibility is to use a Markov chain model. Generally, a methylation state vector such as <$S_1$, $S_2$, . . . , $S_n$>, where S denotes the methylation state whether methylated (denoted as M), unmethylated (denoted as U), or indeterminate (denoted as I), has a joint probability that can be expanded using the chain rule of probabilities as:

$$P(<S_1, S_2, \ldots, S_n>) = P(S_n | S_1, \ldots, S_{n-2}) * \ldots * P(S_2 | S_1) * P(S_1).$$

A Markov chain model can be used to calculate the conditional probabilities of each possibility more efficiently. In one embodiment, the analytics system selects a Markov chain order k which corresponds to how many prior CpG sites in the vector (or window) to consider in the conditional probability calculation, such that the conditional probability is modeled as $P(S_n | S_1, \ldots, S_{n-1}) \sim P(S_n | S_{n-k-2}, \ldots, S_{n-1})$.

To calculate each Markov modeled probability for a possibility of methylation state vector, the analytics system accesses the control group's data structure, specifically the counts of various strings of CpG sites and states. To calculate $P(M_n | S_{n-k-2}, \ldots, S_{n-1})$, the analytics system takes a ratio of the stored count of the number of strings from the data structure matching $<S_{n-k-2}, \ldots, S_{n-1}, M_n>$ divided by the sum of the stored count of the number of strings from the data structure matching $<S_{n-k-2}, \ldots, S_{n-1}, M_n>$ and $<S_{n-k-2}, \ldots, S_{n-1}, U_n>$. Thus, $P(M_n | S_{n-k-2}, \ldots, S_{n-1})$, is calculated ratio having the form:

$$\frac{\# \text{ of } \langle S_{n-k-2}, \ldots, S_{n-1}, M_n \rangle}{\# \text{ of } \langle S_{n-k-2}, \ldots, S_{n-1}, M_n \rangle + \# \text{ of } \langle S_{n-k-2}, \ldots, S_{n-1}, U_n \rangle}.$$

The calculation may additionally implement a smoothing of the counts by applying a prior distribution. In one embodiment, the prior distribution is a uniform prior as in Laplace smoothing. As an example of this, a constant is added to the numerator and another constant (e.g., twice the constant in the numerator) is added to the denominator of the above equation. In other embodiments, an algorithmic technique such as Knesser-Ney smoothing is used.

In the illustration, the above denoted formulas are applied to the test methylation state vector 505 covering sites 23-26. Once the calculated probabilities 515 are completed, the analytics system calculates 430 a p-value score 525 that sums the probabilities that are less than or equal to the probability of possibility of methylation state vector matching the test methylation state vector 505.

In embodiments with indeterminate states, the analytics system may calculate a p-value score summing out CpG sites with indeterminates states in a fragment's methylation state vector. The analytics system identifies all possibilities that have consensus with all methylation states of the methylation state vector, excluding the indeterminate states. The analytics system may assign the probability to the methylation state vector as a sum of the probabilities of the identified possibilities. As an example, the analytics system calculates a probability of a methylation state vector of $<M_1, I_2, U_3>$ as a sum of the probabilities for the possibilities of methylation state vectors of $<M_1, M_2, U_3>$ and $<M_1, U_2, U_3>$ since methylation states for CpG sites 1 and 3 are observed and in consensus with the fragment's methylation states at CpG sites 1 and 3. This method of summing out CpG sites with indeterminate states uses calculations of probabilities of possibilities up to $2^i$, wherein i denotes the number of indeterminate states in the methylation state vector. In additional embodiments, a dynamic programming algorithm may be implemented to calculate the probability of a methylation state vector with one or more indeterminate states. Advantageously, the dynamic programming algorithm operates in linear computational time.

In one embodiment, the computational burden of calculating probabilities and/or p-value scores may be further reduced by caching at least some calculations. For example, the analytic system may cache in transitory or persistent memory calculations of probabilities for possibilities of methylation state vectors (or windows thereof). If other fragments have the same CpG sites, caching the possibility probabilities allows for efficient calculation of p-value scores without needing to re-calculate the underlying possibility probabilities. Equivalently, the analytics system may calculate p-value scores for each of the possibilities of methylation state vectors associated with a set of CpG sites from vector (or window thereof). The analytics system may cache the p-value scores for use in determining the p-value scores of other fragments including the same CpG sites. Generally, the p-value scores of possibilities of methylation state vectors having the same CpG sites may be used to determine the p-value score of a different one of the possibilities from the same set of CpG sites.

6.4.2.2. Sliding Window

In one embodiment, the analytics system uses 435 a sliding window to determine possibilities of methylation state vectors and calculate p-values. Rather than enumerating possibilities and calculating p-values for entire methylation state vectors, the analytics system enumerates possibilities and calculates p-values for only a window of sequential CpG sites, where the window is shorter in length (of CpG sites) than at least some fragments (otherwise, the window would serve no purpose). The window length may be static, user determined, dynamic, or otherwise selected.

In calculating p-values for a methylation state vector larger than the window, the window identifies the sequential set of CpG sites from the vector within the window starting from the first CpG site in the vector. The analytic system calculates a p-value score for the window including the first CpG site. The analytics system then "slides" the window to the second CpG site in the vector, and calculates another p-value score for the second window. Thus, for a window size l and methylation vector length m, each methylation state vector will generate m–l–1 p-value scores. After completing the p-value calculations for each portion of the vector, the lowest p-value score from all sliding windows is taken as the overall p-value score for the methylation state vector. In another embodiment, the analytics system aggregates the p-value scores for the methylation state vectors to generate an overall p-value score.

Using the sliding window helps to reduce the number of enumerated possibilities of methylation state vectors and their corresponding probability calculations that would otherwise need to be performed. Example probability calculations are shown in FIG. 5, but generally the number of possibilities of methylation state vectors increases exponentially by a factor of 2 with the size of the methylation state vector. To give a realistic example, it is possible for fragments to have upwards of 54 CpG sites. Instead of computing probabilities for $2^{54}$ (~$1.8 \times 10^{16}$) possibilities to generate a single p-score, the analytics system can instead use a window of size 5 (for example) which results in 50 p-value calculations for each of the 50 windows of the methylation state vector for that fragment. Each of the 50 calculations enumerates $2^5$ (32) possibilities of methylation state vectors, which total results in $50 \times 2^5$ ($1.6 \times 10^3$) probability calculations. This results in a vast reduction of calculations to be performed, with no meaningful hit to the accurate identification of anomalous fragments. This additional step can also be applied when validating 240 the control group with the validation group's methylation state vectors.

6.4.3. Analysis of Hyper or Hypomethylated Fragments

In some embodiments, an additional filtration step can be performed to identify genomic regions that can be targeted for detection of cancer, a cancer tissue of origin, or a type of cancer.

Figure 6:
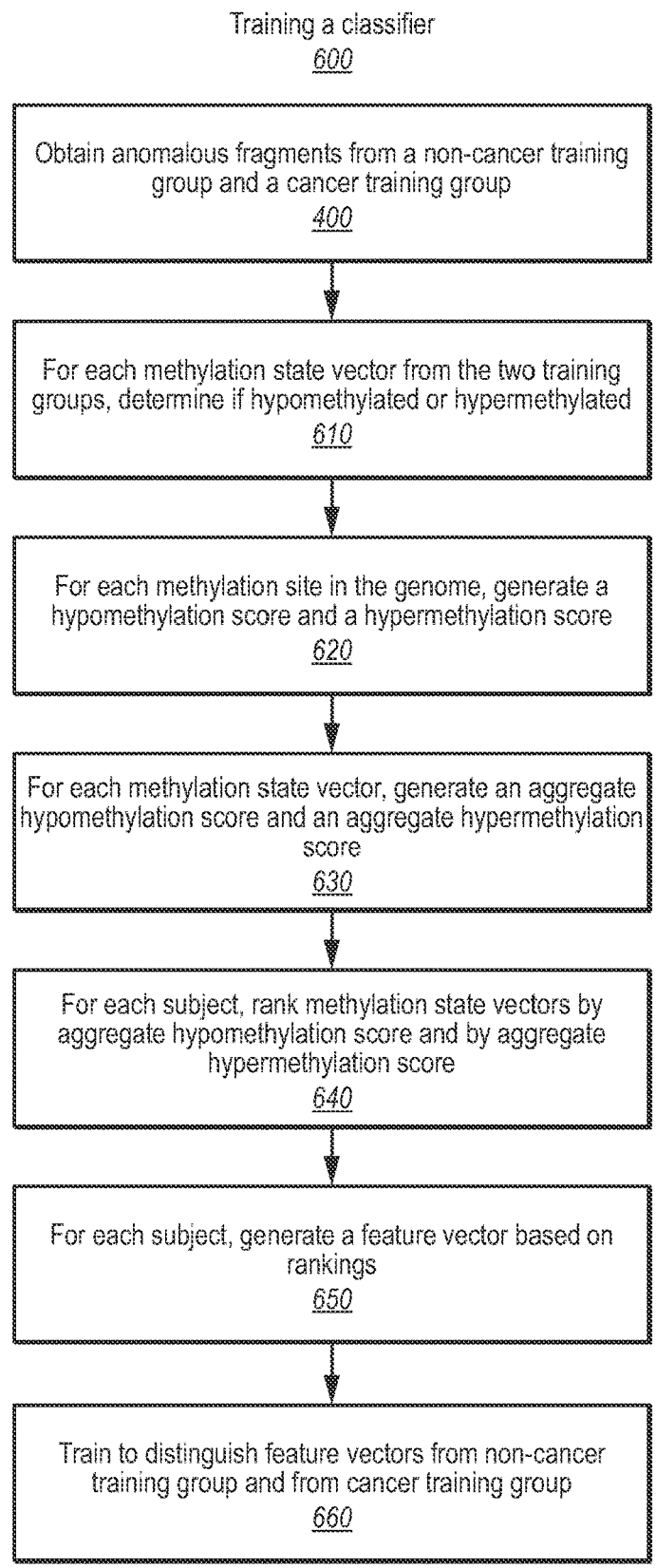
FIG. 6 is a flowchart describing a process of training a classifier based on the methylation statuses of fragments, according to an embodiment.

The analytics system may perform any variety and/or possibility of additional analyses with the set of anomalously methylated fragments. One additional analysis identifies 450 hypomethylated fragments or hypermethylated fragments from the filtered set. Fragments that are hypomethylated or hypermethylated can be defined as fragments of a certain length of CpG sites (e.g., more than 3, 4, 5, 6, 7, 8, 9, 10, etc.) with a high percentage of methylated CpG sites (e.g., more than 80%, 85%, 90%, or 95%, or any other percentage within the range of 50%-100%) or a high percentage of unmethylated CpG sites (e.g., more than 80%, 85%, 90%, or 95%, or any other percentage within the range of 50%-100%), respectively. FIG. 6, described below, illustrates an exemplary process for identifying these anomalously hypermethylated or hypomethylated portions of a genome based on the set of anomalously methylated fragments.

An alternate analysis applies 460 a trained classification model on the set of anomalous fragments. The trained classification model can be trained to identify any condition of interest that can be identified from the methylation state vectors. In one embodiment, the trained classification model is a binary classifier trained based on methylation states for cfDNA fragments obtained from a subject cohort with cancer, and optionally based on methylation states for cfDNA fragments obtained from a healthy subject cohort without cancer, and is then used to classify a test subject probability of having cancer, or not having cancer, based on anomalously methylation state vectors. In further embodiments, different classifiers may be trained using subject cohorts known to have particular cancer (e.g., breast, lung, prostrate, etc.) to predict whether a test subject has those specific cancers.

In one embodiment, the classifier is trained based on information about hyper/hypo methylated regions from the process 450 and as described with respect to FIG. 6 below.

FIG. 6 is a flowchart describing a process 600 of training a classifier based on methylation status of cfDNA fragments, according to an embodiment. An analytics system may be used to perform the process 600. The process accesses two training groups of samples—a non-cancer group and a cancer group—and obtains 400 a non-cancer set of methylation state vectors and a cancer set of methylation state vectors comprising the anomalous fragments of the samples in each group. The anomalous fragments may be identified according to the process of FIG. 4, for example.

The analytics system determines 610, for each methylation state vector, whether the methylation state vector is hypomethylated or hypermethylated. Here, the hypermethylated or hypomethylated label is assigned if at least some number of CpG sites have a particular state (methylated or unmethylated, respectively) and/or have a threshold percentage of sites that are the particular state (again, methylated or unmethylated, respectively). In one example, cfDNA fragments are identified as hypomethylated or hypermethylated, respectively, if the fragment overlaps at least 5 CpG sites, and at least 80%, 90% or 100% of its CpG sites are methylated or at least 80%, 90%, or100% are unmethylated.

In an alternate embodiment, the analytics system considers portions of the methylation state vector and determines whether the portion is hypomethylated or hypermethylated, and may distinguish that portion to be hypomethylated or hypermethylated. This alternative resolves missing methylation state vectors which are large in size but contain at least one region of dense hypomethylation or hypermethylation. This process of defining hypomethylation and hypermethylation can be applied in step 450 of FIG. 4.

In one embodiment, the analytics system generates 620 a hypomethylation score ($P_{hypo}$) and a hypermethylation score ($P_{hyper}$) per CpG site in the genome. To generate either score at a given CpG site, the classifier takes four counts at that CpG site— (1) count of (methylations state) vectors of the cancer set labeled hypomethylated that overlap the CpG site; (2) count of vectors of the cancer set labeled hypermethylated that overlap the CpG site; (3) count of vectors of the non-cancer set labeled hypomethylated that overlap the CpG site; and (4) count of vectors of the non-cancer set labeled hypermethylated that overlap the CpG site. Additionally the process may normalize these counts for each group to account for variance in group size between the non-cancer group and the cancer group.

In one embodiment, the hypomethylation score at a given CpG site is defined as a log of a ratio of (1) over (3). Similarly the hypermethylation score is calculated as a log of a ratio of (2) over (4). Additionally these ratios may be calculated with an additional smoothing technique as discussed above.

In another embodiment, the hypomethylation score is defined as a ratio of (1) over (1) summed with (3). The hypermethylation score is defined as a ratio of (2) over (2) summed with (4). Similar to the embodiment above, smoothing techniques may be implemented into the ratios.

The analytics system generates 630 an aggregate hypomethylation score and an aggregate hypermethylation score for each anomalous methylation state vector. The aggregate hyper and hypo methylation scores, are determined based on the hyper and hypo methylation scores of the CpG sites in the methylation state vector. In one embodiment, the aggregate hyper and hypo methylation scores are assigned as the largest hyper and hypo methylation scores of the sites in each state vector, respectively. However, in alternate embodiments, the aggregate scores could be based on means, medians, or other calculations that use the hyper/hypo methylation scores of the sites in each vector. In one embodiment, the analytics system assigns the greater of the aggregate hypomethylation score and the aggregate hypermethylation score to the anomalous methylation state vector.

The analytics system then ranks 640 all of that subject's methylation state vectors by their aggregate hypomethylation score and by their aggregate hypermethylation score, resulting in two rankings per subject. The process selects aggregate hypomethylation scores from the hypomethylation ranking and aggregate hypermethylation scores from the hypermethylation ranking. With the selected scores, the classifier generates 650 a single feature vector for each subject. In one embodiment, the scores selected from either ranking are selected with a fixed order that is the same for each generated feature vector for each subject in each of the training groups. As an example, in one embodiment the classifier selects the first, the second, the fourth, the eighth, the sixteenth, the thirty-second, and the sixty-fourth aggregate hyper methylation score, and similarly for each aggregate hypo methylation score, from each ranking and writes those scores in the feature vector for that subject (totaling 14 features in the feature vector). In additional embodiments, to adjust for sample sequencing depth, the analytics system adjusts ranks in linear proportion to relative sample depth. For example, if the relative sample depth was x, interpolated scores were taken at x*the original ranks (i.e. x=1.1, we take scores computed at ranks 1.1, 2.2, . . . , x*2i). The analytics system may then define the feature vector based on the adjusted ranks to be used in further classification.

The analytics system trains 660 a binary classifier to distinguish feature vectors between the cancer and non-cancer training groups. The analytics system may group the training samples into sets of one or more training samples for iterative batch training of the binary classifier. After inputting all sets of training samples including their training feature vectors and adjusting the classification parameters, the binary classifier is sufficiently trained to label test samples according to their feature vector within some margin of error.

In one embodiment, the classifier is a non-linear classifier. In a specific embodiment, the classifier is a non-linear classifier utilizing a L2-regularized kernel logistic regression with a Gaussian radial basis function (RBF) kernel. Specifically, a regularized kernel logistic regression classifier (KLR) was trained using the isotropic radial basis function (power exponential 2) as the kernel with scale parameter gamma and L2 regularization parameter lambda. Gamma and lambda were optimized for holdout log-loss using internal cross-validation within specified training data, and were optimized using grid-search in multiplicative steps, starting at the maximum value and halving the parameter each step. In other embodiments, the classifier can include other types of classifiers, such as a random forest classifier, a mixture model, a convolutional neural network, or an autoencoder model.

In some embodiments, calculation is performed with respect to each CpG site. Specifically a first count is determined that is the number of cancerous samples (cancer count) that include a fragment overlapping that CpG, and a second count is determined that is the total number of samples containing fragments overlapping that CpG (total) in the set. Genomic regions can be selected based on the numbers, for example, based on criteria positively correlated to the number of cancerous samples (cancer count) that include a fragment overlapping that CpG, and inversely correlated to the total number of samples containing fragments overlapping that CpG (total) in the set. Specifically, in one embodiment, the number of non-cancer samples (neon-cancer) and the number of cancer samples ($n_{cancer}$) having a fragment overlapping a CpG site are counted. Then the probability that a sample is cancer is estimated as ($n_{cancer}$+1)/($n_{cancer}$ $n_{non-cancer}$+2). CpG sites by this metric were ranked and greedily added to a panel until the panel size budget is exhausted.

In some cases, additional analysis calculates the log-odds ratio that the anomalous fragments from a subject are indicative of cancer generally. The log-odds ratio can be calculated by taking the log of a ratio of a probability of being cancerous over a probability of being non-cancerous (i.e., one minus the probability of being cancerous), both as determined by the applied classification model.

6.4.4. Off-Target Genomic Regions

In some embodiments, probes targeting selected genomic regions are further filtered 465 based on the number of their off-target regions. This is for screening probes that pull down too many cfDNA fragments containing off-target genomic regions. Exclusion of probes having many off-target regions can be valuable by decreasing off-target rates and increasing target coverage for a given amount of sequencing.

An off-target genomic region is a genomic region that has sufficient homology to a target genomic region to be bound and pulled down by a probe designed to target the target genomic region. An off-target genomic region can be a genomic region (or a converted sequence of that same region) that aligns to a probe along at least 35 bp, 40 bp, 45 bp, 50 bp, 60 bp, 70 bp, or 80 bp with at least an 80%, 85%, 90%, 95%, or 97% match rate. In one embodiment, an off-target genomic region is a genomic region (or a converted sequence of that same region) that aligns to a probe along at least 45 bp with at least a 90% match rate. Various methods known in the art can be adopted to screen off-target genomic regions.

Exhaustively searching the genome to find all off-target genomic regions can be computationally challenging. In one embodiment, a k-mer seeding strategy (which can allow one or more mismatches) is combined to local alignment at the seed locations. In this case, exhaustive searching of good alignments can be guaranteed based on k-mer length, number of mismatches allowed, and number of k-mer seed hits at a particular location. This requires doing dynamic programing local alignment at a large number of locations, so this approach is highly optimized to use vector CPU instructions (e.g., AVX2, AVX512) and also can be parallelized across many cores within a machine and also across many machines connected by a network. A person of ordinary skill will recognize that modifications and variations of this approach can be implemented for the purpose of identifying off-target genomic regions.

In some embodiments, probes having off-target genomic regions more than a threshold number are excluded. For example, probes having more than 30, more than 25, more than 20, more than 18, more than 15, more than 12, more than 10, or more than 5 are excluded.

In some embodiments, probes are divided into 2, 3, 4, 5, 6, or more separate groups depending on the numbers of off-target regions. For example, probes having no off-target regions are assigned to high-quality group, probes having 1-19 off-target regions are assigned to low-quality group, and probes having more than 19 off-target regions are assigned to poor-quality group. Other cut-off values can be used for the grouping.

In some embodiments, probes in the lowest quality group are excluded. In some embodiments, probes in groups other than the highest-quality group are excluded. In some embodiments, separate panels are made for the probes in each group. In some embodiments, all the probes are put on the same panel, but separate analysis is performed based on the assigned groups.

In some embodiments, a panel comprises a larger number of high-quality probes than the number of probes in lower groups. In some embodiments, a panel comprises a smaller number of poor-quality probes than the number of probes in other group. In some embodiments, more than 95%, 90%, 85%, 80%, 75%, or 70% of probes in a panel are high-quality probes. In some embodiments, less than 35%, 30%, 20%, 10%, 5%, 4%, 3%, 2% or 1% of the probes in a panel are low-quality probes. In some embodiments, less than 5%, 4%, 3%, 2% or 1% of the probes in a panel are poor-quality probes. In some embodiments, no poor-quality probes are included in a panel.

In some embodiments, probes having below 50%, below 40%, below 30%, below 20%, below 10% or below 5% are excluded. In some embodiments, probes having above 30%, above 40%, above 50%, above 60%, above 70%, above 80%, or above 90% are selectively included in a panel.

6.5. Methods of Using Cancer Assay Panel

In yet another aspect, methods of using a cancer assay panel are provided. The methods can comprise steps of a bisulfite treatment cfDNA fragments to convert unmethylated cytosines to uracils, applying the samples to the cancer assay panel and sequencing cfDNA fragments that bind to the probes in the panel. The sequence reads can be further compared to a reference genome. This assay can allow identification of methylation states at CpG sites within the fragments and thus provide information relevant to diagnosis of cancer.

6.5.1. Sample Processing

Figure 7A:
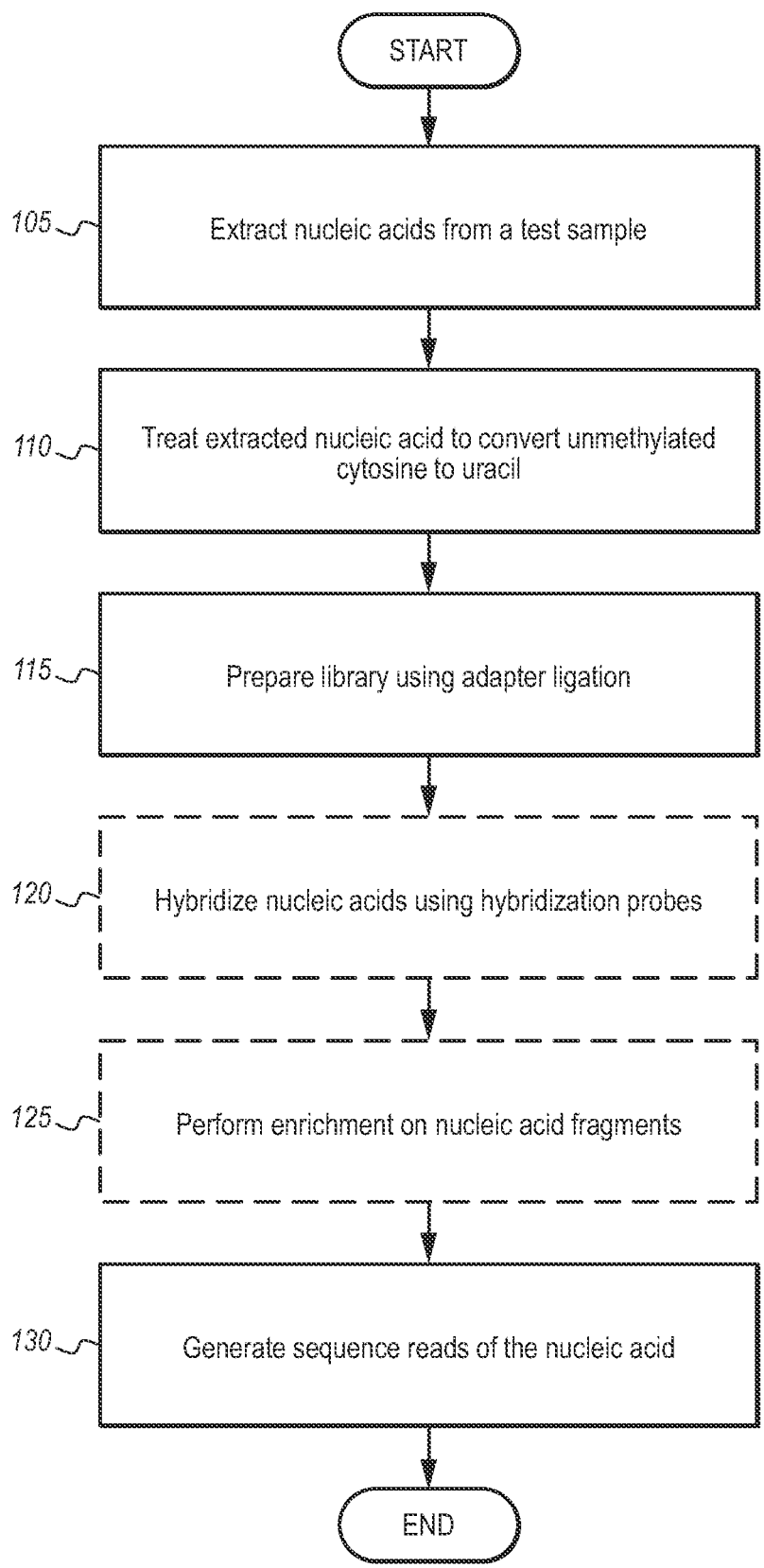
FIG. 7A is a flowchart describing a process of sequencing a fragment of cell-free DNA (cfDNA), according to an embodiment.

FIG. 7A is a flowchart of a method for preparing a nucleic acid sample for analysis according to one embodiment. The method includes, but is not limited to, the following steps. For example, any step of the method may comprise a quantitation sub-step for quality control or other laboratory assay procedures known to one skilled in the art.

In step 105, a nucleic acid sample (DNA or RNA) is extracted from a subject. In the present disclosure, DNA and RNA may be used interchangeably unless otherwise indicated. That is, the embodiments described herein may be applicable to both DNA and RNA types of nucleic acid sequences. However, the examples described herein may focus on DNA for purposes of clarity and explanation. The sample may be any subset of the human genome, including the whole genome. The sample may include blood, plasma, serum, urine, fecal, saliva, other types of bodily fluids, or any combination thereof. In some embodiments, methods for drawing a blood sample (e.g., syringe or finger prick) may be less invasive than procedures for obtaining a tissue biopsy, which may require surgery. The extracted sample may comprise cfDNA and/or ctDNA. For healthy individuals, the human body may naturally clear out cfDNA and other cellular debris. If a subject has a cancer or disease, cfDNA or ctDNA in an extracted sample may be present at a detectable level for diagnosis.

In step 110, the cfDNA fragments are treated to convert unmethylated cytosines to uracils. In one embodiment, the method uses a bisulfite treatment of the DNA which converts the unmethylated cytosines to uracils without converting the methylated cytosines. For example, a commercial kit such as the EZ DNA Methylation™—Gold, EZ DNA Methylation™—Direct or an EZ DNA Methylation™—Lightning kit (available from Zymo Research Corp (Irvine, Calif.)) is used for the bisulfite conversion. In another embodiment, the conversion of unmethylated cytosines to uracils is accomplished using an enzymatic reaction. For example, the conversion can use a commercially available kit for conversion of unmethylated cytosines to uracils, such as APOBEC-Seq (NEBiolabs, Ipswich, Mass.).

In step 115, a sequencing library is prepared. In a first step, a ssDNA adapter is added to the 3'-OH end of a bisulfite-converted ssDNA molecule using a ssDNA ligation reaction. In one embodiment, the ssDNA ligation reaction uses CircLigase II (Epicentre) to ligate the ssDNA adapter to the 3'-OH end of a bisulfite-converted ssDNA molecule, wherein the 5'-end of the adapter is phosphorylated and the bisulfite-converted ssDNA has been dephosphorylated (i.e., the 3' end has a hydroxyl group). In another embodiment, the ssDNA ligation reaction uses Thermostable 5' AppDNA/RNA ligase (available from New England BioLabs (Ipswich, Mass.)) to ligate the ssDNA adapter to the 3'-OH end of a bisulfite-converted ssDNA molecule. In this example, the first UMI adapter is adenylated at the 5'-end and blocked at the 3'-end. In another embodiment, the ssDNA ligation reaction uses a T4 RNA ligase (available from New England BioLabs) to ligate the ssDNA adapter to the 3'-OH end of a bisulfate-converted ssDNA molecule. In a second step, a second strand DNA is synthesized in an extension reaction. For example, an extension primer, that hybridizes to a primer sequence included in the ssDNA adapter, is used in a primer extension reaction to form a double-stranded bisulfate-converted DNA molecule. Optionally, in one embodiment, the extension reaction uses an enzyme that is able to read through uracil residues in the bisulfate-converted template strand. Optionally, in a third step, a dsDNA adapter is added to the double-stranded bisulfate-converted DNA molecule. Finally, the double-stranded bisulfate-converted DNA is amplified to add sequencing adapters. For example, PCR amplification using a forward primer that includes a P5 sequence and a reverse primer that includes a P7 sequence is used to add P5 and P7 sequences to the bisulfate-converted DNA. Optionally, during library preparation, unique molecular identifiers (UMI) may be added to the nucleic acid molecules (e.g., DNA molecules) through adapter ligation. The UMIs are short nucleic acid sequences (e.g., 4-10 base pairs) that are added to ends of DNA fragments during adapter ligation. In some embodiments, UMIs are degenerate base pairs that serve as a unique tag that can be used to identify sequence reads originating from a specific DNA fragment. During PCR amplification following adapter ligation, the UMIs are replicated along with the attached DNA fragment, which provides a way to identify sequence reads that came from the same original fragment in downstream analysis.

In step 120, targeted DNA sequences may be enriched from the library. This is used, for example, where a targeted panel assay is being performed on the samples. During enrichment, hybridization probes (also referred to herein as "probes") are used to target, and pull down, nucleic acid fragments informative for the presence or absence of cancer (or disease), or cancer status. For a given workflow, the probes may be designed to anneal (or hybridize) to a target (complementary) strand of DNA or RNA. The target strand may be the "positive" strand (e.g., the strand transcribed into mRNA, and subsequently translated into a protein) or the complementary "negative" strand. The probes may range in length from 10s, 100s, or 1000s of base pairs. Moreover, the probes may cover overlapping portions of a target region.

After a hybridization step 120, the hybridized nucleic acid fragments are captured and may also be amplified using PCR (enrichment 125). For example, the target sequences can be enriched to obtain enriched sequences that can be subsequently sequenced. In general, any known method in the art can be used to isolate, and enrich for, probe-hybridized target nucleic acids. For example, as is well known in the art, a biotin moiety can be added to the 5'-end of the probes (i.e., biotinylated) to facilitate isolation of target nucleic acids hybridized to probes using a streptavidin-coated surface (e.g., streptavidin-coated beads).

In step 130, sequence reads are generated from the enriched DNA sequences, e.g., enriched sequences. Sequencing data may be acquired from the enriched DNA sequences by known means in the art. For example, the method may include next generation sequencing (NGS) techniques including synthesis technology (Illumina), pyrosequencing (454 Life Sciences), ion semiconductor technology (Ion Torrent sequencing), single-molecule real-time sequencing (Pacific Biosciences), sequencing by ligation (SOLiD sequencing), nanopore sequencing (Oxford Nanopore Technologies), or paired-end sequencing. In some embodiments, massively parallel sequencing is performed using sequencing-by-synthesis with reversible dye terminators.

6.5.2. Analysis of Sequence Reads

In some embodiments, the sequence reads may be aligned to a reference genome using known methods in the art to determine alignment position information. The alignment position information may indicate a beginning position and an end position of a region in the reference genome that corresponds to a beginning nucleotide base and end nucleotide base of a given sequence read. Alignment position information may also include sequence read length, which can be determined from the beginning position and end position. A region in the reference genome may be associated with a gene or a segment of a gene.

In various embodiments, a sequence read is comprised of a read pair denoted as $R_1$ and $R_2$. For example, the first read $R_1$ may be sequenced from a first end of a nucleic acid fragment whereas the second read $R_2$ may be sequenced from the second end of the nucleic acid fragment. Therefore, nucleotide base pairs of the first read $R_1$ and second read $R_2$ may be aligned consistently (e.g., in opposite orientations) with nucleotide bases of the reference genome. Alignment position information derived from the read pair $R_1$ and $R_2$ may include a beginning position in the reference genome that corresponds to an end of a first read (e.g., $R_1$) and an end position in the reference genome that corresponds to an end of a second read (e.g., $R_2$). In other words, the beginning position and end position in the reference genome represent the likely location within the reference genome to which the nucleic acid fragment corresponds. In one embodiment, the read pair $R_1$ and $R_2$ can be assembled into a fragment, and the fragment used for subsequent analysis and/or classification. An output file having SAM (sequence alignment map) format or BAM (binary alignment map) format may be generated and output for further analysis.

From the sequence reads, the location and methylation state for each of CpG site may be determined based on alignment to a reference genome. Further, a methylation state vector for each fragment may be generated specifying a location of the fragment in the reference genome (e.g., as specified by the position of the first CpG site in each fragment, or another similar metric), a number of CpG sites in the fragment, and the methylation state of each CpG site in the fragment whether methylated (e.g., denoted as M), unmethylated (e.g., denoted as U), or indeterminate (e.g., denoted as I). The methylation state vectors may be stored in temporary or persistent computer memory for later use and processing. Further, duplicate reads or duplicate methylation state vectors from a single subject may be removed. In an additional embodiment, it may be determined that a certain fragment has one or more CpG sites that have an indeterminate methylation status. Such fragments may be excluded from later processing or selectively included where downstream data model accounts for such indeterminate methylation statuses.

Figure 7B:
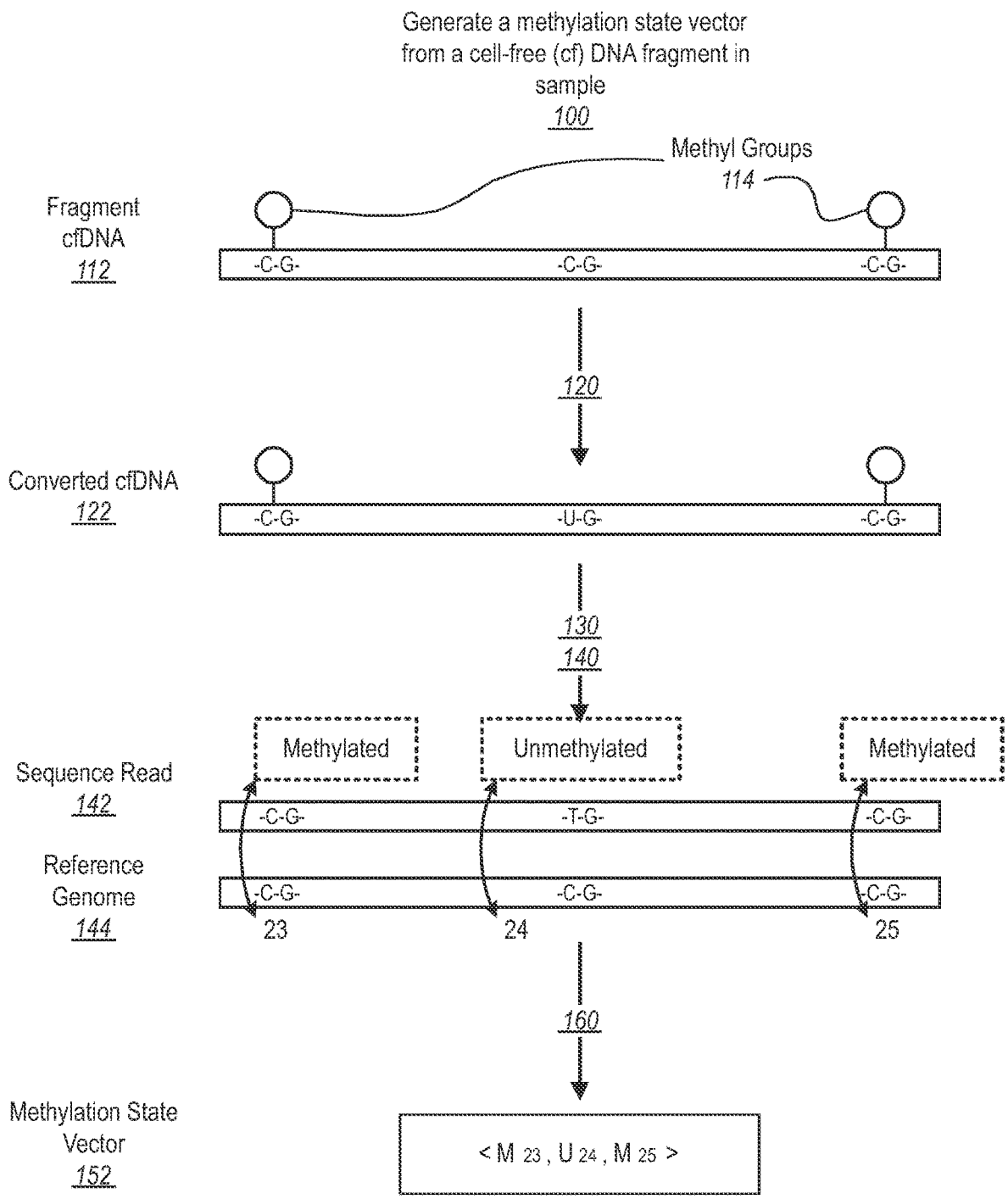
FIG. 7B is an illustration of the process of FIG. 7A of sequencing a fragment of cfDNA to obtain a methylation state vector (e.g., a methylation state for the fragment), according to an embodiment.

FIG. 7B is an illustration of the process 100 of FIG. 7A of sequencing a cfDNA fragment to obtain a methylation state vector, according to an embodiment. As an example, the analytics system takes a cfDNA fragment 112. In this example, the cfDNA fragment 112 contains three CpG sites. As shown, the first and third CpG sites of the cfDNA fragment 112 are methylated 114. During the treatment step 120, the cfDNA fragment 112 is converted to generate a converted cfDNA fragment 122. During the treatment 120, the second CpG site which was unmethylated has its cytosine converted to uracil. However, the first and third CpG sites are not converted.

After conversion, a sequencing library 130 is prepared and sequenced 140 generating a sequence read 142. The analytics system aligns 150 the sequence read 142 to a reference genome 144. The reference genome 144 provides the context as to what position in a human genome the fragment cfDNA originates from. In this simplified example, the analytics system aligns 150 the sequence read such that the three CpG sites correlate to CpG sites 23, 24, and 25 (arbitrary reference identifiers used for convenience of description). The analytics system thus generates information both on methylation status of all CpG sites on the cfDNA fragment 112 and which to position in the human genome the CpG sites map. As shown, the CpG sites on sequence read 142 which were methylated are read as cytosines. In this example, the cytosines appear in the sequence read 142 only in the first and third CpG site which allows one to infer that the first and third CpG sites in the original cfDNA fragment were methylated. Whereas, the second CpG site is read as a thymine (U is converted to T during the sequencing process), and thus, one can infer that the second CpG site was unmethylated in the original cfDNA fragment. With these two pieces of information, the methylation status and location, the analytics system generates 160 a methylation state vector 152 for the fragment cfDNA 112. In this example, the resulting methylation state vector 152 is $<M_{23}, U_{24}, M_{25}>$, wherein M corresponds to a methylated CpG site, U corresponds to an unmethylated CpG site, and the subscript number corresponds to a position of each CpG site in the reference genome.

FIGS. 9A & 9B show three graphs of data validating the consistency of sequencing from a control group. The first graph 170 shows conversion accuracy of conversion of unmethylated cytosines to uracil (step 120) on cfDNA fragment obtained from a test sample across subjects in varying stages of cancer—stage I, stage II, stage III, stage IV, and non-cancer. As shown, there was uniform consistency in converting unmethylated cytosines on cfDNA fragments into uracils. There was an overall conversion accuracy of 99.47% with a precision at ±0.024%. The second graph 180 shows mean coverage over varying stages of cancer. The mean coverage over all groups being ~34× mean across the genome coverage of DNA fragments, using only those confidently mapped to the genome are counted. The third graph 190 shows concentration of cfDNA per sample across varying stages of cancer.

6.5.3. Detection of Cancer

Sequence reads or fragments obtained by the methods provided herein can be analyzed by a medical professional, or further processed by an automated algorithms. For example, the analytics system is used to receive sequencing data from a sequencer and perform various aspects of processing as described herein. The analytics system can be one of a personal computer (PC), a desktop computer, a laptop computer, a notebook, a tablet PC, a mobile device. A computing device can be communicatively coupled to the sequencer through a wireless, wired, or a combination of wireless and wired communication technologies. Generally, the computing device is configured with a processor and memory storing computer instructions that, when executed by the processor, cause the processor to perform steps as described in the remainder of this document. Generally, the amount of genetic data and data derived therefrom is sufficiently large, and the amount of computational power required so great, so as to be impossible to be performed on paper or by the human mind alone.

The clinical interpretation of methylation status of targeted genomic regions is a process that includes classifying the clinical effect of each or a combination of the methylation status and reporting the results in ways that are meaningful to a medical professional. The clinical interpretation can be based on comparison of the sequence reads with a database specific to cancer or non-cancer subjects, and/or based on numbers and types of the cfDNA fragments having cancer-specific methylation patterns identified from a sample. In some embodiments, targeted genomic regions are ranked or classified based on their likeness to be differentially methylated in cancer samples, and the ranks or classifications are used in the interpretation process. The ranks and classifications can include (1) the type of clinical effect, (2) the strength of evidence of the effect, and (3) the size of the effect. Various methods for clinical analysis and interpretation of genome data can be adopted for analysis of the sequence reads. In some other embodiments, the clinical interpretation of the methylation states of such differentially methylated regions can be based on machine learning approaches that interpret a current sample based on a classification or regression method that was trained using the methylation states of such differentially methylated regions from samples from cancer and non-cancer patients with known cancer status, cancer type, cancer stage, tissue of origin, etc.

The clinically meaningful information can include the presence or absence of cancer generally, presence or absence of certain types of cancers, cancer stage, or presence or absence of other types of diseases. In some embodiments, the information relates to a presence or absence of one or more cancer types, selected from the group consisting of anorectal cancer, bladder and urothelial cancer, blood cancer, breast cancer (hormone receptor positive and hormone receptor negative), biliary tract cancer, cervical cancer, colorectal cancer, endometrial cancer, esophageal cancer, head and neck cancer, gastric cancer, hepatobiliary cancer, liver cancer, lung cancer, lymphoid neoplasm, gall bladder cancer, melanoma, multiple myeloma, ovarian cancer, pancreatic cancer, upper GI tract cancer, prostate cancer, renal cancer, sarcoma, thyroid cancer, bile duct cancer, urothelial cancer, and uterine cancer.

Cancer Classifier

To train a cancer type classifier, the analytics system obtains a plurality of training samples each having a set of hypomethylated and hypermethylated fragments indicative of cancer, e.g., identified via step 450 in the process 400, and a label of the training sample's cancer type. The analytics system determines, for each training sample, a feature vector based on the set of hypomethylated and hypermethylated fragments indicative of cancer. The analytics system calculates an anomaly score for each CpG site in the targeted genomic regions. In one embodiment, the analytics system defines the anomaly score for the feature vector as a binary scoring based on whether there is a hypomethylated or hypermethylated fragment from the set that encompasses the CpG site. Once all anomaly scores are determined for a training sample, the analytics system determines the feature vector as a vector of elements including, for each element, one of the anomaly scores associated with one of the CpG sites. The analytics system may normalize the anomaly scores of the feature vector based on a coverage of the sample, i.e., a median or average sequencing depth over all CpG sites.

With the feature vectors of the training samples, the analytics system can train the cancer classifier. In one embodiment, the analytics system trains a binary cancer classifier to distinguish between the labels, cancer and non-cancer, based on the feature vectors of the training samples. In this embodiment, the classifier outputs a prediction score indicating the likelihood of the presence or absence of cancer. In another embodiment, the analytics system trains a multiclass cancer classifier to distinguish between many cancer types (e.g., between head and neck cancer, liver/bileduct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer). In this multiclass cancer classifier embodiment, the cancer classifier is trained to determine a cancer prediction that comprises a prediction value for each of the cancer types being classified for. The prediction values may correspond to a likelihood that a given sample has each of the cancer types. For example, the cancer classifier returns a cancer prediction including a prediction value for breast cancer, lung cancer, and non-cancer. For example, the cancer classifier may return a cancer prediction for a test sample including a prediction score for breast cancer, lung cancer, and/or no cancer. In either embodiment, the analytics system trains the cancer classifier by inputting sets of training samples with their feature vectors into the cancer classifier and adjusting classification parameters so that a function of the classifier accurately relates the training feature vectors to their corresponding label. The analytics system may group the training samples into sets of one or more training samples for iterative batch training of the cancer classifier. After inputting all sets of training samples including their training feature vectors and adjusting the classification parameters, the cancer classifier is sufficiently trained to label test samples according to their feature vector within some margin of error. The analytics system may train the cancer classifier according to any one of a number of methods. As an example, the binary cancer classifier may be a L2-regularized logistic regression classifier that is trained using a log-loss function. As another example, the multi-cancer classifier may be a multinomial logistic regression. In practice either type of cancer classifier may be trained using other techniques. These techniques are numerous including potential use of kernel methods, machine learning algorithms such as multilayer neural networks, etc. In particular, methods as described in PCT/US2019/022122 and U.S. patent application Ser. No. 16/352,602 which are incorporated by reference in their entireties herein can be used for various embodiments.

In particular embodiments, a cancer classifier is trained by the process comprising the steps of: a. obtaining sequence information of training fragments from a plurality of training subjects; b. for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, c. for each training subject, generating a training feature vector based on the hypomethylated training fragments and hypermethylated training fragments, and d. training the model with the training feature vectors from the one or more training subjects without cancer and the training feature vectors from the one or more training subjects with cancer. The training method can further comprise the steps of: a. obtaining sequence information of training fragments from a plurality of training subjects; b. for each training fragment, determining whether that training fragment is hypomethylated or hypermethylated, wherein each of the hypomethylated and hypermethylated training fragments comprises at least a threshold number of CpG sites with at least a threshold percentage of the CpG sites being unmethylated or methylated, respectively, c. for each of a plurality of CpG sites in a reference genome: quantifying a count of hypomethylated training fragments which overlap the CpG site and a count of hypermethylated training fragments which overlap the CpG site; and generating a hypomethylation score and a hypermethylation score based on the count of hypomethylated training fragments and hypermethylated training fragments; d. for each training fragment, generating an aggregate hypomethylation score based on the hypomethylation score of the CpG sites in the training fragment and an aggregate hypermethylation score based on the hypermethylation score of the CpG sites in the training fragment; e. for each training subject: ranking the plurality of training fragments based on aggregate hypomethylation score and ranking the plurality of training fragments based on aggregate hypermethylation score; and generating a feature vector based on the ranking of the training fragments; f obtaining training feature vectors for one or more training subjects without cancer and training feature vectors for the one or more training subjects with cancer; and g. training the model with the feature vectors for the one or more training subjects without cancer and the feature vectors for the one or more training subjects with cancer. In some embodiments, the model comprises one of a kernel logistic regression classifier, a random forest classifier, a mixture model, a convolutional neural network, and an autoencoder model.

In some embodiments, quantifying a count of hypomethylated training fragments which overlap that CpG site and a count of hypermethylated training fragments which overlap that CpG site further comprises: a. quantifying a cancer count of hypomethylated training fragments from the one or more training subjects with cancer that overlap that CpG site and a non-cancer count of hypomethylated training fragments from the one or more training subjects without cancer that overlap that CpG site; and b. quantifying a cancer count of hypermethylated training fragments from the one or more training subjects with cancer that overlap that CpG site and a non-cancer count of hypermethylated training fragments from the one or more training subjects without cancer that overlap that CpG site. In some embodiments, generating a hypomethylation score and a hypermethylation score based on the count of hypomethylated training fragments and hypermethylated training fragments further comprises: a. for generating the hypomethylation score, calculating a hypomethylation ratio of the cancer count of hypomethylated training fragments over a hypomethylation sum of the cancer count of hypomethylated training fragments and the non-cancer count of hypomethylated training fragments; and b. for generating the hypermethylation score, calculating a hypermethylation ratio of the cancer count of hypermethylated training fragments over a hypermethylation sum of the cancer count of hypermethylated training fragments and the non-cancer count of hypermethylated training fragments.

During deployment, the analytics system obtains sequence reads from a test sample collected from a subject. Various sequencing methods available in the art can be used to obtain sequence reads. In some embodiments, the sequence reads are obtained from whole genome sequencing or targeted sequencing. In some embodiments, the sequence reads include a set of sequence reads of modified test fragments, wherein the modified test fragments are obtained by processing a set of nucleic acid fragments, wherein each of the nucleic acid fragments corresponds to or is derived from a plurality of genomic regions selected from any one of Lists 1-8. In some embodiments, the sequence reads are from the DNA samples enriched using the assay panel described herein.

The analytics system processes the sequence reads to obtain a test feature vector in a similar process as described for the training samples. In some embodiments, the test feature vector is obtained by the process comprising a. for each of the nucleic acid fragments, determining whether the nucleic acid fragment is hypomethylated or hypermethylated, wherein each of the hypomethylated and hypermethylated nucleic acid fragments comprises at least a threshold number of CpG sites with at least a threshold percentage of the CpG sites being unmethylated or methylated, respectively; b. for each of a plurality of CpG sites in a reference genome: quantifying a count of hypomethylated nucleic acid fragments which overlap the CpG site and a count of hypermethylated nucleic acid fragments which overlap the CpG site; and generating a hypomethylation score and a hypermethylation score based on the count of hypomethylated nucleic acid fragments and hypermethylated nucleic acid fragments; c. for each nucleic acid fragment, generating an aggregate hypomethylation score based on the hypomethylation score of the CpG sites in the nucleic acid fragment and an aggregate hypermethylation score based on the hypermethylation score of the CpG sites in the nucleic acid fragment; d. ranking the plurality of nucleic acid fragments based on aggregate hypomethylation score and ranking the plurality of nucleic acid fragments based on aggregate hypermethylation score; and e. generating the test feature vector based on the ranking of the nucleic acid fragments.

The analytics system then inputs the test feature vector into the trained cancer classifier to yield a cancer prediction, e.g., binary prediction (cancer or non-cancer) or multiclass cancer prediction (prediction score for each of a plurality of cancer types). In some embodiments, the analytics system outputs a cancer probability for the test sample. The cancer probability can be compared to a threshold probability to determine whether the test sample is from a subject with cancer or without cancer.

Exemplary Sequencer and Analytics System

FIG. 8A is a flowchart of systems and devices for sequencing nucleic acid samples according to one embodiment. This illustrative flowchart includes devices such as a sequencer 820 and an analytics system 800. The sequencer 820 and the analytics system 800 may work in tandem to perform one or more steps in the processes described herein.

In various embodiments, the sequencer 820 receives an enriched nucleic acid sample 810. As shown in FIG. 8A, the sequencer 820 can include a graphical user interface 825 that enables user interactions with particular tasks (e.g., initiate sequencing or terminate sequencing) as well as one more loading stations 830 for loading a sequencing cartridge including the enriched fragment samples and/or for loading necessary buffers for performing the sequencing assays.

Therefore, once a user of the sequencer 820 has provided the necessary reagents and sequencing cartridge to the loading station 830 of the sequencer 820, the user can initiate sequencing by interacting with the graphical user interface 825 of the sequencer 820. Once initiated, the sequencer 820 performs the sequencing and outputs the sequence reads of the enriched fragments from the nucleic acid sample 810.

In some embodiments, the sequencer 820 is communicatively coupled with the analytics system 800. The analytics system 800 includes some number of computing devices used for processing the sequence reads for various applications such as assessing methylation status at one or more CpG sites, variant calling or quality control. The sequencer 820 may provide the sequence reads in a BAM file format to the analytics system 800. The analytics system 800 can be communicatively coupled to the sequencer 820 through a wireless, wired, or a combination of wireless and wired communication technologies. Generally, the analytics system 800 is configured with a processor and non-transitory computer-readable storage medium storing computer instructions that, when executed by the processor, cause the processor to process the sequence reads or to perform one or more steps of any of the methods or processes disclosed herein.

In some embodiments, the sequence reads may be aligned to a reference genome using known methods in the art to determine alignment position information, e.g., part of step 140 of the process 100 in FIG. 3A. Alignment position may generally describe a beginning position and an end position of a region in the reference genome that corresponds to a beginning nucleotide based and an end nucleotide base of a given sequence read. Corresponding to methylation sequencing, the alignment position information may be generalized to indicate a first CpG site and a last CpG site included in the sequence read according to the alignment to the reference genome. The alignment position information may further indicate methylation statuses and locations of all CpG sites in a given sequence read. A region in the reference genome may be associated with a gene or a segment of a gene; as such, the analytics system 800 may label a sequence read with one or more genes that align to the sequence read. In one embodiment, fragment length (or size) is determined from the beginning and end positions.

In various embodiments, for example when a paired-end sequencing process is used, a sequence read is comprised of a read pair denoted as R_1 and R_2. For example, the first read R_1 may be sequenced from a first end of a double-stranded DNA (dsDNA) molecule whereas the second read R_2 may be sequenced from the second end of the double-stranded DNA (dsDNA). Therefore, nucleotide base pairs of the first read R_1 and second read R_2 may be aligned consistently (e.g., in opposite orientations) with nucleotide bases of the reference genome. Alignment position information derived from the read pair R_1 and R_2 may include a beginning position in the reference genome that corresponds to an end of a first read (e.g., R_1) and an end position in the reference genome that corresponds to an end of a second read (e.g., R_2). In other words, the beginning position and end position in the reference genome represent the likely location within the reference genome to which the nucleic acid fragment corresponds. In one embodiment, the read pair $R_1$ and $R_2$ can be assembled into a fragment, and the fragment used for subsequent analysis and/or classification. An output file having SAM (sequence alignment map) format or BAM (binary) format may be generated and output for further analysis.

Referring now to FIG. 8B, FIG. 8B is a block diagram of an analytics system 800 for processing DNA samples according to one embodiment. The analytics system implements one or more computing devices for use in analyzing DNA samples. The analytics system 800 includes a sequence processor 840, sequence database 845, model database 855, models 850, parameter database 865, and score engine 860. In some embodiments, the analytics system 800 performs one or more steps in the processes 100 of FIG. 3A, 340 of FIG. 3B, 400 of FIG. 4, 500 of FIG. 5, 600 of FIG. 6A, or 680 of FIG. 6B and other process described herein.

The sequence processor 840 generates methylation state vectors for fragments from a sample. At each CpG site on a fragment, the sequence processor 840 generates a methylation state vector for each fragment specifying a location of the fragment in the reference genome, a number of CpG sites in the fragment, and the methylation state of each CpG site in the fragment whether methylated, unmethylated, or indeterminate via the process 100 of FIG. 3A. The sequence processor 840 may store methylation state vectors for fragments in the sequence database 845. Data in the sequence database 845 may be organized such that the methylation state vectors from a sample are associated to one another.

Further, multiple different models 850 may be stored in the model database 855 or retrieved for use with test samples. In one example, a model is a trained cancer classifier for determining a cancer prediction for a test sample using a feature vector derived from anomalous fragments. The training and use of the cancer classifier is discussed elsewhere herein. The analytics system 800 may train the one or more models 850 and store various trained parameters in the parameter database 865. The analytics system 800 stores the models 850 along with functions in the model database 855.

During inference, the score engine 860 uses the one or more models 850 to return outputs. The score engine 860 accesses the models 850 in the model database 855 along with trained parameters from the parameter database 865. According to each model, the score engine receives an appropriate input for the model and calculates an output based on the received input, the parameters, and a function of each model relating the input and the output. In some use cases, the score engine 860 further calculates metrics correlating to a confidence in the calculated outputs from the model. In other use cases, the score engine 860 calculates other intermediary values for use in the model.

Application

In some embodiments, the methods, analytic systems and/or classifier of the present invention can be used to detect the presence (or absence) of cancer, monitor cancer progression or recurrence, monitor therapeutic response or effectiveness, determine a presence or monitor minimum residual disease (MRD), or any combination thereof. In some embodiments, the analytic systems and/or classifier may be used to identify the tissue or origin for a cancer. For instance, the systems and/or classifiers may be used to identify a cancer as of any of the following cancer types: head and neck cancer, liver/bileduct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. For example, as described herein, a classifier can be used to generate a likelihood or probability score (e.g., from 0 to 100) that a sample feature vector is from a subject with cancer. In some embodiments, the probability score is compared to a threshold probability to determine whether or not the subject has cancer. In other embodiments, the likelihood or probability score can be assessed at different time points (e.g., before or after treatment) to monitor disease progression or to monitor treatment effectiveness (e.g., therapeutic efficacy). In still other embodiments, the likelihood or probability score can be used to make or influence a clinical decision (e.g., diagnosis of cancer, treatment selection, assessment of treatment effectiveness, etc.). For example, in one embodiment, if the likelihood or probability score exceeds a threshold, a physician can prescribe an appropriate treatment.

Early Detection of Cancer

In some embodiments, the methods and/or classifier of the present invention are used to detect the presence or absence of cancer in a subject suspected of having cancer. For example, a classifier (as described herein) can be used to determine a likelihood or probability score that a sample feature vector is from a subject that has cancer.

In one embodiment, a probability score of greater than or equal to 60 can indicated that the subject has cancer. In still other embodiments, a probability score greater than or equal to 65, greater than or equal to 70, greater than or equal to 75, greater than or equal to 80, greater than or equal to 85, greater than or equal to 90, or greater than or equal to 95, indicated that the subject has cancer. In other embodiments, a probability score can indicate the severity of disease. For example, a probability score of 80 may indicate a more severe form, or later stage, of cancer compared to a score below 80 (e.g., a score of 70). Similarly, an increase in the probability score over time (e.g., at a second, later time point) can indicate disease progression or a decrease in the probability score over time (e.g., at a second, later time point) can indicate successful treatment.

In another embodiment, a cancer log-odds ratio can be calculated for a test subject by taking the log of a ratio of a probability of being cancerous over a probability of being non-cancerous (i.e., one minus the probability of being cancerous), as described herein. In accordance with this embodiment, a cancer log-odds ratio greater than 1 can indicate that the subject has cancer. In still other embodiments, a cancer log-odds ratio greater than 1.2, greater than 1.3, greater than 1.4, greater than 1.5, greater than 1.7, greater than 2, greater than 2.5, greater than 3, greater than 3.5, or greater than 4, indicated that the subject has cancer. In other embodiments, a cancer log-odds ratio can indicate the severity of disease. For example, a cancer log-odds ratio greater than 2 may indicate a more severe form, or later stage, of cancer compared to a score below 2 (e.g., a score of 1). Similarly, an increase in the cancer log-odds ratio over time (e.g., at a second, later time point) can indicate disease progression or a decrease in the cancer log-odds ratio over time (e.g., at a second, later time point) can indicate successful treatment.

According to aspects of the invention, the methods and systems of the present invention can be trained to detect or classify multiple cancer indications. For example, the methods, systems and classifiers of the present invention can be used to detect the presence of one or more, two or more, three or more, five or more, or ten or more different types of cancer.

In some embodiments, the cancer is one or more of head and neck cancer, liver/bile duct cancer, upper GI cancer, pancreatic/gallbladder cancer; colorectal cancer, ovarian cancer, lung cancer, multiple myeloma, lymphoid neoplasms, melanoma, sarcoma, breast cancer, and uterine cancer. In some embodiments, the cancer is one or more of anorectal cancer, bladder or urothelial cancer, or cervical cancer.

Cancer and Treatment Monitoring

In some embodiments, the likelihood or probability score can be assessed at different time points (e.g., or before or after treatment) to monitor disease progression or to monitor treatment effectiveness (e.g., therapeutic efficacy). For example, the present disclosure provides methods that involve obtaining a first sample (e.g., a first plasma cfDNA sample) from a cancer patient at a first time point, determining a first likelihood or probability score therefrom (as described herein), obtaining a second test sample (e.g., a second plasma cfDNA sample) from the cancer patient at a second time point, and determine a second likelihood or probability score therefrom (as described herein).

In certain embodiments, the first time point is before a cancer treatment (e.g., before a resection surgery or a therapeutic intervention), and the second time point is after a cancer treatment (e.g., after a resection surgery or therapeutic intervention), and the method utilized to monitor the effectiveness of the treatment. For example, if the second likelihood or probability score decreases compared to the first likelihood or probability score, then the treatment is considered to have been successful. However, if the second likelihood or probability score increases compared to the first likelihood or probability score, then the treatment is considered to have not been successful. In other embodiments, both the first and second time points are before a cancer treatment (e.g., before a resection surgery or a therapeutic intervention). In still other embodiments, both the first and the second time points are after a cancer treatment (e.g., before a resection surgery or a therapeutic intervention) and the method is used to monitor the effectiveness of the treatment or loss of effectiveness of the treatment. In still other embodiments, cfDNA samples may be obtained from a cancer patient at a first and second time point and analyzed. e.g., to monitor cancer progression, to determine if a cancer is in remission (e.g., after treatment), to monitor or detect residual disease or recurrence of disease, or to monitor treatment (e.g., therapeutic) efficacy.

Those of skill in the art will readily appreciate that test samples can be obtained from a cancer patient over any desired set of time points and analyzed in accordance with the methods of the invention to monitor a cancer state in the patient. In some embodiments, the first and second time points are separated by an amount of time that ranges from about 15 minutes up to about 30 years, such as about 30 minutes, such as about 1, 2, 3, 4, 5, 6, 7, 8, 9, 10, 11, 12, 13, 14, 15, 16, 17, 18, 19, 20, 21, 22, 23, or about 24 hours, such as about 1, 2, 3, 4, 5, 10, 15, 20, 25 or about 30 days, or such as about 1, 2, 3, 4, 5, 6, 7, 8, 9, 10, 11, or 12 months, or such as about 1, 1.5, 2, 2.5, 3, 3.5, 4, 4.5, 5, 5.5, 6, 6.5, 7, 7.5, 8, 8.5, 9, 9.5, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5 or about 30 years. In other embodiments, test samples can be obtained from the patient at least once every 3 months, at least once every 6 months, at least once a year, at least once every 2 years, at least once every 3 years, at least once every 4 years, or at least once every 5 years.

Treatment

In still another embodiment, information obtained from any method described herein (e.g., the likelihood or probability score) can be used to make or influence a clinical decision (e.g., diagnosis of cancer, treatment selection, assessment of treatment effectiveness, etc.). For example, in one embodiment, if the likelihood or probability score exceeds a threshold, a physician can prescribe an appropriate treatment (e.g., a resection surgery, radiation therapy, chemotherapy, and/or immunotherapy). In some embodiments, information such as a likelihood or probability score can be provided as a readout to a physician or subject.

A classifier (as described herein) can be used to determine a likelihood or probability score that a sample feature vector is from a subject that has cancer. In one embodiment, an appropriate treatment (e.g., resection surgery or therapeutic) is prescribed when the likelihood or probability exceeds a threshold. For example, in one embodiment, if the likelihood or probability score is greater than or equal to 60, one or more appropriate treatments are prescribed. In another embodiments, if the likelihood or probability score is greater than or equal to 65, greater than or equal to 70, greater than or equal to 75, greater than or equal to 80, greater than or equal to 85, greater than or equal to 90, or greater than or equal to 95, one or more appropriate treatments are prescribed. In other embodiments, a cancer log-odds ratio can indicate the effectiveness of a cancer treatment. For example, an increase in the cancer log-odds ratio over time (e.g., at a second, after treatment) can indicate that the treatment was not effective. Similarly, a decrease in the cancer log-odds ratio over time (e.g., at a second, after treatment) can indicate successful treatment. In another embodiment, if the cancer log-odds ratio is greater than 1, greater than 1.5, greater than 2, greater than 2.5, greater than 3, greater than 3.5, or greater than 4, one or more appropriate treatments are prescribed.

In some embodiments, the treatment is one or more cancer therapeutic agents selected from the group consisting of a chemotherapy agent, a targeted cancer therapy agent, a differentiating therapy agent, a hormone therapy agent, and an immunotherapy agent. For example, the treatment can be one or more chemotherapy agents selected from the group consisting of alkylating agents, antimetabolites, anthracyclines, anti-tumor antibiotics, cytoskeletal disruptors (taxans), topoisomerase inhibitors, mitotic inhibitors, corticosteroids, kinase inhibitors, nucleotide analogs, platinum-based agents and any combination thereof. In some embodiments, the treatment is one or more targeted cancer therapy agents selected from the group consisting of signal transduction inhibitors (e.g. tyrosine kinase and growth factor receptor inhibitors), histone deacetylase (HDAC) inhibitors, retinoic receptor agonists, proteosome inhibitors, angiogenesis inhibitors, and monoclonal antibody conjugates. In some embodiments, the treatment is one or more differentiating therapy agents including retinoids, such as tretinoin, alitretinoin and bexarotene. In some embodiments, the treatment is one or more hormone therapy agents selected from the group consisting of anti-estrogens, aromatase inhibitors, progestins, estrogens, anti-androgens, and GnRH agonists or analogs. In one embodiment, the treatment is one or more immunotherapy agents selected from the group comprising monoclonal antibody therapies such as rituximab (RITUXAN) and alemtuzumab (CAMPATH), non-specific immunotherapies and adjuvants, such as BCG, interleukin-2 (IL-2), and interferon-alfa, immunomodulating drugs, for instance, thalidomide and lenalidomide (REVLIMID). It is within the capabilities of a skilled physician or oncologist to select an appropriate cancer therapeutic agent based on characteristics such as the type of tumor, cancer stage, previous exposure to cancer treatment or therapeutic agent, and other characteristics of the cancer.

6.6. EXAMPLES

The following examples are put forth so as to provide those of ordinary skill in the art with a complete disclosure and description of how to make and use the present description, and are not intended to limit the scope of what the inventors regard as their description nor are they intended to represent that the experiments below are all or the only experiments performed. Efforts have been made to ensure accuracy with respect to numbers used (e.g., amounts, temperature, etc.) but some experimental errors and deviations should be accounted for.

6.6.1. Example 1: Sequencing cfDNA from Individuals with Cancer and Non-Cancer Controls The Circulating Cell-free Genome Atlas Study ("CCGA"; Clinical Trial.gov identifier NCT02889978) is a prospective, multi-center, case-control, observational study with longitudinal follow-up. De-identified biospecimens were collected from approximately 15,000 participants from 142 sites. Samples were selected to ensure a prespecified distribution of cancer types and non-cancers across sites in each cohort, and cancer and non-cancer samples were frequency age-matched by gender. The STRIVE study is a prospective, multi-center, observational cohort study designed to validate an assay for the early detection of breast cancer and other invasive cancers (See Clinical Trail.gov Identifier: NCT03085888 (clinicaltrials.gov/ct2/show/NCT03085888)). As described below, additional non-cancer samples were selected from the STRIVE study and used for classifier training.

In some embodiments, whole-genome bisulfite sequencing (WGBS; 30× depth) of cfDNA isolated from plasma from the CCGA study subjects was employed for analysis of cfDNA. In other embodiments, as indicated below, a targeted bisulfite sequencing procedure was used for analysis of sample. Under the targeted bisulfite sequencing procedure, a probe set was used to enrich cfDNA molecules derived from a plurality of target genomic regions. For both processes, cfDNA was extracted from two tubes of plasma (up to a combined volume of 10 ml) per patient using a modified QIAamp Circulating Nucleic Acid kit (Qiagen; Germantown, Md.). Up to 75 ng of plasma cfDNA was subjected to bisulfite conversion using the EZ-96 DNA Methylation Kit (Zymo Research, D5003). Converted cfDNA was used to prepare dual indexed sequencing libraries using Accel-NGS Methyl-Seq DNA library preparation kits (Swift BioSciences; Ann Arbor, Mich.). The constructed libraries were quantified using the KAPA Library Quantification Kit for Illumina Platforms (Kapa Biosystems; Wilmington, Mass.). Four libraries along with 10% PhiX v3 library (Illumina, FC-110-3001) were pooled and clustered on an Illumina NovaSeq 6000 S2 flow cell followed by 150-bp paired-end sequencing (30×).

6.6.2. Example 2: Modeling the Methylation Status of Healthy Individuals

A statistical model and a data structure of typical cfDNA fragments were produced using an independent reference set of 108 non-smoking participants without cancer (age: 58±14 years, 79 [73%] women) (i.e., a reference genome) from the CCGA study. These samples were used to train a Markov-chain model (order 3) estimating the likelihood of a given sequence of CpG methylation statuses within a fragment as further described above in Section 6.4.2.1—P-Value Score Calculation. This model was demonstrated to be calibrated within the normal fragment range (p-value>0.001) and was used to reject fragments with a p-value from the Markov model of >0.001 as insufficiently unusual.

6.6.3. Example 3: Selection of Target Genomic Regions

Target genomic regions were selected using a database generated by sequencing bisulfite converted cfDNA fragments obtained from 1548 individuals who had been diagnosed with cancer and 1163 individuals who had not been diagnosed with cancer from the CCGA study.

The process for selecting target genomic regions began by identifying anomalous cfDNA fragments from among the bisulfite converted cfDNA fragment sequences from each individual. The fragments were aligned to the hg19 reference genome, and each CpG site within each fragment was scored as methylated or unmethylated, or indeterminate. Anomalous cfDNA fragments have three characteristics: (1) a bisulfite converted methylation pattern with a p-value of <0.001 according to the Markov-chain model, indicating that the methylation pattern would not be expected to occur in individuals without cancer; (2) five or more CpG sites; and (3) a hypermethylated or hypomethylated state wherein at least 80%, 90%, or 100% of the CpG sites are either methylated or unmethylated, respectively. Indeterminant sites were included in the total number of CpG sites when calculating the percentage of methylated or unmethylated CpG sites.

The second step in target selection was to determine a ranking score for each of the approximately 30 million CpG sites in the GRCh37/hg19 reference genome. For each CpG site, a count was made of cancer and non-cancer samples having at least one anomalous cfDNA fragment overlapping the CpG site. Hypermethylated anomalous fragments and hypermethylated anomalous fragments were counted separately. These counts were used to separately calculate scores for hypermethylated and hypomethylated fragments according to the following formula: $(n_{cancer}+1)/(n_{cancer} \, n_{non-cancer}+2)$. Three pairs of scores were calculated for each CpG: a first pair for anomalous fragments having an 80% or more hypermethylation or hypomethylation state; a second pair for anomalous fragments having a 90% or more hypermethylation or hypomethylation state; and a third pair for anomalous fragments having a 100% hypermethylation or hypomethylation state. The highest of these six scores became the ranking score for the CpG site.

The third step in target selection was to define targeted regions within the genome. The first region added to the target list was a 30-base region extending 15 bases on either side of the center of the highest ranking CpG site. The list of target regions was then expanded in an iterative process. A 30-base region extending 15 bases on either side of the center of the next highest ranking CpG site was identified. If the new region was within 200 bases of an existing target site, the new region was merged with the existing one to form a larger region including the all bases between the new 30-base region and the old one. If the new region was not within 200 bases of an existing target site, it was simply added to the list of target regions. The list of target regions was iteratively expanded until it reached the desired panel size of 0.59 MB for Assay Panel 1, 1.19 MB for Assay Panel 2, 2.38 MB for Assay Panel 3, 4.96 MB for Assay Panel 4, and 8.53 MB for Assay Panel 5.

6.6.4. Example 4: Probe Design

Biotinylated probes were designed for the purpose of collecting bisulfite-converted anomalous cfDNA fragments that are derived from the genomic regions identified above. Each probe was 120 bases long and had a biotin moiety at its 5' end. Generally, probe sets were designed to include probes that target fragments from each of the CpG sites included within the start/stop ranges of any of the targeted regions included in any one of Lists 1-8.

To increase the probability of capturing anomalous cfDNA fragments derived from a target region (or a portion of a target region), including anomalous cfDNA fragments with partial target sequences at their 5' or 3' ends, probes were arranged in a tiled fashion so that two probes aligned to each base within a target region. Adjacent 120-base probes were designed to overlap by 60 bases. Target regions of 60 or fewer bases were initially targeted by three probes as illustrated in FIG. 1A. Additional probes were used for target regions of larger size (see e.g., FIG. 1B). For both size classes of target regions, the probes used to interrogate each region collectively extend beyond the target region (e.g., to include at least 60 bases of non-targeted sequence on either side of the target region due to the tiled arrangement; see FIG. 1A). Additionally, probes were designed to enrich DNA molecules derived from both strands of DNA from each target region, such that a single base pair of a target genomic region may be targeted by four probes: two for each strand.

Probe sequences were designed to be complementary to bisulfite-converted anomalous cfDNA fragments from each of the genomic regions, where every CpG site in a cfDNA fragment is either methylated or unmethylated. Thus, if the anomalous cfDNA fragments aligning with a target sequence are hypomethylated, all, or most of the CpG sites within the fragment would be expected to be converted to UpG sequences, and the corresponding probes would have CpA sequences for all, or most of the CpGs in the target. Conversely, if the anomalous cfDNA sequences aligning with a target sequence are hypermethylated, all, or most of the CpG sites within the fragment would be expected to be protected from conversion to UpG sequences, and the corresponding probes would have CpG sequences for all, or most of the CpGs in the target. Cytosines not located within a CpG site are generally not methylated. These bystander cytosines are therefore converted to uracil regardless of the methylation status of adjacent CpG sites. Probes matching a target site were designed to pull down hypomethylated cfDNA fragments or hypermethylated cfDNA fragments, but generally not both. This "semibinary" design contrasts with a "binary" design where cfDNA fragments from the same target region are targeted with two sets of probes, one designed to pull down hypomethylated cfDNA and the other designed to pull down hypermethylated cfDNA at the same region.

6.6.5. Example 5: Probe Quality Control

Poor quality probes likely to pull down a significant number off-target cfDNA fragments were excluded from the cancer assay panels.

To determine the characteristics of a poor-quality probe, an experiment was conducted to test how much overlap between a cfDNA fragment and a probe is required to achieve a non-negligible amount of pulldown.

Purified, bisulfate converted cfDNA was mixed with biotinylated probes in Hybridization Capture Buffer (Argonaut Technologies, Redwood City, Calif., Cat #310450) supplemented with 1 mM Tris, pH 8.0 in a 96-well plate, and processed in a Hamilton Star Liquid Handler (Hamilton, Reno, Nev., Cat # STAR AL 8/96 iSWAP) and a 96-well BioRad C1000 Touch Thermocycler (BiRad, Hercules, Calif., Cat #1851196). The temperature of the hybridization mix was raised to 95° C. for 10 minutes, and then gradually decreased by 2° C./min to 62° C., with 1-minute pauses at 93° C. and 91° C. Hybridization continued for 15.5-17.5 hours at 62° C. A second aliquot of probes was added, and the thermal cycling program was repeated. Captured cfDNA was captured on Streptavidin Magnetic Beads (Illumina, San Diego, Calif., Cat #20014367), amplified by PCR, and then sequenced.

Various overlap lengths were tested using preliminary assay panels (V1D3, V1D4, V1E2) designed to include probes having various overlaps ranging from 0 to 120 bases. Samples comprising 175 bp target DNA fragments were applied to the panel and washed, and then DNA fragments bound to the probes were collected. The amounts of the collected DNA fragments were measured, and then plotted as densities over the sizes of overlaps as provided in FIG. 10.

There was no significant binding and pull down of target DNA fragments when the overlap was less than 45 bp. These results indicate that, with the specified hybridization conditions, a fragment-probe overlap of at least 45 bp is generally required to maximize hybridization between the probe set and nucleic acids derived from the target genomic regions, and thus improve pulldown efficiency.

Furthermore, binding, and thus pulldown efficiency, is greatly disrupted when the percentage of mismatches between the probe and fragment sequences in the region of overlap is greater than 10%. It was therefore concluded that off-target pulldown may occur for probes having a sequence with a match rate of at least 90% to an off-target genomic region of at least 45 bp.

For each probe, we performed an exhaustive, bisulfate aware search of the entire reference genome for off-target regions having 45 bp alignments with a 90%+ match rate. Specifically, we combined a k-mer seeding strategy (which can allow one or more mismatches) with local alignment at the seed locations. This guaranteed against missing any good alignments based on k-mer length, number of mismatches allowed, and number of k-mer seed hits at a particular location. The search involved performing dynamic programming local alignment at a large number of locations, so the implementation was optimized to use vector CPU instructions (e.g., AVX2, AVX512) and parallelized across many cores within a machine and also across many machines connected by a network. This implementation allows for an exhaustive search, which is valuable in designing a high-performance panel (i.e., low off-target rate and high target coverage for a given amount of sequencing).

Following the exhaustive search, each probe was scored based on its number of off-target regions. The best probes (high) have a score of 1, meaning they match only one genomic region—the target. Probes with an intermediate score of between 2-19 hits (intermediate) were accepted but probes with a poor score of 20 or more hits (poor) were discarded. Table 1 presents a summary of the probes in Assay Panels 3-5, including the numbers and percentages of probes retained after eliminating low quality probes with potential off-target effects. The probe region is larger than the target region because some probes extend beyond the ends of target regions.

TABLE 1

Probe numbers and target region sizes before and after probe quality control

|  | Original probes | Final probes | Final probe target (MB) | Final target region (Mb) | Fraction of original target |
|---|---|---|---|---|---|
| Assay Panel 3 | 127,734 | 102,013 | 3.798 | 2.12 | 88.1% |
| Assay Panel 4 | 256,988 | 189,155 | 7.013 | 4.15 | 83.5% |
| Assay Panel 5 | 449,088 | 303,262 | 11.35 | 6.71 | 78.5% |

Additionally, numbers of high quality, intermediate quality, and poor-quality probes were counted among probes targeting hypermethylated genomic regions or hypomethylated genomic regions. As shown in FIG. 11, probes targeting hypermethylated genomic regions tend to have significantly less off-target matches.

6.6.6. Example 4: Characterization of Target Genomic Regions

Lists 1 to 8 (see Table 2 below) present Assay Panels of various sizes representing the portion of targeted genomic regions for which probes were designed to enrich DNA molecules derived from these targeted genomic regions. Assay Panels 1-5 are arranged from small to large according to the size budget used to select their target genomic regions. These Assay Panels were filtered to exclude certain CpG sites and genomic regions. Assay Panel 6, which defines a larger genomic region than any of Assay Panels 1-5, includes all of the CpG sites and genomic regions that were filtered out to produce each of Assay Panels 1-5. Assay Panels 3A and 4A present subsets of the target genomic regions in Assay Panels 3 and 4, respectively, excluding genomic regions that are also described in PCT/US2019/025358.

TABLE 2

Correspondence between Assay Panels, Lists, and SEQ ID NOs

| Name | List | SEQ ID NO range |
|---|---|---|
| Assay Panel 1 | List 1 | 1-1644 |
| Assay Panel 2 | List 2 | 1645-5270 |
| Assay Panel 3 | List 3 | 5271-16837 |
| Assay Panel 3A | List 4 | 16838-25984 |
| Assay Panel 4 | List 5 | 25985-46929 |
| Assay Panel 4A | List 6 | 46930-67335 |
| Assay Panel 5 | List 7 | 67336-101617 |
| Assay Panel 6 | List 8 | 101618-131822 |

The sequence listing includes the following information: (1) SEQ ID NO, (2) a sequence identifier that identifies (a) a chromosome or contig on which the CpG site is located and (b) a start and stop position of the region, (3) the sequence corresponding to (2) and (4) whether the region was included based on its hypermethylation or hypomethylation score. The chromosome numbers and the start and stop positions are provided relative to a known human reference genome, GRCh37/hg19. The sequence of GRCh37/hg19 is available from the National Center for Biotechnology Information (NCBI), the Genome Reference Consortium, and the Genome Browser provided by Santa Cruz Genomics Institute.

Generally, a probe can be designed to target any of the CpG sites included within the start/stop ranges of any of the targeted regions included in Lists 1-8. Alternatively stated, in some embodiments, probes can be designed to hybridize to any CpG site in fragments derived from any of the targeted regions, such as converted fragments from the target region.

The Assay Panels were analyzed to understand their features. The sizes of target genomic regions of the Assay Panels, prior to filtering out off-target probes, are shown in Table 10. The number of CpG sites per target genomic region, for each of various assay panels (prior to filtering out off-target probes), is plotted in FIG. 12A as a function of density. The per probe G/C content of various assay panels is presented in FIG. 12.B.

TABLE 10

Target genomic region sizes

| Region size | Assay Panel 1 | Assay Panel 2 | Assay Panel 3 | Assay Panel 4 | Assay Panel 6 |
|---|---|---|---|---|---|
| Smallest | 15 | 15 | 15 | 15 | 15 |
| Median | — | — | 95 | 94 | 82 |
| Mean | — | — | 207 | 229 | 220 |
| Largest | 2593 | 3374 | 3374 | 4368 | 6820 |

Target genomic regions within the Assay Panels were next aligned to a reference genome to evaluate their locations. Target genomic regions were positioned in introns, exons, intergenic regions, 5'UTRs, 3'UTRs, or controlling regions such as promoters or enhancers. The number of target genomic regions that fall within each genomic annotation for Assay Panels 3-5 were counted and plotted in the graphs provided in FIG. 13. FIG. 13 also compares numbers of the selected target genomic regions (black bars) with numbers of randomly selected genomic regions (gray bars) that fall within each genomic annotation.

The analysis shows that the selected target genomic regions are not random in their genomic distributions. Functional elements such as promoters, 5'UTRs, exons, and intron/exon boundaries were more highly represented in the assay panels compared to randomly selected regions, while intergenic regions were underrepresented.

6.6.7. Example 7: Generation of a Mixture Model Classifier

To maximize performance, the predictive cancer models described in this Example were trained using sequence data obtained from a plurality of samples from known cancer types and non-cancers from both CCGA sub-studies (CCGA1 and CCGA22), a plurality of tissue samples for known cancers obtained from CCGA1, and a plurality of non-cancer samples from the STRIVE study (See Clinical Trail.gov Identifier: NCT03085888 (//clinicaltrials.gov/ct2/show/NCT03085888)). The STRIVE study is a prospective, multi-center, observational cohort study to validate an assay for the early detection of breast cancer and other invasive cancers, from which additional non-cancer training samples were obtained to train the classifier described herein. The known cancer types included from the CCGA sample set included the following: breast, lung, prostate, colorectal, renal, uterine, pancreas, esophageal, lymphoma, head and neck, ovarian, hepatobiliary, melanoma, cervical, multiple myeloma, leukemia, thyroid, bladder, gastric, and anorectal. As such, a model can be a multi-cancer model (or a multi-cancer classifier) for detecting one or more, two or more, three or more, four or more, five or more, ten or more, or 20 or more different types of cancer.

Classifier performance data shown below for Assay Panels 1-6, was reported out for a locked classifier trained on cancer and non-cancer samples obtained from the CCGA sub-study (CCGA2) and the STRIVE study. The individuals in the CCGA2 sub-study were different from the individuals in the CCGA1 sub-study whose cfDNA was used to select target genomes. From the CCGA2 study, blood samples were collected from individuals diagnosed with untreated cancer (including 20 tumor types and all stages of cancer) and healthy individuals with no cancer diagnosis (controls). For STRIVE, blood samples were collected from women within 28 days of their screening mammogram. Cell-free DNA (cfDNA) was extracted from each sample and treated with bisulfite to convert unmethylated cytosines to uracils. The bisulfite treated cfDNA was enriched for informative cfDNA molecules using hybridization probes designed to enrich bisulfite-converted nucleic acids derived from each of a plurality of targeted genomic regions in an assay panel comprising all of the genomic regions of Assay Panels 1-6. The enriched bisulfite-converted nucleic acid molecules were sequenced using paired-end sequencing on an Illumina platform (San Diego, Calif.) to obtain a set of sequence reads for each of the training samples, and the resulting read pairs were aligned to the reference genome, assembled into fragments, and methylated and unmethylated CpG sites identified.

Classifier performance was evaluated for Assay Panels 1-6, and reported in this Example and in FIGS. 14-27, over a set of training samples that included 3,053 samples (1,532 cancer samples and 1,521 non-cancer samples). All sample types used for evaluating classifier performance are shown below in Table 3.

TABLE 3

Cancer diagnoses of individuals whose cfDNA was used to train the classifier

| | | Stage | | | | |
|---|---|---|---|---|---|---|
| Cancer Type | Total | I | II | III | IV | Not Reported |
| Non-cancer | 1521 | — | — | — | — | — |
| Lung | 261 | 60 | 23 | 72 | 106 | 0 |
| Breast | 247 | 102 | 110 | 27 | 8 | 0 |
| Prostate | 188 | 39 | 113 | 19 | 17 | 0 |
| Lymphoid neoplasm | 147 | 15 | 27 | 27 | 39 | 39 |
| Colorectal | 121 | 13 | 22 | 41 | 45 | 0 |
| Pancreas and gallbladder | 95 | 15 | 15 | 19 | 46 | 0 |
| Uterine | 84 | 73 | 3 | 5 | 3 | 0 |
| Upper GI | 67 | 9 | 12 | 19 | 27 | 0 |
| Head and neck | 62 | 7 | 13 | 16 | 26 | 0 |
| Renal | 56 | 37 | 4 | 4 | 11 | 0 |
| Ovary | 37 | 4 | 2 | 25 | 6 | 0 |
| Multiple myeloma | 34 | 10 | 13 | 11 | 0 | 0 |
| Not reported | 29 | 8 | 5 | 7 | 6 | 3 |
| Liver bile duct | 29 | 5 | 7 | 7 | 10 | 0 |
| Sarcoma | 17 | 2 | 4 | 5 | 6 | 0 |
| Bladder and urothelial | 16 | 6 | 7 | 3 | 1 | 0 |
| Anorectal | 14 | 4 | 5 | 5 | 0 | 0 |
| Cervical | 11 | 8 | 1 | 2 | 0 | 0 |
| Melanoma | 7 | 3 | 1 | 0 | 3 | 0 |
| Myeloid neoplasm | 4 | 2 | 1 | 0 | 1 | 0 |
| Thyroid | 4 | 0 | 0 | 0 | 0 | 4 |
| Prediction only | 2 | 0 | 0 | 0 | 2 | 0 |

Mixture Model Based Featurization

For each cancer type (including non-cancer) a probabilistic mixture model was trained and utilized to assign a probability to each fragment from each cancer and noncancer sample based on how likely it was that the fragment would be observed in a given sample type.

Briefly, for each sample type (cancer and non-cancer samples), for each region (where each region was 1 kb in length with a 50% overlap between adjacent regions), a probabilistic model was fit to the fragments derived from the training samples for each type or cancer and non-cancer. The probabilistic model trained for each sample type was a mixture model, where each of three mixture components was an independent-sites model in which methylation at each CpG is assumed to be independent of methylation at other CpGs. Fragments were excluded from the model if: they had a p-value greater than 0.01, were marked as duplicate fragments, the fragments had a bag size of greater than 1; they did not cover at least one CpG site; or if the fragment was greater than 1000 bases in length.

Each probabilistic model was fit using maximum-likelihood estimation to identify a set of parameters that maximized the log-likelihood of all fragments deriving from each sample type, subject to a regularization penalty.

Featurization

Features were extracted for each fragment from each training sample, for each cancer type and non-cancer sample, in each region. The extracted features were the tallies of outlier fragments (i.e., anomalously methylated fragments), which were defined as those whose log-likelihood under a first cancer model exceeded the log-likelihood under a second cancer model or non-cancer model by at least a threshold tier value. Outlier fragments were tallied separately for each genomic region, sample model (i.e., cancer type), and tier (for tiers 1, 2, 3, 4, 5, 6, 7, 8, and 9), yielding 9 features per region for each sample type.

Feature Ranking and Classifier Training

For each set of pairwise features, the features were ranked using mutual information based on their ability to distinguish the first cancer type (which defined the log-likelihood model from which the feature was derived) from the second cancer type or non-cancer. The top ranked 256 features from each pairwise comparison were identified and added to the final feature set for each cancer type and non-cancer. The features in the final feature set for each sample (cancer type and non-cancer) were binarized (any feature value greater than 0 was set to 1, so that all features were either 0 or 1). The training samples were then divided into distinct 5-fold cross-validation training sets and used to train a logistic regression classifier (for detecting the presence of cancer) and a multiclass logistic regression classifier (for determining cancer tissue of origin). During the classifier training process, the cross-validated scores assigned to the training set were collected.

Once the binary cancer/non-cancer classifier was trained, a probability score was determined from the classifier for each of the training samples. Training samples with a probability score that exceeded a threshold were called as positive for cancer. This threshold was prespecified to target a desired specificity level, based on the distribution of cross-validated scores assigned to the training set. For example, if the desired specificity level was 99.4%, the threshold would be set to the 99.4th percentile of the cross-validated cancer detection probability scores assigned to the non-cancer samples in the training set. A tissue of origin or cancer type assessment was subsequently made for each training sample determined to be positive for cancer from the multiclass classifier. First, the multiclass logistic regression classifier assigned a set of probability scores, one for each prospective cancer type, to each sample. Next, the confidence of these scores was assessed as the difference between the highest and second-highest scores. A threshold was prespecified as the minimum value such that, of the cancer samples in the training set with a top-two score differential exceeding the threshold, 90% had been assigned the correct TOO label as their highest score. For prediction on new samples, samples with a top-two score differential lower than this threshold received an assignment of "indeterminate cancer"; those whose score differential exceeded the threshold were assigned the cancer label to which the multiclass classifier assigned the highest score.

6.6.8. Example 8: Classifier Performance

As a proxy for testing different probe sets (bait sets), classifier performance was determined for each of Assay Panels 1-6 by constraining the data set and only considering the methylation status of CpG sites within fragments that would be enriched for by the specified Assay Panels.

The results of the classifier performance analysis are provided in Tables 11 to 18. For each set of genomic regions (i.e., Assay Panels 1-6), the Detection column of the tables indicates the performance of the classifier over the indicated Assay Panels. Here, Detection is the sensitivity for all cancer types included in the CCGA2 study stratified by cancer stage at 99% specificity. The Tissue of Origin column indicates the accuracy of a tissue of origin classification at 99% specificity only for individuals diagnosed with cancer and when sufficient methylation data was available to assign a tissue of origin. Values indicate mean accuracy, with a 95% confidence interval in brackets and the number correctly assigned divided by the total in the category in parenthesis.

TABLE 11

Classification accuracy using the genomic regions of Assay Panel 1

| Stage | Detection* | Tissue of Origin* |
|---|---|---|
| I | 16.1% [12.7-20] (68/422) | 76.9% [63.2-87.5] (40/52) |
| II | 40.5% [35.5-45.5] (157/388) | 89.6% [83.1-94.2] (120/134) |
| III | 75.7% [70.6-80.4] (237/313) | 90.2% [85.5-93.9] (194/215) |
| IV | 89.3% [85.6-92.2] (324/363) | 91.9% [88.3-94.8] (274/298) |
| All | 52.2% [49.6-54.7] (799/1532) | 89.9% [87.4-92] (640/712) |

TABLE 12

Classification accuracy using the genomic regions of Assay Panel 2

| Stage | Detection* | Tissue of Origin* |
|---|---|---|
| I | 19.2% [15.5-23.3] (81/422) | 68.9% [55.7-80.1] (42/61) |
| II | 43.3% [38.3-48.4] (168/388) | 86.4% [79.8-91.5] (127/147) |
| III | 78% [72.9-82.4] (244/313) | 91.4% [87-94.8] (203/222) |
| IV | 90.1% [86.5-93] (327/363) | 94.3% [91-96.6] (280/297) |
| All | 54.6% [52-57.1] (836/1532) | 89.8% [87.3-91.8] (666/742) |

TABLE 13

Classification accuracy using the genomic regions of Assay Panel 3

| Stage | Detection* | Tissue of Origin* |
|---|---|---|
| I | 19.2% [15.5-23.3] (81/422) | 76.3% [63.4-86.4] (45/59) |
| II | 43.6% [38.6-48.7] (169/388) | 86.3% [79.8-91.3] (132/153) |
| III | 79.9% [75-84.2] (250/313) | 91% [86.6-94.4] (213/234) |
| IV | 90.6% [87.2-93.4] (329/363) | 92.6% [89.1-95.3] (289/312) |
| All | 55.4% [52.9-57.9] (849/1532) | 89.7% [87.3-91.8] (697/777) |

TABLE 14

Classification accuracy using the genomic regions of Assay Panel 4

| Stage | Detection* | Tissue of Origin* |
|---|---|---|
| I | 22% [18.2-26.3] (93/422) | 71.6% [59.3-82] (48/67) |
| II | 44.3% [39.3-49.4] (172/388) | 86.2% [79.7-91.2] (131/152) |
| III | 81.2% [76.4-85.3] (254/313) | 91.7% [87.3-94.9] (209/228) |
| IV | 90.4% [86.8-93.2] (328/363) | 93.4% [90-95.9] (284/304) |
| All | 56.8% [54.3-59.3] (870/1532) | 89.6% [87.3-91.7] (691/771) |

TABLE 15

Classification accuracy using the genomic regions of Assay Panel 5

| Stage | Detection* | Tissue of Origin* |
|---|---|---|
| I | 21.8% [18-26] (92/422) | 75.4% [63.5-84.9] (52/69) |
| II | 43.3% [38.3-48.4] (168/388) | 89.1% [83.1-93.5] (139/156) |
| III | 82.4% [77.8-86.5] (258/313) | 92.2% [88-95.3] (214/232) |
| IV | 90.4% [86.8-93.2] (328/363) | 91.7% [88-94.5] (286/312) |
| All | 56.7% [54.2-59.2] (869/1532) | 89.6% [87.3-91.7] (709/791) |

TABLE 16

Classification accuracy using the genomic regions of Assay Panel 6

| Stage | Detection* | Tissue of Origin* |
|---|---|---|
| I | 22% [18.2-26.3] (93/422) | 75.3% [63.9-84.7] (55/73) |
| II | 45.6% [40.6-50.7] (177/388) | 87.3% [81.3-92] (145/166) |
| III | 81.8% [77.1-85.9] (256/313) | 91.7% [87.5-94.9] (222/242) |
| IV | 90.1% [86.5-93] (327/363) | 92.1% [88.6-94.8] (292/317) |
| All | 57.1% [54.6-59.6] (875/1532) | 89.5% 87.2-91.5) (733/819) |

TABLE 17

Classification accuracy using the genomic regions of Assay Panel 3A

| Stage | Detection* | Tissue of Origin* |
|---|---|---|
| I | 16.1% [12.7-20] (68/422) | 71.7% [57.7-83.2] (38/53) |
| II | 40.2% [35.3-45.3] (156/388) | 87% [80.4-92] (127/146) |
| III | 74.8% [69.6-79.5] (234/31 3) | 92% [87.5-95.3] (195/212) |
| IV | 88.2% [84.4-91.3] (320/363) | 91.8% [88.1-94.7] (269/293) |
| All | 52.2% [49.6-54.7] (799/1532) | 89.3% [86.9-91.5] (645/722) |

TABLE 18

Classification accuracy using the genomic regions of Assay Panel 4A

| Stage | Detection* | Tissue of Origin* |
|---|---|---|
| I | 17.3% [13.8-21.3] (73/422) | 74.1% [60.3-85] (40/54) |
| II | 40.7% [35.8-45.8] (158/388) | 88.5% [82.2-93.2] (131/148) |
| III | 79.2% [74.3-83.6] (248/313) | 89.7% [85-93.3] (208/232) |
| IV | 89% [85.3-92] (323/363) | 92.3% [88.7-95] (286/310) |
| All | 53.7% [51.1-56.2] (822/1532) | 89.4% [87-91.5] (682/763) |

These results show that the accuracy of detection and tissue of origin determination is higher for later stage cancers than early stage cancers. Additionally, larger panels apparently provide more accurate cancer detection for stage I and stage II cancers.

Part A of FIGS. 14-21 presents receiver operator curves (ROC curves) for Assay Panels 1-6 and 3A and 4A from the binary logistic regression classifier using mixture model based featurization described above. The ROC curve results were similar for all Assay Panels, showing an area under the curves (AUC) falling within a narrow range of 0.80 to 0.83. Part B of FIGS. 14-21 presents confusion matrices showing tissue of origin (TOO) accuracy determined for the multi-class logistic regression classifier trained using mixture model-based features, as described above. As shown in FIGS. 14-21, TOO precision ranged from 89.9% to 91.1% across Assay Panels 1-6.

The classification performance for random subsets of the markers in Assay Panels 3-5, at 99% specificity, are presented in Tables 19-24.

TABLE 19

Classification accuracy using a randomly selected subset of 40% of the genomic regions of Assay Panel 3 (subset a)

| Stage | Detection* | Tissue of Origin* |
|---|---|---|
| I | 18.5% [14.9-22.5] (78/422) | 73.2% [59.7-84.2] (41/56) |
| II | 42% [37-47.1] (163/388) | 87.9% [81.3-92.8] (123/140) |
| III | 79.6% [74.7-83.9] (249/313) | 92.6% [88.2-95.7] (200/216) |
| IV | 89.5% [85.9-92.5] (325/363) | 91% [87.2-94] (274/301) |
| All | 54.4% [51.9-57] (834/1532) | 89.6% [87.1-91.7] (654/730) |

TABLE 20

Classification accuracy using a randomly selected subset of 40% of the genomic regions of Assay Panel 3 (subset b)

| Stage | Detection* | Tissue of Origin* |
|---|---|---|
| I | 17.8% [14.2-21.8] (75/422) | 75% [61.6-85.6] (42/56) |
| II | 41.5% [36.5-46.6] (161/388) | 85.9% [79.1-91.2] (122/142) |
| III | 77.6% [72.6-82.1] (243/313) | 92.3% [88-95.5] (205/222) |
| IV | 89.3% [85.6-92.2] (324/363) | 91.7% [88.1-94.6] (278/303) |
| All | 53.6% [51.1-56.1] (821/1532) | 89.5% [87-91.6] (663/741) |

TABLE 21

Classification accuracy using a randomly selected subset of 40% of the genomic regions of Assay Panel 3 (subset c)

| Stage | Detection* | Tissue of Origin* |
|---|---|---|
| I | 16.8% [13.4-20.7] (71/422) | 79.6% [66.5-89.4] (43/54) |
| II | 42.5% [37.6-47.6] (165/388) | 85% [78.2-90.4] (125/147) |
| III | 77.3% [72.3-81.8] (242/313) | 91.8% [87.2-95.2] (191/208) |
| IV | 89.5% [85.9-92.5] (325/363) | 92.3% [88.6-95] (275/298) |
| All | 53.7% [51.2-56.2] (823/1532) | 89.7% [87.2-91.8] (650/725) |

TABLE 22

Classification accuracy using a randomly selected subset of 60% of the genomic regions of Assay Panel 3

| Stage | Detection* | Tissue of Origin* |
|---|---|---|
| I | 18% [14.5-22] (76/422) | 71.4% [57.8-82.7] (40/56) |
| II | 41.2% [36.3-46.3] (160/388) | 86% [79.2-91.2] (123/143) |
| III | 78.6% [73.6-83] (246/313) | 91.1% [86.6-94.5] (205/225) |
| IV | 89.5% [85.9-92.5] (325/363) | 91.6% [87.8-94.5] (272/297) |
| All | 54% [51.5-56.6] (828/1532) | 88.7% [86.2-90.9] (658/742) |

TABLE 23

Classification accuracy using a randomly selected subset of 50% of the genomic regions of Assay Panel 4

| Stage | Detection* | Tissue of Origin* |
|---|---|---|
| I | 18.5% [14.9-22.5] (78/422) | 80.7% [68.1-90] (46/57) |
| II | 44.3% [39.3-49.41 (172/388) | 82.9% [76-88.5] (126/152) |
| III | 78.9% [74-83.3] (247/313) | 91.7% [87.3-95] (200/218) |
| IV | 90.4% [86.8-93.2] (328/363) | 92.4% [88.9-95.1] (28 ]/304) |
| All | 55.3% [52.8-57.8] (847/1532) | 89.5% [87-91.6] (670/749) |

TABLE 24

Classification accuracy using a randomly selected subset of 50% of the genomic regions of Assay Panel 5

| Stage | Detection* | Tissue of Origin* |
|---|---|---|
| I | 20.4% [16,6-24.5] (86/422) | 73.8% [61.5-84] (48/65) |
| II | 43.3% [38.3-48.4] (168/388) | 87% [80.7-91.9] (134/154) |
| III | 80.2% [75.3-84.5] (251/313) | 90.7% [86.2-94.2] (206/227) |
| IV | 89% [85.3-92] (323/363) | 92.7% [89.2-95.4] (281/303) |
| All | 55.4% [52.8-57.9] (848/1532) | 89.4% [87-91.5] (686/767) |

Part A of FIGS. 22-27 presents receiver operator curves (ROC curves) for randomly selected subsets of Assay Panels 3-4 from the trained binary logistic regression classifier using mixture model based featurization, as described above. Classifier performance results for the same random subsets the markers are also shown in Tables 19-24. As shown, the areas under the curve (AUC) for these receiver operator curves (ROC curves) were similar to each other and similar to the areas under the curve (AUC) for the complete assay panels. A summary of the area under the curve results (AUC) for each Assay Panel is presented in Table 25. Part B of FIGS. 22-27 presents confusion matrices showing tissue of origin (TOO) accuracy determined for the multi-class logistic regression classifier described above. As shown in FIGS. 22-27, TOO precision ranged from 90.4% to 90.7% for the randomly selected subsets of Assay Panels 3-4.

TABLE 25

Areas under the curves for cancer classification.

| Assay Panel | AUC |
|---|---|
| 1 | 0.81 |
| 2 | 0.82 |
| 3 | 0.82 |
| 4 | 0.83 |
| 5 | 0.83 |
| 6 | 0.83 |
| 3A | 0.80 |
| 4A | 0.82 |
| 3 Random 40% a | 0.81 |
| 3 Random 40% b | 0.82 |
| 3 Random 40% c | 0.82 |
| 3 Random 60% | 0.82 |
| 4 Random 50% | 0.82 |
| 5 Random 50% | 0.78 |

Table 26 shows tissue of origin accuracy for each cancer type at a specificity of 0.994 for Assay Panels 1, 3A and 5. Each column shows TOO precision with a 95% confidence interval in brackets and in parenthesis the number correctly assigned divided by the total number of samples correctly detected as having cancer under the binary logistic regression classifier described above.

TABLE 26

TOO precision for Assay Panels 1, 3A, and 5

| Cancer Type | Assay Panel 1 | Assay Panel 3A | Assay Panel 5 |
|---|---|---|---|
| Lung | 97% [93.2-99] (163/168) | 97% [93.2-99] (163/168) | 97.3% [93.7-99.1] (178/183) |
| Colorectal | 97.8% [92.2-99.7] (88/90) | 97.7% [91.9-99.7] (84/86) | 98.9% [94.3-100] (94/95) |
| Lymphoid neoplasm | 100% [95.4-100] (79/79) | 100% [95.9-100] (89/89) | 100% [96-100] (90/90) |
| Breast | 98.6% [92.3-100] (69/70) | 98.6% [92.2-100] (68/69) | 98.8% [93.5-100] (82/83) |
| Pancreas Gallbladder | 87.7% [77.2-94.5] (57/65) | 90.9% [81.3-96.6] (60/66) | 90.5% [81.5-96.1] (67/74) |
| Head and Neck | 89.8% [77.8-96.6] (44/49) | 85.1% [71.7-93.8] (40/47) | 88.2% [76.1-95.6] (45/51) |
| Upper GI | 80.9% [66.7-90.9] (38/47) | 89.8% [77.8-96.6] (44/49) | 86.5% [74.2-94.4] (45/52) |
| Ovary | 86.4% [65.1-97.1] (19/22) | 91.3% [72-98.9] (21/23) | 88.9% [70.8-97.6] (24/27) |
| Liver/Bile Duct | 77.8% [52.4-93.6] (14/18) | 70.8% [48.9-87.4] (17/24) | 77.3% [54.6-92.2] (17/22) |
| Uterine | 100% [75.3-100] (13/13) | 92.9% [66.1-99.8] (13/14) | 95.2% [76.2-99.9] (20/21) |
| Prostate | 92.3% [64-99.8] (12/13) | 87.5% [61.7-98.4] (14/16) | 94.4% [72.7-99.9] (17/18) |
| Multiple Myeloma | 92.3% [64-99.8] (12/13) | 94.7% [74-99.9] (18/19) | 91.3% [72-98.9] (21/23) |
| Renal | 100% [69.2-100] (10/10) | 100% [66.4-100] (9/9) | 100% [73.5-100] (12/12) |
| Anorectal | 0% [0-45.9] (0/6) | 0% [0-33.6] (0/9) | 12.5% [0.3-52.7] (1/8) |
| Bladder and urothelia | 0% [0-60.2] (0/4) | 40% [5.3-85.3] (2/5) | 50% [11.8-88.2] (3/6) |
| Sarcoma | 66.7% [9.4-99.2] (2/3) | 25% [0.6-80.6] (1/4) | 50% [6.8-93.2] (2/4) |
| Cervical | 0% [0-97.5] (0/1) | 100% [15.8-100] (2/2) | 25% [0.6-80.6] (1/4) |
| Melanoma | 100% [2.5-100] (1/1) | 66.7% [9.4-99.2] (2/3) | 100% [29.2-100] (3/3) |

Tables 27-29 show classifier performance for the binary logistic regression classifier described above for Assay Panels 1, 3A and 5. Each tables shows the sensitivity for each cancer type, stratified by stage, at a specificity of 0.994. Each column also shows the 95% confidence interval in brackets and in parenthesis the number correctly detected divided by the total number of samples in the data set for each cancer type, at stages I through IV.

TABLE 27

Classifier performance by cancer type and stage for Assay Panel 1

| Cancer Type | I | II | III | IV | All Stages |
|---|---|---|---|---|---|
| Lung | 16.7% | 78.3% | 83.3% | 86.8% | 69% |
| | [8.3-28.5] | [56.3-92.5] | [72.7-91.1] | [78.8-92.6] | [63-74.5] |
| | (10/60) | (18/23) | (60/72) | (92/106) | (180/261) |
| Prostate | 0% | 0.9% | 10.5% | 76.5% | 8.5% |
| | [0-9] | [0-4.8] | [1.3-33.1] | [50.1-93.2] | [4.9-13.5] |
| | (0/39) | (1/113) | (2/19) | (13/17) | (16/188) |
| Breast HR positive | 2.3% | 20% | 71.4% | 100% | 18.1% |
| | [0.3-8.1] | [11.4-31.3] | [41.9-91.6] | [54.1-100] | [12.7-24.6] |
| | (2/87) | (14/70) | (10/14) | (6/6) | (32/177) |
| Lymphoid neoplasm | 20% | 74.1% | 70.4% | 76.9% | 56.5% |
| | [4.3-48.1] | [53.7-88.9] | [49.8-86.2] | [60.7-88.9] | [48-64.6] |
| | (3/15) | (20/27) | (19/27) | (30/39) | (83/147) |
| Colorectal | 41.2% | 66.7% | 80.4% | 93.3% | 77% |
| | [18.4-67.1] | [46.2-83.5] | [66.1-90.6] | [81.7-98.6] | [69-83.8] |
| | (7/17) | (18/27) | (37/46) | (42/45) | (104/135) |
| Pancreas | 58.3% | 71.4% | 81.2% | 92.9% | 82.1% |
| | [27.7-84.8] | [41.9-91.6] | [54.4-96] | [80.5-98.5] | [72.3-89.6] |
| | (7/12) | (10/14) | (13/16) | (39/42) | (69/84) |
| Endometrial carcinoma | 13.7% | 33.3% | 60% | 66.7% | 19% |
| | [6.8-23.8] | [0.8-90.6] | [14.7-94.7] | [9.4-99.2] | [11.3-29.1] |
| | (10/73) | (1/3) | (3/5) | (2/3) | (16/84) |
| Breast HR negative | 0% | 62.5% | 100% | 100% | 57.1% |
| | [0-21.8] | [45.8-77.3] | [75.3-100] | [15.8-100] | [44.7-68.9] |
| | (0/15) | (25/40) | (13/13) | (2/2) | (40/70) |
| Head and Neck | 85.7% | 76.9% | 87.5% | 88.5% | 85.5% |
| | [42.1-99.6] | [46.2-95] | [61.7-98.4] | [69.8-97.6] | [74.2-93.1] |
| | (6/7) | (10/13) | (14/16) | (23/26) | (53/62) |
| Renal | 0% | 0% | 50% | 81.8% | 19.6% |
| | [0-9.5] | [0-60.2] | [6.8-93.2] | [48.2-97.7] | [10.2-32.4] |
| | (0/37) | (0/4) | (2/4) | (9/11) | (11/56) |
| Ovary | 25% | 0% | 68% | 100% | 64.9% |
| | [0.6-80.6] | [0-84.2] | [46.5-85.1] | [54.1-100] | [47.5-79.8] |
| | (1/4) | (0/2) | (17/25) | (6/6) | (24/37) |
| Multiple Myeloma | 20% | 23.1% | 90.9% | — | 44.1% |
| | [2.5-55.6] | [5-53.8] | [58.7-99.8] | | [27.2-62.1] |
| | (2/10) | (3/13) | (10/11) | | (15/34) |
| Esophagus | 16.7% | 75% | 82.4% | 100% | 80% |
| | [0.4-64.1] | [34.9-96.8] | [56.6-96.2] | [82.4-100] | [66.3-90] |
| | (1/6) | (6/8) | (14/17) | (19/19) | (40/50) |
| Multiple myeloma | 20% | 23.1% | 90.9% | — | 44.1% |
| | [2.5-55.6] | [5-53.8] | [58.7-99.8] | | [27.2-62.1] |
| | (2/10) | (3/13) | (10/11) | | (15/34) |
| Biliary tract | 25% | 80% | 60% | 100% | 75% |
| | [0.6-80.6] | [28.4-99.5] | [14.7-94.7] | [69.2-100] | [53.3-90.2] |
| | (1/4) | (4/5) | (3/5) | (10/10) | (18/24) |
| Gastric | 0% | 75% | 100% | 100% | 76.5% |
| | [0-70.8] | [19.4-99.4] | [15.8-100] | [63.1-100] | [50.1-93.2] |
| | (0/3) | (3/4) | (2/2) | (8/8) | (13/17) |
| Hepatocellular | 25% | 66.7% | 100% | 100% | 75% |
| | [0.6-80.6] | [9.4-99.2] | [47.8-100] | [39.8-100] | [47.6-92.7] |
| | (1/4) | (2/3) | (5/5) | (4/4) | (12/16) |
| Sarcoma | 100% | 0% | 20% | 66.7% | 37.5% |
| | [2.5-100] | [0-60.2] | [0.5-71.6] | [22.3-95.7] | [15.2-64.6] |
| | (1/1) | (0/4) | (1/5) | (4/6) | (6/16) |
| Bladder | 60% | 66.7% | 50% | 0% | 54.5% |
| | [14.7-94.7] | [9.4-99.2] | [1.3-98.7] | [0-97.5] | [23.4-83.3] |
| | (3/5) | (2/3) | (1/2) | (0/1) | (6/11) |
| Cervical | 12.5% | 100% | 100% | — | 36.4% |
| | [0.3-52.7] | [2.5-100] | [15.8-100] | | [10.9-69.2] |
| | (1/8) | (1/1) | (2/2) | | (4/11) |
| Melanoma | 0% | 0% | — | 100% | 42.9% |
| | [0-70.8] | [0-97.5] | | [29.2-100] | [9.9-81.6] |
| | (0/3) | (0/1) | | (3/3) | (3/7) |
| Renal Pelvis Urothelial | 100% | 50% | — | — | 60% |
| | [2.5-100] | [6.8-93.2] | | | [14.7-94.7] |
| | (1/1) | (2/4) | | | (3/5) |
| Uterine sarcoma | 100% | — | — | — | 100% |
| | [2.5-100] | | | | [2.5-100] |
| | (1/1) | | | | (1/1) |
| Myeloid neoplasm | — | — | — | — | 0% |
| | | | | | [0-60.2] |
| | | | | | (0/4) |
| Thyroid | 0% | 0% | — | 0% | 0% |
| | [0-84.2] | [0-97.5] | | [0-97.5] | [0-60.2] |
| | (0/2) | (0/1) | | (0/1) | (0/4) |

TABLE 28

Classifier performance by cancer type and stage for Assay Panel 3A

| Cancer Type | I | II | III | IV | All Stages |
|---|---|---|---|---|---|
| Lung | 13.3% [5.9-24.6] (8/60) | 73.9% [51.6-89.8] (17/23) | 79.2% [68-87.8] (57/72) | 86.8% [78.8-92.6] (92/106) | 66.7% [60.6-72.4] (174/261) |
| Prostate | 0% [0-9] (0/39) | 1.8% [0.2-6.2] (2/113) | 10.5% [1.3-33.1] (2/19) | 76.5% [50.1-93.2] (13/17) | 9% [5.4-14.1] (17/188) |
| Breast HR positive | 2.3% [0.3-8.1] (2/87) | 18.6% [10.3-29.7] (13/70) | 71.4% [41.9-91.6] (10/14) | 83.3% [35.9-99.6] (5/6) | 16.9% [11.7-23.3] (30/177) |
| Lymphoid neoplasm | 26.7% [7.8-55.1] (4/15) | 81.5% [61.9-93.7] (22/27) | 70.4% [49.8-86.2] (19/27) | 74.4% [57.9-87] (29/39) | 61.9% [53.5-69.8] (91/147) |
| Colorectal | 35.3% [14.2-61.7] (6/17) | 51.9% [31.9-71.3] (14/27) | 78.3% [63.6-89.1] (36/46) | 93.3% [81.7-98.6] (42/45) | 72.6% [64.3-79.9] (98/135) |
| Pancreas | 33.3% [9.9-65.1] (4/12) | 71.4% [41.9-91.6] (10/14) | 75% [47.6-92.7] (12/16) | 92.9% [80.5-98.5] (39/42) | 77.4% [67-85.8] (65/84) |
| Endometrial carcinoma | 15.1% [7.8-25.4] (11/73) | 33.3% [0.8-90.6] (1/3) | 60% [14.7-94.7] (3/5) | 33.3% [0.8-90.6] (1/3) | 19% [11.3-29.1] (16/84) |
| Breast HR negative | 0% [0-21.8] (0/15) | 65% [48.3-79.4] (26/40) | 100% [75.3-100] (13/13) | 100% [15.8-100] (2/2) | 58.6% [46.2-70.2] (41/70) |
| Head and Neck | 85.7% [42.1-99.6] (6/7) | 84.6% [54.6-98.1] (11/13) | 81.2% [54.4-96] (13/16) | 88.5% [69.8-97.6] (23/26) | 85.5% [74.2-93.1] (53/62) |
| Renal | 0% [0-9.5] (0/37) | 25% [0.6-80.6] (1/4) | 50% [6.8-93.2] (2/4) | 72.7% [39-94] (8/11) | 19.6% [10.2-32.4] (11/56) |
| Ovary | 25% [0.6-80.6] (1/4) | 0% [0-84.2] (0/2) | 72% [50.6-87.9] (18/25) | 100% [54.1-100] (6/6) | 67.6% [50.2-82] (25/37) |
| Multiple Myeloma | 40% [12.2-73.8] (4/10) | 46.2% [19.2-74.9] (6/13) | 100% [71.5-100] (11/11) | — | 61.8% [43.6-77.8] (21/34) |
| Esophagus | 16.7% [0.4-64.1] (1/6) | 75% [34.9-96.8] (6/8) | 82.4% [56.6-96.2] (14/17) | 94.7% [74-99.9] (18/19) | 78% [64-88.5] (39/50) |
| Multiple myeloma | 40% [12.2-73.8] (4/10) | 46.2% [19.2-74.9] (6/13) | 100% [71.5-100] (11/11) | [43.6-77.8] | 61.8% (21/34) |
| Biliary tract | 25% [0.6-80.6] (1/4) | 80% [28.4-99.5] (4/5) | 60% [14.7-94.7] (3/5) | 100% [69.2-100] (10/10) | 75% [53.3-90.2] (18/24) |
| Gastric | 0% [0-70.8] (0/3) | 100% [39.8-100] (4/4) | 100% [15.8-100] (2/2) | 100% [63.1-100] (8/8) | 82.4% [56.6-96.2] (14/17) |
| Hepatocellular | 50% [6.8-93.2] (2/4) | 100% [29.2-100] (3/3) | 100% [47.8-100] (5/5) | 100% [39.8-100] (4/4) | 87.5% [61.7-98.4] (14/16) |
| Sarcoma | 0% [0-97.5] (0/1) | 0% [0-60.2] (0/4) | 20% [0.5-71.6] (1/5) | 50% [11.8-88.2] (3/6) | 25% [7.3-52.4] (4/16) |
| Bladder | 40% [5.3-85.3] (2/5) | 66.7% [9.4-99.2] (2/3) | 50% [1.3-98.7] (1/2) | 0% [0-97.5] (0/1) | 45.5% [16.7-76.6] (5/11) |
| Cervical | 12.5% [0.3-52.7] (1/8) | 100% [2.5-100] (1/1) | 100% [15.8-100] (2/2) | — | 36.4% [10.9-69.2] (4/11) |
| Melanoma | 0% [0-70.8] (0/3) | 0% [0-97.5] (0/1) | — | 100% [29.2-100] (3/3) | 42.9% [9.9-81.6] (3/7) |
| Renal Pelvis Urothelial | 100% [2.5-100] (1/1) | 25% [0.6-80.6] (1/4) | — | — | 40% [5.3-85.3] (2/5) |
| Uterine sarcoma | 100% [2.5-100] (1/1) | — | — | — | 100% [2.5-100] (1/1) |
| Myeloid neoplasm | — | — | — | — | 0% [0-60.2] (0/4) |
| Thyroid | 0% [0-84.2] (0/2) | 0% [0-97.5] (0/1) | — | 0% [0-97.5] (0/1) | 0% [0-60.2] (0/4) |

TABLE 29

Classifier performance by cancer type and stage for Assay Panel 5

| Cancer Type | I | II | III | IV | All Stages |
|---|---|---|---|---|---|
| Lung | 20% | 78.3% | 86.1% | 91.5% | 72.4% |
| | [10.8-32.3] | [56.3-92.5] | [75.9-93.1] | [84.5-96] | [66.6-77.7] |
| | (12/60) | (18/23) | (62/72) | (97/106) | (189/261) |
| Prostate | 2.6% | 4.4% | 10.5% | 76.5% | 11.2% |
| | [0.1-13.5] | [1.5-10] | [1.3-33.1] | [50.1-93.2] | [7-16.6] |
| | (1/39) | (5/113) | (2/19) | (13/17) | (21/188) |
| Breast HR positive | 4.6% | 25.7% | 71.4% | 100% | 21.5% |
| | [1.3-11.4] | [16-37.6] | [41.9-91.6] | [54.1-100] | [15.7-28.3] |
| | (4/87) | (18/70) | (10/14) | (6/6) | (38/177) |
| Lymphoid neoplasm | 26.7% | 74.1% | 77.8% | 79.5% | 62.6% |
| | [7.8-55.1] | [53.7-88.9] | [57.7-91.4] | [63.5-90.7] | [54.2-70.4] |
| | (4/15) | (20/27) | (21/27) | (31/39) | (92/147) |
| Colorectal | 47.1% | 70.4% | 82.6% | 93.3% | 79.3% |
| | [23-72.2] | [49.8-86.2] | [68.6-92.2] | [81.7-98.6] | [71.4-85.8] |
| | (8/17) | (19/27) | (38/46) | (42/45) | (107/135) |
| Pancreas | 58.3% | 71.4% | 87.5% | 95.2% | 84.5% |
| | [27.7-84.8] | [41.9-91.6] | [61.7-98.4] | [83.8-99.4] | [75-91.5] |
| | (7/12) | (10/14) | (14/16) | (40/42) | (71/84) |
| Endometrial carcinoma | 20.5% | 33.3% | 60% | 66.7% | 25% |
| | [12-31.6] | [0.8-90.6] | [14.7-94.7] | [9.4-99.2] | [16.2-35.6] |
| | (15/73) | (1/3) | (3/5) | (2/3) | (21/84) |
| Breast HR negative | 6.7% | 72.5% | 100% | 100% | 64.3% |
| | [0.2-31.9] | [56.1-85.4] | [75.3-100] | [15.8-100] | [51.9-75.4] |
| | (1/15) | (29/40) | (13/13) | (2/2) | (45/70) |
| Head and Neck | 100% | 84.6% | 87.5% | 88.5% | 88.7% |
| | [59-100] | [54.6-98.1] | [61.7-98.4] | [69.8-97.6] | [78.1-95.3] |
| | (7/7) | (11/13) | (14/16) | (23/26) | (55/62) |
| Renal | 0% | 50% | 50% | 81.8% | 23.2% |
| | [0-9.5] | [6.8-93.2] | [6.8-93.2] | [48.2-97.7] | [13-36.4] |
| | (0/37) | (2/4) | (2/4) | (9/11) | (13/56) |
| Ovary | 25% | 0% | 88% | 100% | 78.4% |
| | [0.6-80.6] | [0-84.2] | [68.8-97.5] | [54.1-100] | [61.8-90.2] |
| | (1/4) | (0/2) | (22/25) | (6/6) | (29/37) |
| Multiple Myeloma | 40% | 46.2% | 100% | — | 61.8% |
| | [12.2-73.8] | [19.2-74.9] | [71.5-100] | | [43.6-77.8] |
| | (4/10) | (6/13) | (11/11) | | (21/34) |
| Esophagus | 25% | 80% | 60% | 100% | 75% |
| | [0.6-80.6] | [28.4-99.5] | [14.7-94.7] | [69.2-100] | [53.3-90.2] |
| | (1/4) | (4/5) | (3/5) | (10/10) | (18/24) |
| Multiple myeloma | 0% | 100% | 100% | 100% | 82.4% |
| | [0-70.8] | [39.8-100] | [15.8-100] | [63.1-100] | [56.6-96.2] |
| | (0/3) | (4/4) | (2/2) | (8/8) | (14/17) |
| Biliary tract | 50% | 100% | 100% | 100% | 87.5% |
| | [6.8-93.2] | [29.2-100] | [47.8-100] | [39.8-100] | [61.7-98.4] |
| | (2/4) | (3/3) | (5/5) | (4/4) | (14/16) |
| Gastric | 0% | 0% | 20% | 50% | 25% |
| | [0-97.5] | [0-60.2] | [0.5-71.6] | [11.8-88.2] | [7.3-52.4] |
| | (0/1) | (0/4) | (1/5) | (3/6) | (4/16) |
| Hepatocellular | 40% | 66.7% | 50% | 0% | 45.5% |
| | [5.3-85.3] | [9.4-99.2] | [1.3-98.7] | [0-97.5] | [16.7-76.6] |
| | (2/5) | (2/3) | (1/2) | (0/1) | (5/11) |
| Sarcoma | 12.5% | 100% | 100% | — | 36.4% |
| | [0.3-52.7] | [2.5-100] | [15.8-100] | | [10.9-69.2] |
| | (1/8) | (1/1) | (2/2) | | (4/11) |
| Bladder | 0% | 0% | — | 100% | 42.9% |
| | [0-70.8] | [0-97.5] | | [29.2-100] | [9.9-81.6] |
| | (0/3) | (0/1) | | (3/3) | (3/7) |
| Cervical | 100% | 25% | — | — | 40% |
| | [2.5-100] | [0.6-80.6] | | | [5.3-85.3] |
| | (1/1) | (1/4) | | | (2/5) |
| Melanoma | 100% | — | — | — | 100% |
| | [2.5-100] | | | | [2.5-100] |
| | (1/1) | | | | (1/1) |
| Renal Pelvis Urothelial | — | — | — | — | 0% |
| | | | | | [0-60.2] |
| | | | | | (0/4) |
| Uterine sarcoma | 0% | 0% | — | 0% | 0% |
| | [0-84.2] | [0-97.5] | | [0-97.5] | [0-60.2] |
| | (0/2) | (0/1) | | (0/1) | (0/4) |
| Myeloid neoplasm | 40% | 46.2% | 100% | — | 61.8% |
| | [12.2-73.8] | [19.2-74.9] | [71.5-100] | | [43.6-77.8] |
| | (4/10) | (6/13) | (11/11) | | (21/34) |
| Thyroid | 25% | 80% | 60% | 100% | 75% |
| | [0.6-80.6] | [28.4-99.5] | [14.7-94.7] | [69.2-100] | [53.3-90.2] |
| | (1/4) | (4/5) | (3/5) | (10/10) | (18/24) |

7. INCORPORATION BY REFERENCE

All publications, patents, patent applications and other documents cited in this application are hereby incorporated by reference in their entireties for all purposes to the same extent as if each individual publication, patent, patent application or other document were individually indicated to be incorporated by reference for all purposes.

8. Equivalents

It is to be understood that the figures and descriptions of the present disclosure have been simplified to illustrate elements that are relevant for a clear understanding of the present disclosure, while eliminating, for the purpose of clarity, many other elements found in a typical system. Those of ordinary skill in the art may recognize that other elements and/or steps are desirable and/or required in implementing the present disclosure. However, because such elements and steps are well known in the art, and because they do not facilitate a better understanding of the present disclosure, a discussion of such elements and steps is not provided herein. The disclosure herein is directed to all such variations and modifications to such elements and methods known to those skilled in the art.

Some portions of above description describe the embodiments in terms of algorithms and symbolic representations of operations on information. These algorithmic descriptions and representations are commonly used by those skilled in the data processing arts to convey the substance of their work effectively to others skilled in the art. These operations, while described functionally, computationally, or logically, are understood to be implemented by computer programs or equivalent electrical circuits, microcode, or the like. The described operations and their associated modules may be embodied in software, firmware, hardware, or any combinations thereof.

As used herein any reference to "one embodiment" or "an embodiment" means that a particular element, feature, structure, or characteristic described in connection with the embodiment is included in at least one embodiment. The appearances of the phrase "in one embodiment" in various places in the specification are not necessarily all referring to the same embodiment, thereby providing a framework for various possibilities of described embodiments to function together.

As used herein, the terms "comprises," "comprising," "includes," "including," "has," "having" or any other variation thereof, are intended to cover a non-exclusive inclusion. For example, a process, method, article, or apparatus that comprises a list of elements is not necessarily limited to only those elements but may include other elements not expressly listed or inherent to such process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

In addition, use of the "a" or "an" are employed to describe elements and components of the embodiments herein. This is done merely for convenience and to give a general sense of the description. This description should be read to include one or at least one and the singular also includes the plural unless it is obvious that it is meant otherwise.

While particular embodiments and applications have been illustrated and described, it is to be understood that the disclosed embodiments are not limited to the precise construction and components disclosed herein. Various modifications, changes and variations, which will be apparent to those skilled in the art, may be made in the arrangement, operation and details of the method and apparatus disclosed herein without departing from the spirit and scope defined in the appended claims.

While various specific embodiments have been illustrated and described, the above specification is not restrictive. It will be appreciated that various changes can be made without departing from the spirit and scope of the description(s). Many variations will become apparent to those skilled in the art upon review of this specification.

SEQUENCE LISTING (131822 sequences)

SEQ ID NO: 1 - DNA, 98 bp, Homo sapiens
  misc_feature 1..98: note = chr1:3567247-3567345
  misc_feature 1..98: note = hyper
  source 1..98: mol_type = genomic DNA
agatcaaggagagaacgaatttgccgctgactgggcagagcgagcgcgtggatcgcggccaccgcccgttcatcacccgcgcgcatctgggctggcac

SEQ ID NO: 2 - DNA, 114 bp, Homo sapiens
  misc_feature 1..114: note = chr1:3567737-3567851
  misc_feature 1..114: note = hyper
  source 1..114: mol_type = genomic DNA
cggccttttctgttgccaaaactagacccaaacctctgcatgggattcgtctttgggtccccaccccgtgcgcccagcaaacagtgggtgagccatgaagatgtgcgagtcagc

SEQ ID NO: 3 - DNA, 395 bp, Homo sapiens
  misc_feature 1..395: note = chr1:3567882-3568277
  misc_feature 1..395: note = hyper
  source 1..395: mol_type = genomic DNA
cggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccaga

SEQ ID NO: 4 - DNA, 113 bp, Homo sapiens
  misc_feature 1..113: note = chr1:4715427-4715540
  misc_feature 1..113: note = hyper
  source 1..113: mol_type = genomic DNA
cgccgcgcagatggcctgggcgagccaggtctgaggccccgctccccgaaacgtgaccatgtggattcaacagcttttaggactcaggtgagcgacccggccggcgccgggtg

SEQ ID NO: 5 - DNA, 528 bp, Homo sapiens
  misc_feature 1..528: note = chr1:4715574-4716102
  misc_feature 1..528: note = hyper
  source 1..528: mol_type = genomic DNA
cggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcaca

SEQ ID NO: 6 - DNA, 517 bp, Homo sapiens
  misc_feature 1..517: note = chr1:6480368-6480885
  misc_feature 1..517: note = hyper
  source 1..517: mol_type = genomic DNA
cagcaggggacccagcggttacgggagctcccatgagggacagcagcgggagggacttgcacccccagctgctttatcgggtgaagggctgagctggacgggaaatccgagttccggagaaaggtcgtgacttgctccagtcctcgacgctgggaacaggccgagcctggacaagggccccagtcgctggacgcccggctctaaggagcccgtagaacccttcggcggcttgcctagttaagagtcttttggttaccccactccaggctttgggtggggaaacggaatcctagagaagcagaggcagccctggagccctcggagctcgttttcattcccaccggctaggggtccgggttctcgcccgcaagacagtcagggctcatgtgacgcgcgggcaggacagttttgggtgcgggccccagtggcccgcccaggaccgccttcgcgccgcgtggccgttgctgcggcaaactggctggcgtcccccgcccatctgctccgggctcccctcccc

SEQ ID NO: 7 - DNA, 15 bp, Homo sapiens
  misc_feature 1..15: note = chr1:6500973-6500988
  misc_feature 1..15: note = hyper
  source 1..15: mol_type = genomic DNA
ctcactgcgtgcccc

SEQ ID NO: 8 - DNA, 125 bp, Homo sapiens
  misc_feature 1..125: note = chr1:6501054-6501179
  misc_feature 1..125: note = hyper
  source 1..125: mol_type = genomic DNA
cggccgccgacctgtcggacttcaacggccacagccactgcacccgctacctgcgcacggtggagaacctggtacgatccctgagctgctcctgtcgcattctttcttctcgcccctccacccca

SEQ ID NO: 9 - DNA, 30 bp, Homo sapiens
  misc_feature 1..30: note = chr1:8277113-8277143
  misc_feature 1..30: note = hyper
  source 1..30: mol_type = genomic DNA
tcccagagatgagggcgaggggaggggacc

SEQ ID NO: 10 - DNA, 50 bp, Homo sapiens
  misc_feature 1..50: note = chr1:11540129-11540179
  misc_feature 1..50: note = hyper
  source 1..50: mol_type = genomic DNA
gggagccaaccccaccgccgggagaacttttcccaactccctggggaggc

SEQ ID NO: 11 - DNA, 133 bp, Homo sapiens
  misc_feature 1..133: note = chr1:12123421-12123554
  misc_feature 1..133: note = hyper
  source 1..133: mol_type = genomic DNA
ggaaccaatttgatacgggagaactaaggctgaaacctcggaggaacaaccacttttgaagtgacttcgcggcgtgcgttgggtgcggactaggtggccgcggcgggagtgtgctggagcctgaagtccacgc

SEQ ID NO: 12 - DNA, 15 bp, Homo sapiens
  misc_feature 1..15: note = chr1:12123787-12123802
  misc_feature 1..15: note = hyper
  source 1..15: mol_type = genomic DNA
cgcaagggaggacac

SEQ ID NO: 13 - DNA, 229 bp, Homo sapiens
  misc_feature 1..229: note = chr1:18437202-18437431
  misc_feature 1..229: note = hyper
  source 1..229: mol_type = genomic DNA
gaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagcc

SEQ ID NO: 14 - DNA, 94 bp, Homo sapiens
  misc_feature 1..94: note = chr1:18437432-18437526
  misc_feature 1..94: note = hyper
  source 1..94: mol_type = genomic DNA
ggggtctccgggattgcgcgggcggaggtgggcggccctgcgggttctcgggttctcgggttctctgtctccgcagccgcgtgtcagcaggtgg

SEQ ID NO: 15 - DNA, 476 bp, Homo sapiens
  misc_feature 1..476: note = chr1:18956811-18957287
  misc_feature 1..476: note = hyper
  source 1..476: mol_type = genomic DNA
caagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatc

SEQ ID NO: 16 - DNA, 93 bp, Homo sapiens
  misc_feature 1..93: note = chr1:18960897-18960990
  misc_feature 1..93: note = hyper
  source 1..93: mol_type = genomic DNA
gcccaccatggcatccggccctgtgtcatctcccgacagctgcgtgtctcccacggctgcgtctccaagattctttgccgctaccaggagacc

SEQ ID NO: 17 - DNA, 331 bp, Homo sapiens
  misc_feature 1..331: note = chr1:22140683-22141014
  misc_feature 1..331: note = hyper
  source 1..331: mol_type = genomic DNA
aagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggc

SEQ ID NO: 18 - DNA, 287 bp, Homo sapiens
  misc_feature 1..287: note = chr1:22141015-22141302
  misc_feature 1..287: note = hyper
  source 1..287: mol_type = genomic DNA
gcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcac

SEQ ID NO: 19 - DNA, 15 bp, Homo sapiens
  misc_feature 1..15: note = chr1:32237531-32237546
  misc_feature 1..15: note = hyper
  source 1..15: mol_type = genomic DNA
cccaccgccggaagc

SEQ ID NO: 20 - DNA, 1008 bp, Homo sapiens
  misc_feature 1..1008: note = chr1:32237638-32238646
  misc_feature 1..1008: note = hyper
  source 1..1008: mol_type = genomic DNA
cggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagt

SEQ ID NO: 21 - DNA, 940 bp, Homo sapiens
  misc_feature 1..940: note = chr1:36042549-36043489
  misc_feature 1..940: note = hyper
  source 1..940: mol_type = genomic DNA
ggaccccagcgccagcgggaccccagcgccagcgggaccccagcgccagcgggaccccagcgccagcgggaccccagcgccagcgggaccccagcgccagcgggtctgtggcccagtggagcgagtggagcgctggcgacctgagcggagactgcgccctggacgccccagcctagacgtcaagttacagcccgcgcagcagcagcaaaggggaaggggcaggagccgggcacagttggatccggaggtcgtgacccaggggaaagcgtgggcggtcgacccagggcagctgcggcggcgaggcaggtgggctccttgctccctggagccgcccctccccacacctgccctcggcgcccccagcagttttcaccttggccctccgcggtcactgcgggattcggcgttgccgccagcccagtggggagtgaattagcgccctccttcgtcctcggcccttccgacggcacgaggaactcctgtcctgccccacagaccttcggcctccgccgagtgcggtactggagcctgccccgccagggccctggaatcagagaaagtcgctctttggccacctgaagcgtcggatccctacagtgcctcccagcctgggcgggagcggcggctgcgtcgctgaaggttggggtccttggtgcgaaagggaggcagctgcagcctcagccccaccccagaagcggccttcgcatcgctgcggtgggcgttctcgggcttcgacttcgccagcgccgcggggcagaggcacctggagctcgcagggcccagacctgggttggaaaagcttcgctgactgcaggcaagcgtccgggaggggcggccaggcgaagccccggcgctttaccacacacttccgggtcccatgccagttgcatccgcggtattgggcaggaaatggcagggctgaggccgaccctaggagtat

SEQ ID NO: 22 - DNA, 162 bp, Homo sapiens
  misc_feature 1..162: note = chr1:38510087-38510249
  misc_feature 1..162: note = hyper
  source 1..162: mol_type = genomic DNA
aggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacac

SEQ ID NO: 23 - DNA, 425 bp, Homo sapiens
  misc_feature 1..425: note = chr1:38510309-38510734
  misc_feature 1..425: note = hyper
  source 1..425: mol_type = genomic DNA
gtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatc

SEQ ID NO: 24 - DNA, 160 bp, Homo sapiens
  misc_feature 1..160: note = chr1:38510773-38510933
  misc_feature 1..160: note = hyper
  source 1..160: mol_type = genomic DNA
cgaggggatgggggcagagagcaggcggcgggcaggatgcccggggtgagttggcgagttccggatcttcgctcctctctcccggggctcgggcgacgcagcctaccgggctgtcttcgccgctcaccggagagggtcgtccgggtgtttggttttgttc

SEQ ID NO: 25 - DNA, 866 bp, Homo sapiens
  misc_feature 1..866: note = chr1:38510934-38511800
  misc_feature 1..866: note = hyper
  source 1..866: mol_type = genomic DNA
aaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggcggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcacttgagaaagtggctctcgagcgcgcctttgacccccacctcgatggacgtgcgcttcttgcgcttgcggccctgcgccgcgatcttgtccaggttggtggggctgccgctggacgagtcggtctcctccagccacttgttgagcagcggcttgagcttgcacatgttcttgaagctcagctgcagggcctcgaagcggcagatggtggtctgcgagaacacgttaccgtagagcgtgcccagcgccagccccacgtcggcctgcgtaaagcccagcttgatgcgccgctgcttgaactgcttggcgaactgctccaggtcgtccgagctgggcgcatcctcgtccgagtgctcgcccaccgatgagccgccgccgcccgcgcccgggtgcaggtgcgccgccgccgcgtgcaggccgcccgcgtgtgcatgtccgtgtgcgtgtccgtgggcgcccagatgcgg

SEQ ID NO: 26 - DNA, 269 bp, Homo sapiens
  misc_feature 1..269: note = chr1:38511821-38512090
  misc_feature 1..269: note = hyper
  source 1..269: mol_type = genomic DNA
cgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgc

SEQ ID NO: 27 - DNA, 141 bp, Homo sapiens
  misc_feature 1..141: note = chr1:44872582-44872723
  misc_feature 1..141: note = hyper
  source 1..141: mol_type = genomic DNA
cccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttc

SEQ ID NO: 28 - DNA, 141 bp, Homo sapiens
  misc_feature 1..141: note = chr1:44872923-44873064
  misc_feature 1..141: note = hyper
  source 1..141: mol_type = genomic DNA
ggactcggcttgaggggcaaaggggagagaaaggaaaaataaagaaaaaaaagggcggcagtgaggaagcagcgaggggactggggggagcagagtgggcaggggggctttgccttgcctggcctcctctttccgtctcgc

SEQ ID NO: 29 - DNA, 108 bp, Homo sapiens
  misc_feature 1..108: note = chr1:44873065-44873173
  misc_feature 1..108: note = hyper
  source 1..108: mol_type = genomic DNA
ggctcttcctgcaaaggggaatgagcagaggggggaaaggcagaaagagcgtcgaggaagagcggtgctggcgtcttccgtgccgatccctcctggcccgcagagacc

SEQ ID NO: 30 - DNA, 281 bp, Homo sapiens
  misc_feature 1..281: note = chr1:44873509-44873790
  misc_feature 1..281: note = hyper
  source 1..281: mol_type = genomic DNA
gggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttggg

SEQ ID NO: 31 - DNA, 94 bp, Homo sapiens
  misc_feature 1..94: note = chr1:44883121-44883215
  misc_feature 1..94: note = hyper
  source 1..94: mol_type = genomic DNA
tggcttggcttggctcggcgcgccgctcgcctggcggctgggctcgctgtagttgtgctcccgctcttcccctgccctcgctccacgccgcgcc

SEQ ID NO: 32 - DNA, 95 bp, Homo sapiens
  misc_feature 1..95: note = chr1:44883751-44883846
  misc_feature 1..95: note = hyper
  source 1..95: mol_type = genomic DNA
cgccgtctgagcagaagagagtgggaaccggggtgacggataaggggggggcgcccacgcgacgtcggggtgcatgggagcgcgcgggaggcgct

SEQ ID NO: 33 - DNA, 229 bp, Homo sapiens
  misc_feature 1..229: note = chr1:46956387-46956616
  misc_feature 1..229: note = hyper
  source 1..229: mol_type = genomic DNA
ttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttg

SEQ ID NO: 34 - DNA, 155 bp, Homo sapiens
  misc_feature 1..155: note = chr1:46956684-46956839
  misc_feature 1..155: note = hyper
  source 1..155: mol_type = genomic DNA
cgacaggccaggggccctgatggactgtgcagggtcccgggcaccaccggctgaactttctggcggtcacaaattcccggaacctgcgcaggggcttcgttggcactggtggttcacttaaggagcttgagggaaacctcctcttccccaaattc

SEQ ID NO: 35 - DNA, 314 bp, Homo sapiens
  misc_feature 1..314: note = chr1:46956840-46957154
  misc_feature 1..314: note = hyper
  source 1..314: mol_type = genomic DNA
caccaaatctggggccccgacttttcctggattccagccacactcggtttgggaggcagtgggctcctcaggcttgtgatttgcggcaggaaggagtcccggaatggaagaacggggaggacgagatccgaggccttttcaccctctttgcaagcatgcagttcaccaaagccgagaacccaccgggcctggagcgcagcctcagcgctggttccgacccgggccccagaaggtctttttcgtttgagaaaagtcctcggaggccggggcagggtgcgccgatattggtttactaagggcgcctccagtttgag

SEQ ID NO: 36 - DNA, 326 bp, Homo sapiens
  misc_feature 1..326: note = chr1:47009560-47009886
  misc_feature 1..326: note = hyper
  source 1..326: mol_type = genomic DNA
aggaaggaaagaccccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggca

SEQ ID NO: 37 - DNA, 126 bp, Homo sapiens
  misc_feature 1..126: note = chr1:47009910-47010036
  misc_feature 1..126: note = hyper
  source 1..126: mol_type = genomic DNA
cgcctcccgccacccggaacccctctccttcaagcgttgaccgccgacccacagctccccttcaacccggggcgagcggggttcttaccatacacctcccctctccgctcggttccatccttctcc

SEQ ID NO: 38 - DNA, 28 bp, Homo sapiens
  misc_feature 1..28: note = chr1:47010104-47010132
  misc_feature 1..28: note = hyper
  source 1..28: mol_type = genomic DNA
cgtccgcactttccgagagccaggcacg

SEQ ID NO: 39 - DNA, 226 bp, Homo sapiens
  misc_feature 1..226: note = chr1:47696295-47696521
  misc_feature 1..226: note = hyper
  source 1..226: mol_type = genomic DNA
cagcaacttagaaaacggctgtagcggaaaaaaacccgctgctttgttctcccgccaaaggagccaaaagggacaaactgctgcgctctgggatgattattttaattaaaatagatgttaatgatgacgattgtgatggtgatggcattagcaattacaataattgacaaaacaaaattctttcaacccgagctagggccccactaacccggtccctcccagagcc

SEQ ID NO: 40 - DNA, 345 bp, Homo sapiens
  misc_feature 1..345: note = chr1:47696620-47696965
  misc_feature 1..345: note = hyper
  source 1..345: mol_type = genomic DNA
cgaatgtccccacccgaggctcgaggcctggtgaatgtgcccattgtcctttcggggcctctcccttggagcccggcggccgcacccacgaaactgaccagaaatggatgaagccggagtgcagcgggaaccgaagcccgcagctaccggctcgaaggcgccggcctcggcgagcgctgctcagcttcaagcctggaggagcctcccactcaccaacgaacccctcaaacacctaggcacaggcgggcctccgggcagagcagccgccgaccgggcgctgtccgcccacccaagccaacaactggctcccgaatacatcataatttggaataaaatgtgaaatcc

SEQ ID NO: 41 - DNA, 44 bp, Homo sapiens
  misc_feature 1..44: note = chr1:47696986-47697030
  misc_feature 1..44: note = hyper
  source 1..44: mol_type = genomic DNA
cgcccccaccagcgcctcgatctctcgctcgccctccccccact

SEQ ID NO: 42 - DNA, 606 bp, Homo sapiens
  misc_feature 1..606: note = chr1:47697341-47697947
  misc_feature 1..606: note = hyper
  source 1..606: mol_type = genomic DNA
tgctgagaacaccaacggagcacaatcgtacgcaacgaagaaaacgcagaagggcctcgaagggtccacatctacacaccccaaccgcgcaggcacaccacactcggacacagagcctgtcgccaagaagaccacacttagaagcagccaacgccgcccacagttctcatgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggagcgaagacctcttttgcggacgtggggaaaaagaggaggaaattgatgaagaattcggtgggaggccgcgggttgcttttcccctagaaaaaggccagaatgctcacgtttttccgctacgggggtacgcgtgtggccattttgaggcccggtcctgagcggcggcggcccggcccctcccgcggcccccgctcccccgcccgccccgcgcccgcc

SEQ ID NO: 43 - DNA, 89 bp, Homo sapiens
  misc_feature 1..89: note = chr1:47698006-47698095
  misc_feature 1..89: note = hyper
  source 1..89: mol_type = genomic DNA
cgaggcgcgccggggccgtgtgcgccgcagagataaggcactgccgcgggtccgcccgcccccgataagcgcctcggccattatgggcc

SEQ ID NO: 44 - DNA, 600 bp, Homo sapiens
  misc_feature 1..600: note = chr1:50882808-50883408
  misc_feature 1..600: note = hyper
  source 1..600: mol_type = genomic DNA
atctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgct

SEQ ID NO: 45 - DNA, 15 bp, Homo sapiens
  misc_feature 1..15: note = chr1:50883962-50883977
  misc_feature 1..15: note = hyper
  source 1..15: mol_type = genomic DNA
ccatccactgagagc

SEQ ID NO: 46 - DNA, 333 bp, Homo sapiens
  misc_feature 1..333: note = chr1:50884020-50884353
  misc_feature 1..333: note = hyper
  source 1..333: mol_type = genomic DNA
cgcagcctctgaattctcatgaattcccagccttttggaaagggggccgggtgaggctggaagagggatccggaggtaggagatgaggacccaggccgcgcaccccctccgagaacacctgcacctgtctgtagctgctccccctttgctcagccttccccacccaccctcctaaacaaaacccaaaaaccaccttagagtgagaagacgcccagccagggcgcagagagagcgctgggcgaagaggggtcgatggcccgcgggaacagggctggggttcctgtttggggaccggccggctgccaggcccctcgccctactgcttctccggag

SEQ ID NO: 47 - DNA, 198 bp, Homo sapiens
  misc_feature 1..198: note = chr1:50884690-50884888
  misc_feature 1..198: note = hyper
  source 1..198: mol_type = genomic DNA
cgccatggcgccggccagcaagggtctgtggtgcggaggtgcggcgggccccgcctgcagcggcgcaggcagcccaggccccccggcggcggcggcggcggcggcggcggcgtcgacgcggctgggccacgcgtcgtctgcagctgctgcagcacccacggcggccttatctgggggcgccgcagggcccaggccggc

SEQ ID NO: 48 - DNA, 634 bp, Homo sapiens
  misc_feature 1..634: note = chr1:50886451-50887085
  misc_feature 1..634: note = hyper
  source 1..634: mol_type = genomic DNA
caaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtag

SEQ ID NO: 49 - DNA, 60 bp, Homo sapiens
  misc_feature 1..60: note = chr1:50887175-50887235
  misc_feature 1..60: note = hyper
  source 1..60: mol_type = genomic DNA
gggcacgctgggcagctccgagcgcagctccatgacaggacctgacgggaaagaaggtgg

SEQ ID NO: 50 - DNA, 322 bp, Homo sapiens
  misc_feature 1..322: note = chr1:50891148-50891470
  misc_feature 1..322: note = hyper
  source 1..322: mol_type = genomic DNA
aagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgc

SEQ ID NO: 51 - DNA, 504 bp, Homo sapiens
  misc_feature 1..504: note = chr1:54203828-54204332
  misc_feature 1..504: note = hyper
  source 1..504: mol_type = genomic DNA
gtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaaca

SEQ ID NO: 52 - DNA, 29 bp, Homo sapiens
  misc_feature 1..29: note = chr1:58715503-58715532
  misc_feature 1..29: note = hyper
  source 1..29: mol_type = genomic DNA
cggccacaacttgggcggctctgtgcggc

SEQ ID NO: 53 - DNA, 322 bp, Homo sapiens
  misc_feature 1..322: note = chr1:58715533-58715855
  misc_feature 1..322: note = hyper
  source 1..322: mol_type = genomic DNA
gccctcgcctgcgcctttgcgcgccacccaaaactttgcgcacactgcagccgccgccttcccgctcttcgcggtgagacgcgcgccgccaagtgccgcaggcagccctccacagccgccgcggcagccgctgcctggcttctggctccagacttttcccccactgcctccagttcccacccaggaggctccctcgcggccgcgagagctcggcgcccgacccacagtaggcagtgcgggcacagtgttgcagaccaccacctcgccaggtccgggcagcgcccactagacggacaggcgcccgcggccgcccctaccccgg

SEQ ID NO: 54 - DNA, 15 bp, Homo sapiens
  misc_feature 1..15: note = chr1:58715978-58715993
  misc_feature 1..15: note = hyper
  source 1..15: mol_type = genomic DNA
cgagcgggctccgct

SEQ ID NO: 55 - DNA, 342 bp, Homo sapiens
  misc_feature 1..342: note = chr1:63539509-63539851
  misc_feature 1..342: note = hyper
  source 1..342: mol_type = genomic DNA
aaaaacaaagccaagcgaagtgggcctgccagagttaactatgttcacagagtgcaattaagtgtttggaaggttctgtgccgtgtgctctgatttacggccgcgttcctgggacgcccctttagccgggcgaacgtggagggggccaggcccggccgtgcgcaccctgggagcggagccgggccgctggcgctccgggtcttgggcttggcaccgcggcgcaccgggtggcaagcacagcgcttagcggaggccacacctgcacctcatttgcttctgagcagtgccatgacccgcctgctgatggggcgccttccctttcatcctcgggattatgacaag

SEQ ID NO: 56 - DNA, 306 bp, Homo sapiens
  misc_feature 1..306: note = chr1:63784987-63785293
  misc_feature 1..306: note = hyper
  source 1..306: mol_type = genomic DNA
ctctcctgggaagttcgcttgttgagactcaaagagtcactcaaactcataattgcgtgtgtgtgtctactcattctccctctatctctccaataaccctttgagactcagaaactttttatccacatacaccctttatcacattttcttccccccactacatgtgtctcactttctctctgtatctgtctcgcttcttccgtctctgtcctacagcttggcggtaactgacgacctgtgagcttttagctgcaaactgcaactacgcggcaaacaatttatttagcccgacatctagccggtctc

SEQ ID NO: 57 - DNA, 149 bp, Homo sapiens
  misc_feature 1..149: note = chr1:63785618-63785767
  misc_feature 1..149: note = hyper
  source 1..149: mol_type = genomic DNA
ggacccagcatcagatggtaacactgattgaacaagagattagcacaatagatctctaaccgaggggaagcgttgcttttcacgctacgcgccgtaattaatggtatgaatcaattaatttgacttttattgtgtcgaaggaaaaaagc

SEQ ID NO: 58 - DNA, 251 bp, Homo sapiens
  misc_feature 1..251: note = chr1:63786078-63786329
  misc_feature 1..251: note = hyper
  source 1..251: mol_type = genomic DNA
gccccgggcccctgcctttagggctgggcaacccaagcagagcaaaggaggttcctgaatgtgtaaatttccgctttttagctttttttttttttttttttggaccttccgacacttcggttgctgaggcagttgcagacgcgacctctgcagtcctgggcgatggccagccagctcagctcgggtcggtttcgcggaaagctgtctagacggcattgtaaacggttcggagcctgcgggccacaaagctg

SEQ ID NO: 59 - DNA, 280 bp, Homo sapiens
  misc_feature 1..280: note = chr1:63789217-63789497
  misc_feature 1..280: note = hyper
  source 1..280: mol_type = genomic DNA
cctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttc

SEQ ID NO: 60 - DNA, 31 bp, Homo sapiens
  misc_feature 1..31: note = chr1:63789728-63789759
  misc_feature 1..31: note = hyper
  source 1..31: mol_type = genomic DNA
ggctcacagctcggcccgggcctgcagctgc

SEQ ID NO: 61 - DNA, 584 bp, Homo sapiens
  misc_feature 1..584: note = chr1:63795350-63795934
  misc_feature 1..584: note = hyper
  source 1..584: mol_type = genomic DNA
agacagacacagacgcgccgggccggtggaactcagctccgggaaggctgtggacctggaccctggggctccccgctgcctgggcgcctctagcccggcgatgagtggttctgcggggaccgacggccccatttccttcttgcctcgtgatgtgggagggaagaaagaaggcggcaactgcaggcccgaagctcccctcgcccagcggcccaaccacagtgctgtcgtgtcggggatcggtccccaagggagcccccaaccccctgcccacgccgagatcacccccgtgccaacctcgagggctcggcctgcgggactccagctgcccctgcctggagggagggaagggagaagagaatacgaattaattacgaaggaaacccaggtgtgaaaggcacccgccgcggagctgggcgtgcagcggggcgcgcggtgggacctctgctcccgtccccgtcccgcggctactcagttgcccgctcatgggaggctcgcgacggaaaataaatcccctcagagtgaacctgggaggccgagaggacccagcctgggatctctgggggaaataggggcaagtttaccac

SEQ ID NO: 62 - DNA, 218 bp, Homo sapiens
  misc_feature 1..218: note = chr1:63795935-63796153
  misc_feature 1..218: note = hyper
  source 1..218: mol_type = genomic DNA
gtttaattaagccacagccctagcacgaggaccccggcgacccatccgggctgggggatggactggagtgccccccaccccaggccgcgaaccggcagcgagaagcacactctccgccatccccggccccgccgcttccgcctctgcggactccgcgtttgccatgctccttcccggggtccagggaccggagctgcggtgcacgtcttattgaaggg

SEQ ID NO: 63 - DNA, 462 bp, Homo sapiens
  misc_feature 1..462: note = chr1:66998790-66999252
  misc_feature 1..462: note = hyper
  source 1..462: mol_type = genomic DNA
agctgcagccccagtcggttgcgagaaaagctccccacctggggaagcgaggccgctcccgtgtgcgctcggcggggaggacgcggtggcggcgggactcgaactcggtcgtcgaagggcgccccgcagggtcccgtctgtagcccggacggcgagcccaggttggagtgggagggagccggcgtgcacagctgtctttggtcgggctcaggcttccgctccctgcctgctcccctttccagcctcccgccccagaaacgatctcgagcgttgccagtttgattccagagccccactcgggtgggttcttttgtttctttgttttaatgacagttcccagcccttcagcatgtcatgcgcaattaattccctggctctcacgaaggcagctggggtgaaatttcttctgcatcatccttttggggatgtttatgatgtgacgtcagtcggattgatttttct

SEQ ID NO: 64 - DNA, 378 bp, Homo sapiens
  misc_feature 1..378: note = chr1:67217965-67218343
  misc_feature 1..378: note = hyper
  source 1..378: mol_type = genomic DNA
agttcccctccagctcgccgccaacccaggacgcagcccggctcagagtgacccccagtgggcagtgaagatgagatcctctacatccttagggcagctcagagggccactcagcggccaagtccggccggggagggccgagggctctgtttgaggtcaccctggagaccggcctcagagtccagggagagtgcgcgggcggccgccggctgaatgaagcctgggacgcgggagccgcgccgcgcgcagtgtctgcagtgccggaggtctgggaggctccgggcgaagcctccctgctgcaggtagggtcgcctctctctgcagcgcgtctggaccccaaaggaaggatagggggcaagggatcggccctttgttgag

SEQ ID NO: 65 - DNA, 151 bp, Homo sapiens
  misc_feature 1..151: note = chr1:75596708-75596859
  misc_feature 1..151: note = hyper
  source 1..151: mol_type = genomic DNA
agccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccc

SEQ ID NO: 66 - DNA, 418 bp, Homo sapiens
  misc_feature 1..418: note = chr1:75596929-75597347
  misc_feature 1..418: note = hyper
  source 1..418: mol_type = genomic DNA
cgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccc

SEQ ID NO: 67 - DNA, 218 bp, Homo sapiens
  misc_feature 1..218: note = chr1:77334168-77334386
  misc_feature 1..218: note = hyper
  source 1..218: mol_type = genomic DNA
cgcccgcccgcagcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggac

SEQ ID NO: 68 - DNA, 119 bp, Homo sapiens
  misc_feature 1..119: note = chr1:77334408-77334527
  misc_feature 1..119: note = hyper
  source 1..119: mol_type = genomic DNA
cggagtggcggaccacaaggtgacagcatgcccgccagcccgctcgccactcagcctggggatcccgcacacctgagccttccccctttcccggggctgggaggcgctgtgagtaggtg

SEQ ID NO: 69 - DNA, 417 bp, Homo sapiens
  misc_feature 1..417: note = chr1:91177840-91178257
  misc_feature 1..417: note = hyper
  source 1..417: mol_type = genomic DNA
ggattgcagtgccttcgctgcaatgttttcaccgggggtgtggggtgcctgggatggggctggacaatggattaagggctggctgtcccccaggccctaggccgtggatgagcacacggggcaccaggggccgctgcagctggggatggggtgctggaggagtccggtacatgctgctgtacatggcagcggcagccgccgccgccgtagtgctgtccatgctgcccagcaggcttgggtgatagaaataaggcgatggaaacatcctctgcagcgccgagtagttccctgcctcggccagcaactccaggcccaccgctgtctgccgcttccacttggtcctgaaagaaagcgggtgtgcaggcacccagcagctgtgggcatggtccaggcaccaagacccggccccttctctgg

SEQ ID NO: 70 - DNA, 241 bp, Homo sapiens
  misc_feature 1..241: note = chr1:91181807-91182048
  misc_feature 1..241: note = hyper
  source 1..241: mol_type = genomic DNA
catcccttttatcaacgaaaagtatttcctgtcggatgccctccgccgcccctcaacccccagtagattaaaattaaataaaacaaaggaaggagctggatggccgtgaaggttgtggggtagaacaataaacagaacttcgaggagtccccacatcgcacgcccaggcctcccttcagctgcagtcttttgaccgtcgcccagtcgcccgagaagctcctggaatcgctccccagcagag

SEQ ID NO: 71 - DNA, 481 bp, Homo sapiens
  misc_feature 1..481: note = chr1:91188983-91189464
  misc_feature 1..481: note = hyper
  source 1..481: mol_type = genomic DNA
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctc

SEQ ID NO: 72 - DNA, 269 bp, Homo sapiens
  misc_feature 1..269: note = chr1:91190137-91190406
  misc_feature 1..269: note = hyper
  source 1..269: mol_type = genomic DNA
ttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtcccta

SEQ ID NO: 73 - DNA, 233 bp, Homo sapiens
  misc_feature 1..233: note = chr1:91192344-91192577
  misc_feature 1..233: note = hyper
  source 1..233: mol_type = genomic DNA
gctgcttgggtcagacgtcccaggcatggtgctgactcccgccaccttggagccccgagctgagcctcgggcagaagatgacaggccagccgtggggcaaggaggccgcggaaacgcggaacggcttcggggagacggaagcgcccaatgagattcaccctgcagcccgggtccagcccaccttcctcggagattgccgcggccctcgaacccgggcctaggtcttcatgtcc

SEQ ID NO: 74 - DNA, 54 bp, Homo sapiens
  misc_feature 1..54: note = chr1:91192681-91192735
  misc_feature 1..54: note = hyper
  source 1..54: mol_type = genomic DNA
cgactctgggccaggccccaaggaccgccccggcctctccggctttgcggggag

SEQ ID NO: 75 - DNA, 242 bp, Homo sapiens
  misc_feature 1..242: note = chr1:91195148-91195390
  misc_feature 1..242: note = hyper
  source 1..242: mol_type = genomic DNA
cgggggactgcgggccgcccgcgctgcagggccgcgggtcaccgcagggggcgccggggcgctacgggtcctcgggcctggtcttttccggtccctgcccgagcccgcgcctttcccgcctttcgggggagaaacctgcctggacactggaactgggagaaagcagcagcctaattgctcttccgatcgtcgcttgggaaaggggggcttcacatttagaaacttctcgcacctttctctct

SEQ ID NO: 76 - DNA, 450 bp, Homo sapiens
  misc_feature 1..450: note = chr1:108506627-108507077
  misc_feature 1..450: note = hyper
  source 1..450: mol_type = genomic DNA
cttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctcacaccatctccgga

SEQ ID NO: 77 - DNA, 228 bp, Homo sapiens
  misc_feature 1..228: note = chr1:108507148-108507376
  misc_feature 1..228: note = hyper
  source 1..228: mol_type = genomic DNA
cgaagtggtcccaaagcagaaggctgggaagcagggcaagctcagcgcacctagacgtttgcatttacacaaagaaattagccgcatgattaatgggagctgccggctggaggcggggcgcccgtgccggcctcctcacctgggacatctgcggcctcaggttgatctccttcaggttgatggagtgcgcccggaggttgttaagcagctggcagagcaggactccat

SEQ ID NO: 78 - DNA, 113 bp, Homo sapiens
  misc_feature 1..113: note = chr1:108507494-108507607
  misc_feature 1..113: note = hyper
  source 1..113: mol_type = genomic DNA
cgacggctccgggacgcggctgggccggggcgggcggcaaggatgcggccgccgccgccgccgccgcggttcctccgcgccccgccgacgccaacagccgccggccctttccc

SEQ ID NO: 79 - DNA, 550 bp, Homo sapiens
  misc_feature 1..550: note = chr1:108507657-108508207
  misc_feature 1..550: note = hyper
  source 1..550: mol_type = genomic DNA
cgctaggctcggctccggtcccggcccgggtgcgccgcgacccggccgccgctgcagcgagtcccgcgcgctctccgtgcgccccggccggctcggcggcggctgccgcgcacaggcttccgactccagcgcccggcccgccactgagcatgcccagcacgccggccggtctcgctgcggtccgcaagtccccagacgcgcgggtgggagcgcgccggcggccggggctggggtctgtggccgagggcggggcgcgggggaggggccggcggaggggggcggcggccagaaaggggatcccgcgcccccgcctgcagccttgcggggctcacgcagcccccggcgtcctggggtcttctctcggggcggcttcccggctttgcggggagtgtggctgaatactgtaatacgatggggtcccccaggaccccctaaacaacaaatgctcaaaggagcgacggattaattggggcacccagactccccagagcaatgaaaaaagtgcctagagcatcagtagagcacggcgctgaaagttttagagatcgtc

SEQ ID NO: 80 - DNA, 340 bp, Homo sapiens
  misc_feature 1..340: note = chr1:108508208-108508548
  misc_feature 1..340: note = hyper
  source 1..340: mol_type = genomic DNA
ccccctcgccccttgcagctctatcccctccattctctatagctgattcctcagcctattcctcctagttgcccctagtggtgttttggcaccctcaaagtgagtgagagtgcgtgtgtggagacgcctgcggaaaccgccccgatccctgagcctatttcctcgcgaggtgattttcacttggagctggtttgcccctgcactgtcaggctcggaactgtttgccgttgctgttctggcccttttgctgaccccacaaaaacctgcttgagaaaggcctgtgccacggtgctagactgcgcatgcgtcggcgactggcggccgggtttgagagcaaagc

SEQ ID NO: 81 - DNA, 38 bp, Homo sapiens
  misc_feature 1..38: note = chr1:108508549-108508587
  misc_feature 1..38: note = hyper
  source 1..38: mol_type = genomic DNA
cgttagccctgggcagctcctgccgggctgttctggga

SEQ ID NO: 82 - DNA, 312 bp, Homo sapiens
  misc_feature 1..312: note = chr1:110610586-110610898
  misc_feature 1..312: note = hyper
  source 1..312: mol_type = genomic DNA
gtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaac

SEQ ID NO: 83 - DNA, 232 bp, Homo sapiens
  misc_feature 1..232: note = chr1:110611045-110611277
  misc_feature 1..232: note = hyper
  source 1..232: mol_type = genomic DNA
cgttgaacaccggcaagagcgccagaggctagcggccgccaggatctctaccaggctctgctcgcacccgcctgcctccctttcgtttggcctgtcctccgttcaactgaaatcgttaattttcttacccccttgttctcattttgatatattctacgctttaaacatgctccgttttcttttgtttagtctgctccctccctctttgtcctttcccccttctctagttatc

SEQ ID NO: 84 - DNA, 80 bp, Homo sapiens
  misc_feature 1..80: note = chr1:110611434-110611514
  misc_feature 1..80: note = hyper
  source 1..80: mol_type = genomic DNA
cgctttctttggttttctttctcggtatttcgttgtcaaggccacccttgccgtcggatcccggggtgctgggtttctcc

SEQ ID NO: 85 - DNA, 141 bp, Homo sapiens
  misc_feature 1..141: note = chr1:110611653-110611794
  misc_feature 1..141: note = hyper
  source 1..141: mol_type = genomic DNA
gctgagccaggccgggtacctgtctctggcggtgctcaccgcactgcgcggcctctgccgtctggctgggatcagaggagccaggccaactgcttctcattaagtcccaactgtggtttttatcaggaaagcctctttcaa

SEQ ID NO: 86 - DNA, 595 bp, Homo sapiens
  misc_feature 1..595: note = chr1:110692902-110693497
  misc_feature 1..595: note = hyper
  source 1..595: mol_type = genomic DNA
gggcagaagccctggcgagggctccagggtctgcatcccctgaccaggggcctcaagaagctaagcccccttgcaactccctctcccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacg

SEQ ID NO: 87 - DNA, 433 bp, Homo sapiens
  misc_feature 1..433: note = chr1:110693736-110694169
  misc_feature 1..433: note = hyper
  source 1..433: mol_type = genomic DNA
cgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcg

SEQ ID NO: 88 - DNA, 239 bp, Homo sapiens
  misc_feature 1..239: note = chr1:111216734-111216973
  misc_feature 1..239: note = hyper
  source 1..239: mol_type = genomic DNA
ccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggc

SEQ ID NO: 89 - DNA, 381 bp, Homo sapiens
  misc_feature 1..381: note = chr1:111217194-111217575
  misc_feature 1..381: note = hyper
  source 1..381: mol_type = genomic DNA
gccacagccgccttgaggcggggcccctccaccatcggccacctccggctccagcaggtggtccccgggcaccacggtcatgtcgggcggcagctcgcggcctgcggcgggctccgcgtagccgtggttcaccagcgtgtgggcaccgccgctgctcgctgggcgctgaggagggtgggcgcggtggcgggctgagggcggcggcggcgagcgcagaaggctgaggcgctcgtccatgcggcggggaagaggcggcagcggtgaggccaggtcgctcctcctcgcgctccccgccctttcgccgcctccgcccccgagccgagcccaccgcctgttgcagccaaagccgcgatgctctgtctgggtctggcgcggtcagcc

SEQ ID NO: 90 - DNA, 136 bp, Homo sapiens
  misc_feature 1..136: note = chr1:111217576-111217712
  misc_feature 1..136: note = hyper
  source 1..136: mol_type = genomic DNA
ggctcccgcacggggacgcctcctccctccttctcgcgctctccgccccctcccctgcggggcgcgcgcccgcctccgcgtccccttaggattcccgcccaccgcgcgggcgcgcgtcccgctctcgggggcagcc

SEQ ID NO: 91 - DNA, 179 bp, Homo sapiens
  misc_feature 1..179: note = chr1:111217713-111217892
  misc_feature 1..179: note = hyper
  source 1..179: mol_type = genomic DNA
ccgggcctgcatttcttgcagccctcaaggcccctcggtgtcagcgaaagagccctcatgttgtacctcggcgccccgcgggaatgcccacccagcagagccggcccacggggagtcaggctgccggcccgggcccctaggctccgcccgcttctggtcagcgcccctcgcccccggcc

SEQ ID NO: 92 - DNA, 93 bp, Homo sapiens
  misc_feature 1..93: note = chr1:111217923-111218016
  misc_feature 1..93: note = hyper
  source 1..93: mol_type = genomic DNA
cggcccgtgggccgggagagctcccgccgcggccccgcgggcgccggccccctggcctccacacccctaggtacagcccggggagggcaggcg

SEQ ID NO: 93 - DNA, 285 bp, Homo sapiens
  misc_feature 1..285: note = chr1:119551013-119551298
  misc_feature 1..285: note = hyper
  source 1..285: mol_type = genomic DNA
cggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgt

SEQ ID NO: 94 - DNA, 15 bp, Homo sapiens
  misc_feature 1..15: note = chr1:154474763-154474778
  misc_feature 1..15: note = hyper
  source 1..15: mol_type = genomic DNA
tgctctttcctcctg

SEQ ID NO: 95 - DNA, 81 bp, Homo sapiens
  misc_feature 1..81: note = chr1:154474987-154475068
  misc_feature 1..81: note = hyper
  source 1..81: mol_type = genomic DNA
cggggtgagcgccatggcagaggcgggtcgggctgcgagctctggagaaaggggcggcggccgcacgtgcggatcggccgc

SEQ ID NO: 96 - DNA, 173 bp, Homo sapiens
  misc_feature 1..173: note = chr1:154475371-154475544
  misc_feature 1..173: note = hyper
  source 1..173: mol_type = genomic DNA
gtggccgccggggattggctgccggcaagccccgccccgtgcccccgggctcagagggggcggagcgcggagggagaaggcgcgaaggctgggcgtcgcgatcgcaggtgcacgcgcgtggcccgcgagacgaggtatggcttgtcggccccaggtcccgggatgccaggcga

SEQ ID NO: 97 - DNA, 662 bp, Homo sapiens
  misc_feature 1..662: note = chr1:156357865-156358527
  misc_feature 1..662: note = hyper
  source 1..662: mol_type = genomic DNA
ttctccggaagcagccgctgttctggcttggcgcaagtgcgtgtggacgacagcaggatttcctgcccagggacatctggataagaggcccaaggtccccaggagcccccaggtgcttctgccctgtgtggccagagccccctcggccaggagttagaagctgctcctctgacctctggaggacccggcactccgaaccccgcgcagcctgggaaaggcctgagattccccgctattgggattcacatcacgacgcggcggccccaactcggggaggaattagacacggcgtgagtgtcccaagtgcggggcggtggccgtcccggggcagacgagcgcggctgccgcgtccccccacctcaccccgatattccgctcccaccgtcgggaactcccccaccgccgcctccggccctgcgcgccccttctcctttgtctggcccgcccactcccagccggtccgccgcgccgccccgcgcgccccggcccgtgcgcccgccgccgccgcccaggaacaatgcgggccaatgtctccgggcgggcgagccggctatgcaaatgcccaacggcctgtgagaatccccttcgccgccgcctgggcttccacggcctgaaaagggctggcggccgggcctgggtgggggaggcggccactgcatagg

SEQ ID NO: 98 - DNA, 714 bp, Homo sapiens
  misc_feature 1..714: note = chr1:156390135-156390849
  misc_feature 1..714: note = hyper
  source 1..714: mol_type = genomic DNA
ggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaa

SEQ ID NO: 99 - DNA, 425 bp, Homo sapiens
  misc_feature 1..425: note = chr1:156863061-156863486
  misc_feature 1..425: note = hyper
  source 1..425: mol_type = genomic DNA
cggtgcccgggaggggtcttaataagatcacggttgctgggcagcactggacagtgcccgacgtaggcgatctcattgattccttcccacaaccccactttgcagataggaaagctgaggcacgagagggtaagtaacccaggccgcacaacgaggggaagctagggagggactggggccctgggcccctgcgctgacctcccctcctcatccccttcttatccccctctgctcctggcccaggccgcgcagagtcggcctctgtgatcccacccagaatacagttttccctcccgggcgcctggatctcccctcccccggctcctgtttccttgtcaaaacttcctgccttggcgagggcccgagttcccacccccttcctgccccccgcccctcggcgcccctcccggccctgcgatcagcag

SEQ ID NO: 100 - DNA, 69 bp, Homo sapiens
  misc_feature 1..69: note = chr1:156863640-156863709
  misc_feature 1..69: note = hyper
  source 1..69: mol_type = genomic DNA
cgcgccccctggcaggggaggcccggtggtgcggccccggagaccaccctgccccggggaaagggcttg

SEQ ID NO: 101 - DNA, 278 bp, Homo sapiens
  misc_feature 1..278: note = chr1:169396357-169396635
  misc_feature 1..278: note = hyper
  source 1..278: mol_type = genomic DNA
agactcggtggacctcggactccagaggataaggcgccaccagaaagcttcttccctcactacctaccctccctcccagctataccagacgtttatacctttaccctctatcccaccattaacatctccgcatcgtccttcccttctctccctctatatccctcttgcctgtgtaaaatgcggcggctgggatcacagagatggccgggggagttctcctctcctcctctttctaagctcttcacattgaggcaaaggagaccccggcacctgcctcc

SEQ ID NO: 102 - DNA, 53 bp, Homo sapiens
  misc_feature 1..53: note = chr1:169396636-169396689
  misc_feature 1..53: note = hyper
  source 1..53: mol_type = genomic DNA
cggcagccaggaccacactgccatggcaacagcgtgcctctgcgtcctccatc

SEQ ID NO: 103 - DNA, 193 bp, Homo sapiens
  misc_feature 1..193: note = chr1:169396730-169396923
  misc_feature 1..193: note = hyper
  source 1..193: mol_type = genomic DNA
cgcatgcaatatcctcagaccaccgacccctcccggcacccatcccggtgcttgcgaagggccagtgaagctgaggtttctaaggggacgactaaggaatccacgcatcactaacgttatagagactcgcgaagtgccgctgtgttggttgtgaaatttccctcttgtagctgtctctcgtcagatttagaat

SEQ ID NO: 104 - DNA, 144 bp, Homo sapiens
  misc_feature 1..144: note = chr1:170630458-170630602
  misc_feature 1..144: note = hyper
  source 1..144: mol_type = genomic DNA
ctgggaagggaaaaacggcccacatcgaactggatgccggatggaaacctctctgcgctattagactgcgtccagtacagcagatggcacgagcacgtgcggcgctcagcttaggctctcggaggcagctgagttggaaatccc

SEQ ID NO: 105 - DNA, 207 bp, Homo sapiens
  misc_feature 1..207: note = chr1:170630603-170630810
  misc_feature 1..207: note = hyper
  source 1..207: mol_type = genomic DNA
acggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatggg

SEQ ID NO: 106 - DNA, 595 bp, Homo sapiens
  misc_feature 1..595: note = chr1:171810200-171810795
  misc_feature 1..595: note = hyper
  source 1..595: mol_type = genomic DNA
cctgggaggagtcatcgcggattctggagaagggcgtgacagaggagatttcctttcgggaagtgtagtctggcagcggtgccccggtggtggcggcggcggtgctgctgttgctggtgatcgtgtggtggtgttagcggcgatagtgctttccactgggctttggcttggtagccgctgaaagagaacaacgctgccgctgctgctgatttcatgccatttcctgacccggcgctgtaacttggcctctgagccttggccacagaacgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaa

SEQ ID NO: 107 - DNA, 62 bp, Homo sapiens
  misc_feature 1..62: note = chr1:197879599-197879661
  misc_feature 1..62: note = hyper
  source 1..62: mol_type = genomic DNA
gtatagaatgcatgtcgttaccaaatacctagaacggtattggaccgcaaagaggttaaacc

SEQ ID NO: 108 - DNA, 508 bp, Homo sapiens
  misc_feature 1..508: note = chr1:197879716-197880224
  misc_feature 1..508: note = hyper
  source 1..508: mol_type = genomic DNA
cgccgtccatccattcgatggcctcgctgatgagcatagaagatgaacccgggaggactgtcccttcctggctgcgaaacctgaccgatataggggagattctagaagaaagagctaaggaggccagggcggaaagaggaaagtcaggtgtaggggagattaaaaggtaaactggtgggactgaccgggctggtgggactagttagcgaagccaagtgtttgggtagaaacagagatcttgtaggaggtgctccgagctacatttcgggatttgggatgaaaagagaaagccagggggttcgccgctcctggtttgttccttaccgaccctaaactgtatggcggagcttgtgggtcaggcgtggaggcggcatccactcccacgtgccccacatgcagcagcaatcccacgcggttttcgcaagcggctgggaggcaagcgggcgtccccccacaccccccccccactgcgccctggacccacgccacgcaccgccaaggagtagct

SEQ ID NO: 109 - DNA, 160 bp, Homo sapiens
  misc_feature 1..160: note = chr1:197886907-197887067
  misc_feature 1..160: note = hyper
  source 1..160: mol_type = genomic DNA
cttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggag

SEQ ID NO: 110 - DNA, 311 bp, Homo sapiens
  misc_feature 1..311: note = chr1:197887146-197887457
  misc_feature 1..311: note = hyper
  source 1..311: mol_type = genomic DNA
cggcggtagccgggcacccctgcgccctctgttaaaccaagccgactccctggccggtggagaaccggagcggcgggtcgtagagacgtccgcttgagggtggcgggtgagttttctcccgtccacctatgcctacagggctaagaaacggtcgtttttctgaatcgaaatgtctgcagctggctatcctccgtcgcagctgattccgaaagagcagggagaggaactgggaggaggtgggatggggggtggtggcattctcttctacagacctcaaggttcccttgattccggggcaggcgtctccccgg

SEQ ID NO: 111 - DNA, 416 bp, Homo sapiens
  misc_feature 1..416: note = chr1:197887706-197888122
  misc_feature 1..416: note = hyper
  source 1..416: mol_type = genomic DNA
cgtttagcgccaggacccggcgggtgtcatgtgtagggggaaatcaaataaaacatacggaggagcgcggcacccagtcgaaacgcatgaactttataaccaacccttaaacaagctaatcaaccaccactgtttctactatccataataataaagtcatgtcctcttaataaagaaaactaattacttatctaagcgcttccctttccagattactaacggggggggggggggactacagaagtctccggaaattatttcggccaaacatagctgtgtagatcctttggtaccacagtaggacttgtagcccaaactaatcaggagactgctctagcccttatcagctgggttttgggtccggccaagtagcccaactggtgaacgtgtctatatttgtaacactcattcagtgc

SEQ ID NO: 112 - DNA, 45 bp, Homo sapiens
  misc_feature 1..45: note = chr1:197888180-197888225
  misc_feature 1..45: note = hyper
  source 1..45: mol_type = genomic DNA
cgtggggaagatcaacccatttctgctagtcgtgagggaaatgtc

SEQ ID NO: 113 - DNA, 299 bp, Homo sapiens
  misc_feature 1..299: note = chr1:200009750-200010049
  misc_feature 1..299: note = hyper
  source 1..299: mol_type = genomic DNA
gctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggt

SEQ ID NO: 114 - DNA, 376 bp, Homo sapiens
  misc_feature 1..376: note = chr1:205312536-205312912
  misc_feature 1..376: note = hyper
  source 1..376: mol_type = genomic DNA
gcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtcca

SEQ ID NO: 115 - DNA, 407 bp, Homo sapiens
  misc_feature 1..407: note = chr1:207669381-207669788
  misc_feature 1..407: note = hyper
  source 1..407: mol_type = genomic DNA
ggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccc

SEQ ID NO: 116 - DNA, 232 bp, Homo sapiens
  misc_feature 1..232: note = chr1:207669828-207670060
  misc_feature 1..232: note = hyper
  source 1..232: mol_type = genomic DNA
cgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagcc

SEQ ID NO: 117 - DNA, 810 bp, Homo sapiens
  misc_feature 1..810: note = chr1:215255060-215255870
  misc_feature 1..810: note = hyper
  source 1..810: mol_type = genomic DNA
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatggg

SEQ ID NO: 118 - DNA, 110 bp, Homo sapiens
  misc_feature 1..110: note = chr1:223936643-223936753
  misc_feature 1..110: note = hyper
  source 1..110: mol_type = genomic DNA
tccggcggtcccgcccggcagtaggacagagggagcgagggagtccgggaggaagggagagcgggtgcggccagtctgacggttgctgtgtttgcagatcaccagcgccg

SEQ ID NO: 119 - DNA, 62 bp, Homo sapiens
  misc_feature 1..62: note = chr1:223936995-223937057
  misc_feature 1..62: note = hyper
  source 1..62: mol_type = genomic DNA
cgggcgccgggtgcgccgcgctgccacctggtggccgcagtggccggcgccaggggccctgg

SEQ ID NO: 120 - DNA, 62 bp, Homo sapiens
  misc_feature 1..62: note = chr1:224804625-224804687
  misc_feature 1..62: note = hyper
  source 1..62: mol_type = genomic DNA
ccctccagcgactctcgacacacgttttcctgtcttcgccggagggccgggtctggggtcgc

SEQ ID NO: 121 - DNA, 270 bp, Homo sapiens
  misc_feature 1..270: note = chr1:224804846-224805116
  misc_feature 1..270: note = hyper
  source 1..270: mol_type = genomic DNA
cgtgtgtggtgggattggggtccgccggccatggccttcactttcgctgcgttctgctacatgctgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgc

SEQ ID NO: 122 - DNA, 555 bp, Homo sapiens
  misc_feature 1..555: note = chr1:224805197-224805752
  misc_feature 1..555: note = hyper
  source 1..555: mol_type = genomic DNA
cgtcccgggtcccgggcgccggggagtggcggctacaaccacaactaaccccttcctctcccgccccgtcctctcctgccggcgggaggcgaaggagaagcgccgccgtcggtcccggcaattagtcaagtagctataataactaaacatttaaaatgtcagcatctgtggtgggttgcatttagatataattggagacaaagtggaaacacgacgggagcgccttgtaagaggtagggagaagccgagcccacggagaggaaggagaccaggcgatgggggtcgaagtggaaggcggtgggggaaaggcgagaaggagaagagcaaggaggcgagggagactgggaagggcaggcatcattaaggccatggaggaaagtcacgaagagagaccgtggagagcgacgacggtgtcctccatctgccctcttggcgtctgaagtccgactcctgaagaccccctgcaggtggcgaacctccgctaggcccccagcgtccccagcccacacaagcttcctgtcacccttcccggggctacgccaggtggagggcagc

SEQ ID NO: 123 - DNA, 18 bp, Homo sapiens
  misc_feature 1..18: note = chr1:224805848-224805866
  misc_feature 1..18: note = hyper
  source 1..18: mol_type = genomic DNA
cgccggtcctctcaaaga

SEQ ID NO: 124 - DNA, 1554 bp, Homo sapiens
  misc_feature 1..1554: note = chr1:228194949-228196503
  misc_feature 1..1554: note = hyper
  source 1..1554: mol_type = genomic DNA
agcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggc

SEQ ID NO: 125 - DNA, 107 bp, Homo sapiens
  misc_feature 1..107: note = chr1:228633813-228633920
  misc_feature 1..107: note = hyper
  source 1..107: mol_type = genomic DNA
gtcgcaaccacccagcgctgggaacctgagcctgcacaacccactagaaagcacccgtgaccgtcccctgcgcccgttatccctgcgccccgcacccctgtatcccc

SEQ ID NO: 126 - DNA, 29 bp, Homo sapiens
  misc_feature 1..29: note = chr1:228633921-228633950
  misc_feature 1..29: note = hyper
  source 1..29: mol_type = genomic DNA
gcttctctgcagctgtacaccctgcactg

SEQ ID NO: 127 - DNA, 157 bp, Homo sapiens
  misc_feature 1..157: note = chr1:228633983-228634140
  misc_feature 1..157: note = hyper
  source 1..157: mol_type = genomic DNA
cgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggac

SEQ ID NO: 128 - DNA, 470 bp, Homo sapiens
  misc_feature 1..470: note = chr1:228651432-228651902
  misc_feature 1..470: note = hyper
  source 1..470: mol_type = genomic DNA
gagggaggaaaggggcgggagaagaacggacccaagcgcctccgcccagacggcgcgataaccccctcacctccaaccccggacctcagtgagcacgtcctccagtctcagccgccaggaggcactgggggcggggacgtggcacaagatcttcccggaggtgacccacgctcctcgcgcgcagggcgtaagccacacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaaaagagcctttgggttcggggcgc

SEQ ID NO: 129 - DNA, 247 bp, Homo sapiens
  misc_feature 1..247: note = chr1:228652206-228652453
  misc_feature 1..247: note = hyper
  source 1..247: mol_type = genomic DNA
cgcttcttgccgtccttcttctgcgccttggtaatggccttcttggagccctttttagaagccggagccgcccgcgatggctccggcatggcgaggtgacaagagcgcctagacgaacgcggatgcggggccggcagggctatttgccatctttatattcaaattaaggctccaaatttgtagtgtctgattggacggcctgactccgcggccgccactgggaggaatttctgtaaatagcagagtc

SEQ ID NO: 130 - DNA, 34 bp, Homo sapiens
  misc_feature 1..34: note = chr1:228652508-228652542
  misc_feature 1..34: note = hyper
  source 1..34: mol_type = genomic DNA
cgcgccggagctgaggttgcgcatctttgttcaa

SEQ ID NO: 131 - DNA, 140 bp, Homo sapiens
  misc_feature 1..140: note = chr1:229542813-229542953
  misc_feature 1..140: note = hyper
  source 1..140: mol_type = genomic DNA
catgctgaggttggtcgcttgtttcattcactgtctcctacgcagtccatgccacgggggataagtttttcacaagtggctttttttccccacagtgaagagacgtggcctgggtctggagttcctcaaccggcaaaata

SEQ ID NO: 132 - DNA, 124 bp, Homo sapiens
  misc_feature 1..124: note = chr1:229543220-229543344
  misc_feature 1..124: note = hyper
  source 1..124: mol_type = genomic DNA
cgagagggagctctggtccccgaggggctgtcccgggagggagcgaggtggggagggggagcaggccctgccccgagcaccccgcggactgagcgtctggcgtgcacggcggaggggttaccgc

SEQ ID NO: 133 - DNA, 86 bp, Homo sapiens
  misc_feature 1..86: note = chr1:229567191-229567277
  misc_feature 1..86: note = hyper
  source 1..86: mol_type = genomic DNA
cccattgagaagattcgtcgtcctgagaagtcgcgtgctggaggtggagtgtgtctagaagcatttgcggtggacgatggaagggc

SEQ ID NO: 134 - DNA, 624 bp, Homo sapiens
  misc_feature 1..624: note = chr1:229567369-229567993
  misc_feature 1..624: note = hyper
  source 1..624: mol_type = genomic DNA
cgctccggcggggcgatgatctgcaagacagcgcgtgaggtggggagacctcaccctggagcccaccccgccgacagcccgcgcaggccaccacccaccttgatcttcatggtgctgggtgccagcgcggtgatctctttctgcatgcggtcagcgatcccagggtacatcgtggtgccccccgacatgacgttgttggcatacaggtccttcctgatgtcgatgtcacacttcatgatgctgttgtaggtggtctcgtgaatgcccgccgactccatacctggggaccgcggcggggagcgtgagcagaagctcggggcgccgggggccggcggggcctgggggccggggcgagggcgagcggggctcaccgatgaaggagggctggaagagcgtctccgggcagcggaagcgctcgttgccgatggtgatgacctgcccgtctggcagctcgtagctcttttccagggaggaggaggaggcggccgtcgccatctcgttctcgaagtccagggccacgtagcacagcttctccttgatgtcgcgcacgatctcgcgctcagctgcggagggcagaagcaggagaggagccctcactcaggggccgccgccggccctcccgcc

SEQ ID NO: 135 - DNA, 193 bp, Homo sapiens
  misc_feature 1..193: note = chr1:229568157-229568350
  misc_feature 1..193: note = hyper
  source 1..193: mol_type = genomic DNA
cgccggagtccagcacgatgcctgtgcgcgcgcgggagagagtgagtggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggcca

SEQ ID NO: 136 - DNA, 49 bp, Homo sapiens
  misc_feature 1..49: note = chr1:236849457-236849506
  misc_feature 1..49: note = hyper
  source 1..49: mol_type = genomic DNA
gtccctcccctggctcgcgatcacccacccgggacaccgacggaccccg

SEQ ID NO: 137 - DNA, 224 bp, Homo sapiens
  misc_feature 1..224: note = chr1:237206511-237206735
  misc_feature 1..224: note = hyper
  source 1..224: mol_type = genomic DNA
ggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggct

SEQ ID NO: 138 - DNA, 626 bp, Homo sapiens
  misc_feature 1..626: note = chr1:240254860-240255486
  misc_feature 1..626: note = hyper
  source 1..626: mol_type = genomic DNA
gcttcagtttttctccgtgtaaaaatttcttcttttttatttaacttttctcttggcaggtccagcagctttgaagatcagagtgcatcttccagctgacgatctcttcggtcggggacaatgcattcgattcgcacggtggagattaaagtccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgc

SEQ ID NO: 139 - DNA, 672 bp, Homo sapiens
  misc_feature 1..672: note = chr1:240255487-240256159
  misc_feature 1..672: note = hyper
  source 1..672: mol_type = genomic DNA
ctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggac

SEQ ID NO: 140 - DNA, 116 bp, Homo sapiens
  misc_feature 1..116: note = chr1:248020515-248020631
  misc_feature 1..116: note = hyper
  source 1..116: mol_type = genomic DNA
cggccgggagcgcagccctccgggaggcgggtcatggcctgggcgccgcccggggagcggctgcgcgaggatgcgcggtgcccggtgtgcctggatttcctgcaggagccggtcag

SEQ ID NO: 141 - DNA, 341 bp, Homo sapiens
  misc_feature 1..341: note = chr1:248020956-248021297
  misc_feature 1..341: note = hyper
  source 1..341: mol_type = genomic DNA
ggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtg

SEQ ID NO: 142 - DNA, 249 bp, Homo sapiens
  misc_feature 1..249: note = chr2:468423-468672
  misc_feature 1..249: note = hyper
  source 1..249: mol_type = genomic DNA
ggggctcctgcgcgccccttgaaccccgcctcccgcatcctcctgcaacagcctggagctccctgtgcaggacgcagcggggggcggggggcggtcttaggaggctgcggggcgcactcccacctcctgcctccccgagacccccagcgccttctccagggtttagagcggaggtgaaggggcctcgtcctgcaccgccactgggcgcctgggctgttcatcatcggttaccgccgattcataggaact

SEQ ID NO: 143 - DNA, 37 bp, Homo sapiens
  misc_feature 1..37: note = chr2:25438835-25438872
  misc_feature 1..37: note = hyper
  source 1..37: mol_type = genomic DNA
acgacaaggtccgggcgcccagcagaacggcccggct

SEQ ID NO: 144 - DNA, 222 bp, Homo sapiens
  misc_feature 1..222: note = chr2:25439138-25439360
  misc_feature 1..222: note = hyper
  source 1..222: mol_type = genomic DNA
ggagtgcccggcgcccgtcgaaaggcccctgcgccggttcaggacccgcacccagctacgctgcggagccccagctcgcagcaccctcccacccaccgctcctggctgcttttctcctgagtctgcggggcggggtcgtttttgttttttacaaaaatgtatgtaaaggtatttcgatgagtgaaggaacacgctataatgctcactcaatgcagcatcggt

SEQ ID NO: 145 - DNA, 179 bp, Homo sapiens
  misc_feature 1..179: note = chr2:26407743-26407922
  misc_feature 1..179: note = hyper
  source 1..179: mol_type = genomic DNA
gacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgc

SEQ ID NO: 146 - DNA, 279 bp, Homo sapiens
  misc_feature 1..279: note = chr2:30453784-30454063
  misc_feature 1..279: note = hyper
  source 1..279: mol_type = genomic DNA
cggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccct

SEQ ID NO: 147 - DNA, 158 bp, Homo sapiens
  misc_feature 1..158: note = chr2:38302718-38302876
  misc_feature 1..158: note = hyper
  source 1..158: mol_type = genomic DNA
ggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataa

SEQ ID NO: 148 - DNA, 38 bp, Homo sapiens
  misc_feature 1..38: note = chr2:39187200-39187238
  misc_feature 1..38: note = hyper
  source 1..38: mol_type = genomic DNA
ggagccgctgggcaacgtggagcgctccctgcgcgccc

SEQ ID NO: 149 - DNA, 63 bp, Homo sapiens
  misc_feature 1..63: note = chr2:39187544-39187607
  misc_feature 1..63: note = hyper
  source 1..63: mol_type = genomic DNA
gcaaggccaagccgctgagccgctctctcaaagagttcccgcgtgcgccgccagccgacggcg

SEQ ID NO: 150 - DNA, 392 bp, Homo sapiens
  misc_feature 1..392: note = chr2:40678497-40678889
  misc_feature 1..392: note = hyper
  source 1..392: mol_type = genomic DNA
cacctccctcctctccgcagtccgtggtgaatgagcacccaacgcccgctggaaaacagggggctcggaaatgtggccttggggaaagaccccagggattaccggaaggagggatgtccgcggagaagagtccagtgggtggggacgcctggatccccagcagctctgcattcggggtggacttagctcttcgcgccctgaatcctcagagcccagcgcggtgcagggtgcagcatctctccttagcagccctttcttcctccggcagcctgcactggcaggcaggcaggcaccctcacgcccagacgcaccagcccgagcaatttcactctgggaagcgcggacacccagaaaaatgtgcaggcgcgcacacaccacatcacacacacaca

SEQ ID NO: 151 - DNA, 137 bp, Homo sapiens
  misc_feature 1..137: note = chr2:40678949-40679086
  misc_feature 1..137: note = hyper
  source 1..137: mol_type = genomic DNA
aagcagagggaagtgtagccttatgagcagcaaatggaaaatagttcttggtctctgactaaatgccttctgcctgtccatcataagatcctacctggtttggggagtgtgaatggattcttcctccgttcctccac

SEQ ID NO: 152 - DNA, 432 bp, Homo sapiens
  misc_feature 1..432: note = chr2:40679087-40679519
  misc_feature 1..432: note = hyper
  source 1..432: mol_type = genomic DNA
ctagtagaaaatacggcgcactccctccttttaaacagctcccgatcaggaagaggtcgctcccatcttctgtgggaagcacaaagcaggcggcggcggcgggctgactaccgtgcagcgccggcgcgagcgggagccgcggcagcgggcagcggtgcgcgcgggcgggaggcaggcgcggaggccgggaggctgggagggccggggcccgggcgcgcgcgcgctccccctccctcccgcgcacactcgcccgcccgccgcccgcagcctcgcactcgctcacacgcgcgctcggccccgcggctgccgggcgccccggggccccctgcgcgccccttgggctccccaggcgatcgcgtcggggcaaagccggcgcgtttctggagcaccgagcgggtggggagcccttccagcctcccagcctctgccggc

SEQ ID NO: 153 - DNA, 85 bp, Homo sapiens
  misc_feature 1..85: note = chr2:40679520-40679605
  misc_feature 1..85: note = hyper
  source 1..85: mol_type = genomic DNA
agcagctttttcgatttcctgccggctctcggccccgcagtgcgttgtggccgcgcgctagcgctgtctctcgcacccagcccat

SEQ ID NO: 154 - DNA, 119 bp, Homo sapiens
  misc_feature 1..119: note = chr2:45028940-45029059
  misc_feature 1..119: note = hyper
  source 1..119: mol_type = genomic DNA
tccttttaattgtgacggtgcggccgcttgggcgtgatcccttggctggggctgcagggggcccgtcctccaggggcgcagagggaaggaccagcgtttccaagccgggctctggccgc

SEQ ID NO: 155 - DNA, 184 bp, Homo sapiens
  misc_feature 1..184: note = chr2:45029183-45029367
  misc_feature 1..184: note = hyper
  source 1..184: mol_type = genomic DNA
cgacccggcgccgactctcctcctcttctccctgcgagggcccgcgccgcccgggcccagtcctgggggatagatccctcggggcccaacggctgggccaccgccggtctccggccactgctgcgaggacaggcgctgcctaactaatttctcctctaagggggctgtgcgtgcgtctccttcc

SEQ ID NO: 156 - DNA, 86 bp, Homo sapiens
  misc_feature 1..86: note = chr2:45155125-45155211
  misc_feature 1..86: note = hyper
  source 1..86: mol_type = genomic DNA
ttgcttttggtgtgccggcaacttttggttgttgctgctgttgccagtgcgcttagcagagtaggaagctcgaagcgcaaagcaac

SEQ ID NO: 157 - DNA, 636 bp, Homo sapiens
  misc_feature 1..636: note = chr2:45155355-45155991
  misc_feature 1..636: note = hyper
  source 1..636: mol_type = genomic DNA
cgcagttttgcaaatccttttccctctccccatgcctcgcggtttaagaccacgcgatttcccaaaaagaaaaactcaaaagatgccaggcgccgggctggagtcacttagagccagctctggctgctcctccgcctccccgacccccggccgccgctccgccctgcccctcgcgcctcgaccccttctcccgaaactccgtcctctccgccgaggggctgccttgcccccaacccaccccccgcgtggagaataaacacagttgacatcactcttataatctttatttaaaactgtttccaaggttacaaattgccgagcctcgtatgcaacaggttcctccaaagcggtatcattacagattaactgtaatgtgtaggattagaataaaagcataagggattaggtaaaagggcgacgctccagacataacgcccgagcgcatctcgactgagtcagcctagggagactgcgaaggcgcagggtgtcggggcgccacggggccgcaaagccggactcggttcctccgctcccggccctggccccggccccagagcggtcgggacagcggcgccggaaggccaacgcggccgaaggtttcggagccaggcttcccgggcgtcaggggctagggac

SEQ ID NO: 158 - DNA, 820 bp, Homo sapiens
  misc_feature 1..820: note = chr2:45155992-45156812
  misc_feature 1..820: note = hyper
  source 1..820: mol_type = genomic DNA
ggtccccggagctggggaagatgaggggccgagaggccgtggaggcggaggacgcgggcaagccacggcccggctgggagcttcgggaagcgccgcgcccgggacgcggtctccgggcggggcgaagcgcagggaaggcggcgagggggtccccacacccgcacggggcaccgggtttgtccatgtgggtgacactgccttcaaggcccaggcccgatggggcccttcctggcgtcctcctcacccccactccgccgcgcctcccctgtccagctggggctggggacagcggcaggggctgggcagccgcgcaggccgcccgcacccttccgagcccaggcctcgggccttcgccgcccgcccaggccgtgcgccctattggaccaccttccccccggccttcgcctgcccctctcgcgccaggaaggccctggagctccctctccccctcacaccgcttcctgcggggccagggctcgccgtgctggccccatttggactcaggcctgacctgggccacggcctcaggccgctgacgcagccccgagggctgtttgcgtgttggggtggagggcgcggggctggaaaaacaaacagggcgggggcgcggaggtttggggtgggggccgcagggggctggaaggaagtgcgcagtgtggcgagagcgcgaacaaagccctctccggagccccgtcacccctcggtgaccccaggcccgccccgctgagccgcggggctcccgggcctcgcctccgagcaggccgcaccgcccggtgggcgcacgtcaggcctccgcggccgcccgggccagtgctcccct

SEQ ID NO: 159 - DNA, 89 bp, Homo sapiens
  misc_feature 1..89: note = chr2:45156832-45156921
  misc_feature 1..89: note = hyper
  source 1..89: mol_type = genomic DNA
cgcggccggccccgaaggcgcgagggacagcgcggccggcggtggagcctcactcaggcacggagcccacagagcgaggctgaggagga

SEQ ID NO: 160 - DNA, 96 bp, Homo sapiens
  misc_feature 1..96: note = chr2:45157254-45157350
  misc_feature 1..96: note = hyper
  source 1..96: mol_type = genomic DNA
gtatgggatttttgccgtcggagcacctcgtatccggcgcgcgggcccagtgtgggactgcggctgggagcccgggccctccgggagtgaagatac

SEQ ID NO: 161 - DNA, 240 bp, Homo sapiens
  misc_feature 1..240: note = chr2:45171324-45171564
  misc_feature 1..240: note = hyper
  source 1..240: mol_type = genomic DNA
gtatgcagttctacccggagactggccgggcggtggggaacccgcagctcccggtgtgtgtttgagggagcagggacggggttactaggggaactcgaccggtcgcggggcagccggctcagtttgaagagccccagggactgcggagggaagaagcgcccggctcctctccgacttctgcttctccagggcttggcgtactttgtcgcttgcacccaggcctccccaagcggccgggct

SEQ ID NO: 162 - DNA, 43 bp, Homo sapiens
  misc_feature 1..43: note = chr2:45171836-45171879
  misc_feature 1..43: note = hyper
  source 1..43: mol_type = genomic DNA
cgcgcagacaccggcacctccatcctctcggtaacctccagcg

SEQ ID NO: 163 - DNA, 54 bp, Homo sapiens
  misc_feature 1..54: note = chr2:50574631-50574685
  misc_feature 1..54: note = hyper
  source 1..54: mol_type = genomic DNA
ccctccattcagccccggccggctcgcccgctagcgccagcctcccccgggcag

SEQ ID NO: 164 - DNA, 121 bp, Homo sapiens
  misc_feature 1..121: note = chr2:50574738-50574859
  misc_feature 1..121: note = hyper
  source 1..121: mol_type = genomic DNA
cgcctcctgacacttacgcccggcgaggggttcagagggaagagtgcgcccttctgaaggaagtgggaatcgaacggcggaaaggcagctgagaagaagatgcagacgaaggagtaaggga

SEQ ID NO: 165 - DNA, 147 bp, Homo sapiens
  misc_feature 1..147: note = chr2:63275877-63276024
  misc_feature 1..147: note = hyper
  source 1..147: mol_type = genomic DNA
ggcgcctttcctcggaacctaaggaaggggtatatttcgttgctttctttaaacctcagcacgatcacagtggctccgagccgcgggcggctgaccgcgggcctcgcgggctactcctggtaggggcctgcgcgagcctaaggtgtg

SEQ ID NO: 166 - DNA, 699 bp, Homo sapiens
  misc_feature 1..699: note = chr2:63280952-63281651
  misc_feature 1..699: note = hyper
  source 1..699: mol_type = genomic DNA
gagaggggcagccctcgaatcttggagacactggcttctagtcgcacatctgcactttctcccacctgtggcctctcaggctcggccgcccgagggagtttcttttattcccagttcggctttcttttgcgaaggccgagatctgggcctgccaggggcctgcccgagtcctctatcgcgggtccacgtggccaccaatgacccgcggcgcccccgcgtgtccccgcagccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtgcgcactccccgggctccagggtctgggtaggggagctgaggctgctcggggaaggtctaggaaggctcttgagtagttcttgaggagaccatcctgtgggggtgggcttacagactgggcagccgctctcggactccccctagcgctgggccccagccaggaaagggggcaaaagttaaaggaaatggcttagagccctggattccgcctttagccctagggcgccttcggtgtcggtatcgaaagtactttttagaattgccggaggactagggaagctcccgaatgtaaagcgccctgcgggcctgacacttg

SEQ ID NO: 167 - DNA, 493 bp, Homo sapiens
  misc_feature 1..493: note = chr2:63285117-63285610
  misc_feature 1..493: note = hyper
  source 1..493: mol_type = genomic DNA
gtccccagaaactttcgcttagggagtgtctccccccacccccaccacgcccctccgcgtcagcctggcctcttcccccaggcgttttgaccccgcatcccccctcgccatccaggacagagacaggtgtcaggactcaattcccgaagcaattcctttctcttcagaggcaggagcctggcactgatttcttcaccctaattgcctgcaccagaaagaagagggggaggggaagagggtcgggaggcgggaaaggatagctctgtaatgctctcagagctgagccaaaaaggaaaagaaagcaaaacgacaaaaaactgatccgtgtcctgcatgttggcagcagacaaccttccttgctgctgagctgtcccgggtggcttcaccgcggctggggaatccgagccattccttccacgtgctaagatgtccctctaagccctcagctcctgccagaagtagccaaattacctttcttcgtactgtaaacttc

SEQ ID NO: 168 - DNA, 227 bp, Homo sapiens
  misc_feature 1..227: note = chr2:63286358-63286585
  misc_feature 1..227: note = hyper
  source 1..227: mol_type = genomic DNA
gcactggcctgggcacccgggctgcagggccttttgggccctcccctcagtgaccctgcctgtagcggccccagggccgctttggctcaggcagcagctgccaatgccgctcgaggcccgcggctccctgaggcgagctctgcggggcccagcagtcctcttggctgctaaatggaacgaaaccaggagacccggctttgcactcgtttggacaactgtgtggcctc

SEQ ID NO: 169 - DNA, 55 bp, Homo sapiens
  misc_feature 1..55: note = chr2:63286693-63286748
  misc_feature 1..55: note = hyper
  source 1..55: mol_type = genomic DNA
cgggaggggcagatgcgacccctgggccggcccctcgggggcgtctagaagcttc

SEQ ID NO: 170 - DNA, 236 bp, Homo sapiens
  misc_feature 1..236: note = chr2:63287082-63287318
  misc_feature 1..236: note = hyper
  source 1..236: mol_type = genomic DNA
ggcggcgggaacgcggaaggttccctccacccccaccccaacccccacccccacccccgggccggccacctgttgacaggcaggttctctgagaaccgacttcagctcgcccttctgtccaggaagtttgttcggtttgggtttgggtgttcgtgacacaatcggagcaattagaattgaagcaacttcaggagatttagcaacccgcgaaaatttagcaacgttcagacgtcaac

SEQ ID NO: 171 - DNA, 58 bp, Homo sapiens
  misc_feature 1..58: note = chr2:66808576-66808634
  misc_feature 1..58: note = hyper
  source 1..58: mol_type = genomic DNA
cactgtcccttttctcgtctccccgcgcacctccccagacgccctgccggggtggctc

SEQ ID NO: 172 - DNA, 665 bp, Homo sapiens
  misc_feature 1..665: note = chr2:66808726-66809391
  misc_feature 1..665: note = hyper
  source 1..665: mol_type = genomic DNA
cgccggccggacgtcggctaggctccttctccccgcgggctgggggccctggggctctgcaaggctctggctccgaacagattgcgcctcccgcctggctgccagtaggaactggggtgggagccgcgtaactaacagttgcgcgcaggaggcgagccccaggtgtgagcgcagaggctctctccccagcccgcgggtctgggaacctttcaggacgcctccctccccaactcctacccatgcgtctgctccctaggccgagcccccctcgtgaggttttaatgaccgcggacgcaggggagcccgcacttgagcgaggaccgacttctctggcgggtccacgctgctcgcgcttgcgtccgcgggtagcgcgctgtgcccgggtcagggggcgagctgcgagaagtaggaggggtcaagacccccagaaatccctccatgggcacacacacaatcaagaatagggttgagggtcttgagaggtagaactaccctaggcagggcttctccaactcggcctttggaccccgcgcgcgcccaagggcgtgcccaccgcggaagcacagatcatcttcccgggactgggtctcctggaccctgcgttgctccctttttcctagcggccccgtagctggctgccgcatgtagggcgatcttcattaact

SEQ ID NO: 173 - DNA, 268 bp, Homo sapiens
  misc_feature 1..268: note = chr2:68546249-68546517
  misc_feature 1..268: note = hyper
  source 1..268: mol_type = genomic DNA
cgcgaggccagaggcccttgagaggctcgggctgtcctgggggcctcagtcctctgcctgtaccccatgggggaccctgctgccaccaggcgccccgcactcactcgacctgcagcgtgctgggtttaatcttcacctcaaccttgtaggaggagccggtgagcagcttgatggtgcggttctggccgaagcgctgcccgtccaccttgtaaaagaccgggccgtcattaggctggatgcgcagcgcgatggagaggcgcacgaggcc

SEQ ID NO: 174 - DNA, 361 bp, Homo sapiens
  misc_feature 1..361: note = chr2:68546552-68546913
  misc_feature 1..361: note = hyper
  source 1..361: mol_type = genomic DNA
cggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatcccc

SEQ ID NO: 175 - DNA, 139 bp, Homo sapiens
  misc_feature 1..139: note = chr2:73147389-73147528
  misc_feature 1..139: note = hyper
  source 1..139: mol_type = genomic DNA
cctcttggaaattgccgccgcttcctgagccatcagtcccagcgggtacgttatcgagtagcacaaacagttggatttttccctcaagaaccgagtctggacgcggagatggagccaagtgtggctgcattttcggacc

SEQ ID NO: 176 - DNA, 101 bp, Homo sapiens
  misc_feature 1..101: note = chr2:73147966-73148067
  misc_feature 1..101: note = hyper
  source 1..101: mol_type = genomic DNA
cggtactgtttccccgagatcaggaactttccgggtctaggagcaacgcctggagggggctgtagagacccagccccccgggacccgcaactacaatgggc

SEQ ID NO: 177 - DNA, 19 bp, Homo sapiens
  misc_feature 1..19: note = chr2:73148174-73148193
  misc_feature 1..19: note = hyper
  source 1..19: mol_type = genomic DNA
cgtccggccctgagcccct

SEQ ID NO: 178 - DNA, 271 bp, Homo sapiens
  misc_feature 1..271: note = chr2:73430485-73430756
  misc_feature 1..271: note = hyper
  source 1..271: mol_type = genomic DNA
cctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcgaggagctgttaggagctggtcaaggctcacaccccactaccgcctccactgctcacgtctgtgaacttgagctacacacttcgctctgagcctgcgtgcatgcaatgct

SEQ ID NO: 179 - DNA, 731 bp, Homo sapiens
  misc_feature 1..731: note = chr2:73518261-73518992
  misc_feature 1..731: note = hyper
  source 1..731: mol_type = genomic DNA
ggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgcttcaaggaaactggaagcgggaccggaggccggccctcgggcgtgcgaggaggagttggaagaagagcggggaggggaacggcccggaactcgtgcgcgccgaacggcggcgccccaacccataaacccatctcttgctcagagagaagcgaaggagaggcccagcgagtaaaagccgaggcccttgagccgctcctcggcgcgcgccttctgcttgaggtgcaccttgctgtgccgtttcttctcatcgctgcgcgcgaagcggcggccgcacacgtcgcaagcaaaaggcttctcgccggtgtgggtgcgcacgtgcgtggtgaggtggtcgctgcggctgaagttgcggaggcagatgcggcactggaagggtttgtggcccgtgtggatgcgcaggtggcgattgagctcgtcggagcgcgcaaagctccgcacacaactctccaccgggcaagcgaaggccttggcgtgcggccgcgggcagaagcagcgcgtgctgcatttgccgccgcggcgccccttgcgtcgcgccttggcctgggg

SEQ ID NO: 180 - DNA, 324 bp, Homo sapiens
  misc_feature 1..324: note = chr2:74742324-74742648
  misc_feature 1..324: note = hyper
  source 1..324: mol_type = genomic DNA
ggctcacgggtgaggttgtctgacccctccagcgtcacgcccgactctgaccccgtctcctcatttcttagctttctgctccaactcaaggacccctttcacacctcccactagatcctcccaggggatcctcccccaactcaaatctctgggtcctgcctccgagaggtgatggggagggagctgccgtcggtgcccgcgccctcctctgtagtcccactgtccacgcgtggggaggggagggtgaagttacaggggacgtctccctcgcatcccaggggaagggcctttcttggctatagggctcggctgatgcttagggcc

SEQ ID NO: 181 - DNA, 452 bp, Homo sapiens
  misc_feature 1..452: note = chr2:74742693-74743145
  misc_feature 1..452: note = hyper
  source 1..452: mol_type = genomic DNA
cggccttctcagtggcacctcgggccaccctgcaaatcctgccctggtctttcttcctcccggtagctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggtgaggcgcggcgcgggcgagggcggactggggttcccgagcagggcctggtgagaagcgacgcggcgggcgccccgctgaccccgcgtctccctcccttaggcgccagacggcggaggagcgcgaggccgagcggcaccgcgcgggc

SEQ ID NO: 182 - skipped

SEQ ID NO: 183 - DNA, 69 bp, Homo sapiens
  misc_feature 1..69: note = chr2:88752716-88752785
  misc_feature 1..69: note = hyper
  source 1..69: mol_type = genomic DNA
aacaggcccgcttggcgtgtccccttctcctcggggattctgtgattggaggaacggaaatcagtgttg

SEQ ID NO: 184 - DNA, 171 bp, Homo sapiens
  misc_feature 1..171: note = chr2:89064805-89064976
  misc_feature 1..171: note = hyper
  source 1..171: mol_type = genomic DNA
cgctgggcatgggcttcggcccgggttgcaggaggcgtgcaccctccggccggataggcggcgcactcagggaccaggaggccatcccaggtgagccccgccagccccagccggagcccgagctgcagctgccacctgcaagtggtgctctggctgcagcggtggcaaccc

SEQ ID NO: 185 - DNA, 350 bp, Homo sapiens
  misc_feature 1..350: note = chr2:89065128-89065478
  misc_feature 1..350: note = hyper
  source 1..350: mol_type = genomic DNA
cgcgtcgggagccggtggaagaggagaagagcgcgcgggcgacagtcatacaggccttggggcagggcgcgcctcgcgctccagggagccacgccagcccgctgcgcctccgcagcaaccgccgcctgcacgtggcggggcgagagagctgctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacgg

SEQ ID NO: 186 - DNA, 15 bp, Homo sapiens
  misc_feature 1..15: note = chr2:97193049-97193064
  misc_feature 1..15: note = hyper
  source 1..15: mol_type = genomic DNA
cggcagcagagcctg

SEQ ID NO: 187 - DNA, 386 bp, Homo sapiens
  misc_feature 1..386: note = chr2:97193251-97193637
  misc_feature 1..386: note = hyper
  source 1..386: mol_type = genomic DNA
cggtttgagccagctcccctttttgagtcagatccggcggcagggccagaaaagcgctttctgaaaccccagcgcggtcctcggtgggggtggaatggggtggggtggggggcgcggccgcgccgctgggcgccctccccgccctcccccctccccacccccagtcctccctccgctgcccgccccccaagcccggtgtcgccccctccgccccctgccgcatccccggagccagtgcccacaggggccaggcagcccgcaggggtcgctcacggctggtgtaggggcttggtccaccacgctagtacttcgggcaccaaaatagaaaaagaataacgcttggaaagaatctgatgtttccgaaggagcatcgaaaatcgccgtta

SEQ ID NO: 188 - DNA, 71 bp, Homo sapiens
  misc_feature 1..71: note = chr2:98963337-98963408
  misc_feature 1..71: note = hyper
  source 1..71: mol_type = genomic DNA
gctgagccgtcggggcgggaggcagaaggagcagggctggctcccgctggggacgggtagggcttgcagcc

SEQ ID NO: 189 - DNA, 417 bp, Homo sapiens
  misc_feature 1..417: note = chr2:98963409-98963826
  misc_feature 1..417: note = hyper
  source 1..417: mol_type = genomic DNA
cgaccccaccccatacatttcctcctgtcacgctgtccccggaccgccagtccgggaaggacccacttccccggctccaagtcgggagcgggcgccgcgtcttctcgagtccgcgccgcgccgggggaggttgagtcagtggcctggagggagcagggccgggggaaggcagcggcgaaggactgccccccaacccaggggactattttcccttggggattcaaagagaaaggtaggctgaggaggaggcgagaattaaaattcttttaggagtgcgcggttactttttttaatgataaaatcacacccgggatctcggacgcccggggcttagtgctcggtgatggaggagaaggggcggcgggctctctgatcctctgcaatcccctaaccggataaaggcgccgggctcccagc

SEQ ID NO: 190 - DNA, 325 bp, Homo sapiens
  misc_feature 1..325: note = chr2:98963868-98964193
  misc_feature 1..325: note = hyper
  source 1..325: mol_type = genomic DNA
cgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctcccc

SEQ ID NO: 191 - DNA, 139 bp, Homo sapiens
  misc_feature 1..139: note = chr2:99439368-99439507
  misc_feature 1..139: note = hyper
  source 1..139: mol_type = genomic DNA
ggccctgggggccccttctcctcatccgggagcacgggcggcgtcggctccgcttccttcgggacactgcgttctggcccgtcgcgagcagagggcgcctctgaggtggcggcggggtcagtctcggggggagtcgtgt

SEQ ID NO: 192 - DNA, 178 bp, Homo sapiens
  misc_feature 1..178: note = chr2:105458974-105459152
  misc_feature 1..178: note = hyper
  source 1..178: mol_type = genomic DNA
aaagagggagatgcccgtgtagagaaccgaggaggggggctggggtagaataatcagctctaaggttgcagatttagatctcaaggctgaaaaggataagcttccaccagagcatcctgtagcgcctcctgtcctgccctgccctgccctgcgcgcgcaccgcactcacacgtacacc

SEQ ID NO: 193 - DNA, 361 bp, Homo sapiens
  misc_feature 1..361: note = chr2:105459902-105460263
  misc_feature 1..361: note = hyper
  source 1..361: mol_type = genomic DNA
cggcagggggagtttgcctcccggctggctagcttcgctagactcagtcattactaaggggttgggagggggagcttgtctcttctctcctggcagagccgcgggaggcgtcggaaagtttcctaccacttgagggacgaaggtggatggatcgagagccttgtttccctgctgggatggccgaatgtaccagaagtctcgctggcgagcagcgccctcggcttccccggcaatcatcccaaacgcacacccttcccctggccgaaggaaccccaggttgcctaggaaacggccccgcggacctggcgggccctagggtggagacccgggcggggttggggggtactcgcgaatctgctgc

SEQ ID NO: 194 - DNA, 247 bp, Homo sapiens
  misc_feature 1..247: note = chr2:105460264-105460511
  misc_feature 1..247: note = hyper
  source 1..247: mol_type = genomic DNA
ggcgcagcgttggggtgtctggtccctgcccagccggtaggccgcgtccgccgtcccactcagtggggctttgcgcccccacccatgggagttgcccgttccgcagcagagttcgaaggggaaagtgggggccacgttcccagaggaacagagttccagacctctcagggcactgatggggactccgtcggacccacgggttccgcaaacactccagaggggttcccagggccgaagatgcctcctg

SEQ ID NO: 195 - DNA, 683 bp, Homo sapiens
  misc_feature 1..683: note = chr2:118981174-118981857
  misc_feature 1..683: note = hyper
  source 1..683: mol_type = genomic DNA
ttgtgaagccaagggcgcttggcatgggaagagagccgctcgtgatttatttgggagagggatggggttttggaaaggaaattggggggtttacaaggaggacgggtgggttttactcaacaacttattcttgggcgttttcgtggactggagaggagtttcgatcccgtctcgggctcacctgggaagccccctcctggcgcccgctttgtttggcgttcctttaaagcccggtgttggcagagcgacccacaatgaaacaaattctcattttatgacgtctttccccccgtaggagtccgaacaatgtctgggggcttggcacgcatgaagataaaagaattttattttaaatgcgatacatgtcaggattagacagcgtttcctttcagctaaactacagagcgaatcttcatttcctgtttcactgcttcccccgaaagaaacttttctttttctttttctttttctttttttttcttttctttctctcccccagcagagagtccgagagaaaagtgctgggcacagagctccccacgaggtccccggaaagcagacttagctcctgatcgttgtcaatctttgggcaacccggggcctcgcaacggctcgggtttagtgtgatctggggaggctgcagcccagttccggctaccgtgggcgcctgagcagagccgggg

SEQ ID NO: 196 - DNA, 203 bp, Homo sapiens
  misc_feature 1..203: note = chr2:118981945-118982148
  misc_feature 1..203: note = hyper
  source 1..203: mol_type = genomic DNA
cgccgggccgccgggtcaccggttttccgaaagggacccggcagagacaaagtgccttcgccgctgcgataggttggttttactttgcaataaacagcccctaatgggaccgggcgccgggcggagagctcggcccggggcgcggcctttgccgcctggctctgcgggccgccccgccgggcgccaggttttggggggtggcc

SEQ ID NO: 197 - DNA, 244 bp, Homo sapiens
  misc_feature 1..244: note = chr2:118982253-118982497
  misc_feature 1..244: note = hyper
  source 1..244: mol_type = genomic DNA
cggaggagccgggcgagaaagcccgaaaagggaggcggttatttacgaccggcgggttggagtctggcaccagatggtgggggtctgtcaggcccggccgccccgcccagcgccccgcaaacagcgcccggttggcagcgtcgcctgagcagcccccatcttcgcttccagcccctcccgtatattttctcccgtccaagtcgatcaaagacggactttaaaaattactcgcaattagacccaa

SEQ ID NO: 198 - DNA, 142 bp, Homo sapiens
  misc_feature 1..142: note = chr2:119616141-119616283
  misc_feature 1..142: note = hyper
  source 1..142: mol_type = genomic DNA
ctcagcgctcccaggcgctccagtggggccgcgttccccgccagggtgggtcaggggaatactctgcctgcgccctctccgagggtccgcgcagagcgagcgcctctttaggtggggcctctggctccgacccctgctccca

SEQ ID NO: 199 - DNA, 325 bp, Homo sapiens
  misc_feature 1..325: note = chr2:132182764-132183089
  misc_feature 1..325: note = hyper
  source 1..325: mol_type = genomic DNA
ggcgggcgcgggaggcgggcgcgggaggcgggcgcgggaggcgggcgctggctcggggggcgcgtgagagaagccgccgcgcccggcctcgctcagacgctcagacgcccgcgcctcggcccgcctcgctccccgagccgccgccgccgccgccgcctgccgaggccccctacgccgtgcccctggcagcgagaactcatccaccggggtgtccccgcagcgagcggccgctgaaggctccccgcgcccgctcctcgccgccgcctgacacggctcccgggcgccctcggccctgtccgcgcccaccgcccggctggcgcgcaga

SEQ ID NO: 200 - DNA, 371 bp, Homo sapiens
  misc_feature 1..371: note = chr2:139536937-139537308
  misc_feature 1..371: note = hyper
  source 1..371: mol_type = genomic DNA
catatagaacataggcgtatatcaggaggaggagagcgtggcgcctcgcgggaagagagaagagagtgacaacgcgaaccccaaaccacattttaatacgtttcttattcctcagcgcctccgagccacccagaccaggcgggcggtctccctgaaaagacagcttcgagatgcccgagagggggctcctgcgcggagctgggcatgaaagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcac

SEQ ID NO: 201 - DNA, 463 bp, Homo sapiens
  misc_feature 1..463: note = chr2:145273327-145273790
  misc_feature 1..463: note = hyper
  source 1..463: mol_type = genomic DNA
acacacgcacacacacgcgtacacacacacaaaacctagagagagagagagagagagagaaaagcatcatttgtctctaatcaaaattctctcgtctttgtgttttgctccttccagcacctcacactgcgcccccagccgccccctccccgcgccgcgcagctctggggcaggccgggggcgcgcacaattgtcttctctagaggaaagttgctccaagtgggcccgggcggtccccgcgaggcgcgggctggggctgcggaggccgggaggccgggtgggcgctgcgtcccagcgcctgcctcgggagcgtctacgcggccccgcgccgggtgatcgggctgagagcgaggggagcgagaagtttcctttccgagtctgggctggcgctcgttcgcttgtttgttttcgggggttggtttctttctttttaaactcagttatcctccgtcagctcccccac

SEQ ID NO: 202 - DNA, 24 bp, Homo sapiens
  misc_feature 1..24: note = chr2:149645535-149645559
  misc_feature 1..24: note = hyper
  source 1..24: mol_type = genomic DNA
ccgcagcaagggctgcgaccccgc

SEQ ID NO: 203 - DNA, 287 bp, Homo sapiens
  misc_feature 1..287: note = chr2:149645560-149645847
  misc_feature 1..287: note = hyper
  source 1..287: mol_type = genomic DNA
ggtccccgctgagcaccgcagcaattaagtacgtgcaagccatttgcggcagcgggtttgagatgcgttcgtagtgggtgacattgagaacccccagaggcgacacgggcgcctggtctctgagaggtggcatgctgcctgccgccctggtgcctggctgccccggaaggggcccccagtcgccggccccgggaaggtgctccaggctcgcggctcctcgggggtcgcctctgcaggcggcctgtttccaatttccaggcgaggagcgacgccgtgatgcaaatctg

SEQ ID NO: 204 - DNA, 1265 bp, Homo sapiens
  misc_feature 1..1265: note = chr2:157176900-157178165
  misc_feature 1..1265: note = hyper
  source 1..1265: mol_type = genomic DNA
gaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggc

SEQ ID NO: 205 - DNA, 13 bp, Homo sapiens
  misc_feature 1..13: note = chr2:157178166-157178179
  misc_feature 1..13: note = hyper
  source 1..13: mol_type = genomic DNA
aggcccaggcagg

SEQ ID NO: 206 - DNA, 55 bp, Homo sapiens
  misc_feature 1..55: note = chr2:162275172-162275227
  misc_feature 1..55: note = hyper
  source 1..55: mol_type = genomic DNA
cttcccccttttttccggtgccccggcttatcttcgctcccagaggtgcgaaagc

SEQ ID NO: 207 - DNA, 128 bp, Homo sapiens
  misc_feature 1..128: note = chr2:162275310-162275438
  misc_feature 1..128: note = hyper
  source 1..128: mol_type = genomic DNA
cggcccgggcgcgcagccgggcgcacacagccacgcgcacagcgaccgcgttaacacgccacccggcgctcccctttcttcccgccggacagatggtggttttacagtccttgcacaagtaccagccc

SEQ ID NO: 208 - DNA, 128 bp, Homo sapiens
  misc_feature 1..128: note = chr2:162275472-162275600
  misc_feature 1..128: note = hyper
  source 1..128: mol_type = genomic DNA
cggaggacactagccagcccggccgcgtgcagacgttcactttccctgagactcagttcatcgccgtcaccgcctaccagaacacggatgtaaggagacctaggggctgggggcgaggcgggcggcac

SEQ ID NO: 209 - DNA, 264 bp, Homo sapiens
  misc_feature 1..264: note = chr2:162280152-162280416
  misc_feature 1..264: note = hyper
  source 1..264: mol_type = genomic DNA
ggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggc

SEQ ID NO: 210 - DNA, 216 bp, Homo sapiens
  misc_feature 1..216: note = chr2:162280740-162280956
  misc_feature 1..216: note = hyper
  source 1..216: mol_type = genomic DNA
cgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttg

SEQ ID NO: 211 - DNA, 238 bp, Homo sapiens
  misc_feature 1..238: note = chr2:162283365-162283603
  misc_feature 1..238: note = hyper
  source 1..238: mol_type = genomic DNA
attaaaatgaaaattcgtgggaggataaaactaacttgccttccctggacaattccgccactagacggcgttccgtggagttttgtctgccacataaaaaagcgaggactgaatttcctttgtgtttctttcccctcctcacatctaagaactaagtaagaggacaaaagtacaagacacggtgcatgtgtggcgagtgaagtggagcagtgcattcgtgtcatcacccacccgaccc

SEQ ID NO: 212 - DNA, 273 bp, Homo sapiens
  misc_feature 1..273: note = chr2:162283782-162284055
  misc_feature 1..273: note = hyper
  source 1..273: mol_type = genomic DNA
ggcgctgcccggcgctacccgccgccctcgggacagtcaccgtgagcaaaagagtcggtgtcatgtgcgtaaacgaagctcttaggagccgaggatagatttcacaggaacgtagtgccttgttctgaaagacgcgctttggttgatattaggaagtatttttaaaaaattggggaggtcgtttcccttgcagctccgccaccatctgctgcgtggactgagtcagcgtgaggtaaatttgcagcttcgcgctcctctcggaggcattgtgct

SEQ ID NO: 213 - DNA, 22 bp, Homo sapiens
  misc_feature 1..22: note = chr2:171675361-171675383
  misc_feature 1..22: note = hyper
  source 1..22: mol_type = genomic DNA
tgactcccagggcaccggaaag

SEQ ID NO: 214 - DNA, 131 bp, Homo sapiens
  misc_feature 1..131: note = chr2:171675522-171675653
  misc_feature 1..131: note = hyper
  source 1..131: mol_type = genomic DNA
cggaatgaagagctaggagccccagcaggaataagagttttcagtccccggctttcgttgagccaagatctgacctcctcctttccccctgggctgtgttcaaagtctataatcagcggaaatttcgacgt

SEQ ID NO: 215 - DNA, 329 bp, Homo sapiens
  misc_feature 1..329: note = chr2:172945896-172946225
  misc_feature 1..329: note = hyper
  source 1..329: mol_type = genomic DNA
cccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacagg

SEQ ID NO: 216 - DNA, 323 bp, Homo sapiens
  misc_feature 1..323: note = chr2:172955471-172955794
  misc_feature 1..323: note = hyper
  source 1..323: mol_type = genomic DNA
cgggagctggccctccacctttggggggtcttttcaggcgcgcggtggggagcagagcccggaaggcagtgatctgtgttgtgacaagcacccatttttcaattggtgctggtgaaagatcagatgcgccaggctcttccgacgccctttgggaaggggaggaggaagtggtggggctgctgggggtggggggaggcggtgtgatggaagcagggaaagtagtcgggggtgggggaatgatgccggggacctccaagccccttccaggcctgagattgggacttctccgcagcacctagaagaaccagcgctgatgggagaga

SEQ ID NO: 217 - DNA, 59 bp, Homo sapiens
  misc_feature 1..59: note = chr2:172957976-172958035
  misc_feature 1..59: note = hyper
  source 1..59: mol_type = genomic DNA
ccaccctcctactcccggagcgggagccacggcggcgggcgcagcgcagccttccaacc

SEQ ID NO: 218 - DNA, 94 bp, Homo sapiens
  misc_feature 1..94: note = chr2:172964795-172964889
  misc_feature 1..94: note = hyper
  source 1..94: mol_type = genomic DNA
gggagggcgggcaggcgggaccgggaggtcaataactgcagcgtccgagctgagcccaggggagcgggcgaggagaaagaagcctcagagcgcc

SEQ ID NO: 219 - skipped

SEQ ID NO: 220 - DNA, 116 bp, Homo sapiens
  misc_feature 1..116: note = chr2:172965647-172965763
  misc_feature 1..116: note = hyper
  source 1..116: mol_type = genomic DNA
ggcggttctggaaccagattttgacctttgaggaaaaagacctgagcattagtggaggaacctagtcttggggcagtaggggttcgaagaggagaaaaaagaaggcagagaaaaac

SEQ ID NO: 221 - DNA, 802 bp, Homo sapiens
  misc_feature 1..802: note = chr2:172966250-172967052
  misc_feature 1..802: note = hyper
  source 1..802: mol_type = genomic DNA
tgagtcttttggaaacgccgctgaagagccgccagctggaaactggagtagatggtgcggggtttccggactttctttggcttcccgttcactatccgaatttcaggctcaaggtcctccttctctgcaacgataaagaatcgtaagaacagcgcaacccaggggtcctggagttcccgccctcctagagggcccggcgggggggacttggcttgagcaaagaggtgggtgcactgaactgtggcgccacgggcaggcgcaacttcgcagcgtgcgatcggagccgccaccgaccccgggagctgtaccctccagggaagggggagacaagtgcacacccaagagaaagaagctggtggcaaggagatgcccttatgaggcaggcagagcacgcccacttggctcttgaggccaccaggtcctaccaaaggagagagggacgtaaccggcgacctgcggcagattggaggctggggagggtaaagggcacaagcgggcggtgagcaggcagcgtgaaaatccagagctttcgaaggccccccgccccaaacacgtttacccatccatcccattaactagaccgactcggcactcttgacttcagcgttatgcataccaggctcgttgttggctggggacgaactggttccatagggagcgtaggaggtgtaggcggcggtgtagcccaggtcatagctgctcttggcggagtaagggacgttgttgaggccgctggcttggtactggtaggaacccatgtgcgcgtagggcgagcccccgccgccgccgccgcccgccgggt

SEQ ID NO: 222 - DNA, 1168 bp, Homo sapiens
  misc_feature 1..1168: note = chr2:175190805-175191973
  misc_feature 1..1168: note = hyper
  source 1..1168: mol_type = genomic DNA
aaagagaagtgttggcgcctcaaacttgaggatcagcttcttgggccccactccagggtgtcgcgggggtcgggttctttccgccgccccccgaaagattctcagctaaccctttccccgccgagaccaagaggccctcactctgacaccactccgggagccaagctactgtaaggagctgataccacccctcgccggcgcgaaccgcccatctccccagacccgcccaccccctgctgcgaatccctgacgttctagcccggcgaaggtcctcttaaattaggaaacaatagctatttaagaagaagcgcaaataacccgcgctctgcgcgcccaatcgtgggattcttgggagttccccgcgggcaaggaagtctgctgctccccgcagctgcggaggagaggagggagcctgcgtgctggggcagggtgtcgcgaacttggggcaacccacctccagagccccgcccccgctttcccgcctgccggggacctgccgaacgcggaaccaccctccttcctgaggcaaatttgggaggggagaggtccagaagctgtagagtcggggcgccaagcgccagattctgccgctcggaagttgggggcagtccccagtcccgcctcaggcccccgcgctcacagggcgctccgccgagggcgcgggccaggcgcgcggtgtcacctccacgaagtcatttacttgccctgaaggagctggccctcgaccccttggaggatggagattcctcccattccctcctccgcctcccccaggtcggcgaagagacgtggaattgagctggaccgatgattccgcgagctctgtaattatgcacacactgaaatcttcaccgttgacttaagttacttggcgctgcgagggctggggccctgcatattgattaaatgcagcctctatttacctaaacaataaatgtagagattagcaacgttcacttgatcacaataatgggattgacaattaaggggcaatgcatcccagatgtagcggaacctatgggctgcgtgcagcaggcagagggcttctcagagaggggcgctgggcagttgcggcggcggaggtagtgcagagcaggaagcagcgcggaagcacagcgggaggcggagggggacgcccagcctcgtcaaggtcttcggccaccccgcc

SEQ ID NO: 223 - DNA, 149 bp, Homo sapiens
  misc_feature 1..149: note = chr2:175192084-175192233
  misc_feature 1..149: note = hyper
  source 1..149: mol_type = genomic DNA
cgcttgctgatgcctggccgggaaggaggatggacgccgctggcatgtgccctggtaagtgtgtctgtttgtcatcagtgtacattctgcatgtggcagcagggcgagggggaggcgcacgtgtctaaagtgcacggagccttcctcta

SEQ ID NO: 224 - DNA, 83 bp, Homo sapiens
  misc_feature 1..83: note = chr2:175193294-175193377
  misc_feature 1..83: note = hyper
  source 1..83: mol_type = genomic DNA
gggtgggggtgggggcgggggcctgctttgatcgctccagctctgttgtaattttgtcttcgccagatagattagctggaacc

SEQ ID NO: 225 - DNA, 267 bp, Homo sapiens
  misc_feature 1..267: note = chr2:175193378-175193645
  misc_feature 1..267: note = hyper
  source 1..267: mol_type = genomic DNA
ccagccctagcttggagttccgttccacggagtaccctccctccccacccccagcgtcatctcgcgcctggagccgggtcgccgctccttccgaagtctcgctggaaacttcaagggctgatggttctgtgttcttgacgtaattaggaggccacgcagctctccaacactccgttaaacaaatatgtaagtcgtcctccccctctctggggacagactctagggaaggaggcagctgggcccgctccgggtggtgtccttggctag

SEQ ID NO: 226 - DNA, 35 bp, Homo sapiens
  misc_feature 1..35: note = chr2:175193808-175193843
  misc_feature 1..35: note = hyper
  source 1..35: mol_type = genomic DNA
cgggtggttctaagctatgacgaactagaggctgg

SEQ ID NO: 227 - DNA, 90 bp, Homo sapiens
  misc_feature 1..90: note = chr2:175199465-175199555
  misc_feature 1..90: note = hyper
  source 1..90: mol_type = genomic DNA
ccctcgccccccccccgcaagtatcccccactactcccccccacccccgcggccctagctagctgacttgactggcacgcgccgggagcc

SEQ ID NO: 228 - skipped

SEQ ID NO: 229 - DNA, 181 bp, Homo sapiens
  misc_feature 1..181: note = chr2:175200260-175200441
  misc_feature 1..181: note = hyper
  source 1..181: mol_type = genomic DNA
aaatctgtctctggccgcttatcctcggattattgttttcataatcgctgtttttgtgtgtatgtaaactttaaaaccaaacgttttctattaaaaaagaaaagtcaagtcgtagccaccctgggagagctgcaagtttcgcccgtccctggcagctgtttcggccgcctccgccctcacc

SEQ ID NO: 230 - DNA, 144 bp, Homo sapiens
  misc_feature 1..144: note = chr2:175200709-175200853
  misc_feature 1..144: note = hyper
  source 1..144: mol_type = genomic DNA
ggggagccaggaccccccgggagcagccgcaggggacgaggctgctcacgggtgcactttgtttcttcccccacttcctcttgccctcctccttcttgctccctcccccatcccacccactctaggaagagccgcgcttcggaa

SEQ ID NO: 231 - DNA, 267 bp, Homo sapiens
  misc_feature 1..267: note = chr2:175200916-175201183
  misc_feature 1..267: note = hyper
  source 1..267: mol_type = genomic DNA
cgctgccagagtcgagcgccttcgccaaaggcggctttcacccctggaagcgctcctcgtccagctgcaacctcggctccagcctctcgggcttcgcggtggccaccgggggccgtggctcgggcggcctggcgggcggctcgggcgccgccaacagcgccttctgcctggcctccacgtcgcccacgtcgtccgccttcagcagcgactacggcggcctcttctccaactcggcggctgccgcggcggcagcggccggggtgtccc

SEQ ID NO: 232 - DNA, 183 bp, Homo sapiens
  misc_feature 1..183: note = chr2:175201359-175201542
  misc_feature 1..183: note = hyper
  source 1..183: mol_type = genomic DNA
gtgcacagcagcccgggctcgtggctggaagtgcagaaccccgctggggggctccagagctcgctgcactcgggcgccccccaggcctcgctgcactcgcagctgggcacctacaaccccgacttcagctcgctcacgcactccgccttcagctccacgggcctcggctcctccgccgccgcc

SEQ ID NO: 233 - DNA, 54 bp, Homo sapiens
  misc_feature 1..54: note = chr2:175201775-175201829
  misc_feature 1..54: note = hyper
  source 1..54: mol_type = genomic DNA
ggccggggcgagcctgcggcgcaagggcctgcacagctgccacattccgggctg

SEQ ID NO: 234 - DNA, 120 bp, Homo sapiens
  misc_feature 1..120: note = chr2:175202126-175202246
  misc_feature 1..120: note = hyper
  source 1..120: mol_type = genomic DNA
cgaatcccccgacctcatcctgcatgactccggcgtcagtgccgcccgggcggcggcagcggcggcggcggcagcggcggcggcggcggcggcggcctccgcgggaggcaaggaagcagc

SEQ ID NO: 235 - DNA, 33 bp, Homo sapiens
  misc_feature 1..33: note = chr2:175202568-175202601
  misc_feature 1..33: note = hyper
  source 1..33: mol_type = genomic DNA
ggagacctacaaccacaagcacgcacactcgcg

SEQ ID NO: 236 - DNA, 78 bp, Homo sapiens
  misc_feature 1..78: note = chr2:175202633-175202711
  misc_feature 1..78: note = hyper
  source 1..78: mol_type = genomic DNA
cgagcgaagagcaatacatagaaaggctccctctttgcccactctccacctccctccaacacccgtctctttcctttt

SEQ ID NO: 237 - DNA, 119 bp, Homo sapiens
  misc_feature 1..119: note = chr2:175204828-175204947
  misc_feature 1..119: note = hyper
  source 1..119: mol_type = genomic DNA
ccttcttgagctccccgcggccaggctgccccgctcttcttactcgagtttttcttcactttggccattttctctccccgatcaagctgttcataaccgggagccccccactccctaag

SEQ ID NO: 238 - DNA, 558 bp, Homo sapiens
  misc_feature 1..558: note = chr2:175208311-175208869
  misc_feature 1..558: note = hyper
  source 1..558: mol_type = genomic DNA
gtgtctgccccagtccgcattctgcttgcagattgctgacgaaagttgatatcttcatgtttgtcccaggagcttcataaagcgccctcttcacctgtggagcccgagcgaccagaaaaattcgctcgctttcctaactgctgaaggcgagtccggcccgcgcgggggactgcgcccgaggcccggcaagcttaggcggggactagcagggccctcggcgggcgggcccccagcgaaaaggcctgagaattgcttctggggggtggcttgggccaacgggggcgagggagccgcgcagagggcaggccccgacccttccccgccgcaccttgtgggtcgggtgttgggcggcctcctggcgcgggaggcgcatctgctaggaagggtgtgcgctccccccttctcggcctccccatttcggtttggggtgttttcgcaaggttgccagacggtgcatccagaaggaaaccaccagagcacgcaggggggcgtcgcctcaggatgggaaggggcgacctcagccaggattcatcccatcaccctactccacccccattc

SEQ ID NO: 239 - DNA, 93 bp, Homo sapiens
  misc_feature 1..93: note = chr2:175208996-175209089
  misc_feature 1..93: note = hyper
  source 1..93: mol_type = genomic DNA
cggctccggggcagctcgggccggagggtgcgtttcttttcattccaggcagctctccgcgttcgtcccgcacatcttcgtcattactgctac

SEQ ID NO: 240 - DNA, 59 bp, Homo sapiens
  misc_feature 1..59: note = chr2:176944346-176944405
  misc_feature 1..59: note = hyper
  source 1..59: mol_type = genomic DNA
gaaaaacagcagcagcgagaaacctccggggcgactcctcccccgcccccaagcaccag

SEQ ID NO: 241 - DNA, 391 bp, Homo sapiens
  misc_feature 1..391: note = chr2:176944456-176944847
  misc_feature 1..391: note = hyper
  source 1..391: mol_type = genomic DNA
cgccgttcagccaagcaacccggacctgagagtgcacagccaggactagcttagggggcgaggggttggtctttgggaaaccaagcgctcaggacagaggtggaaagtgggtcccgggagccagaaaagagagagaagggcagacggctgggtggcaaatacaaaaatagaaataatttagggggatgcccgccaggcttttgcgcctgctccttctcccccaattcggagcaggttcccttcggcctcccgcgccccggggcgccccctggcggcagcggcagcagcgggcaacgcgcggagggctcagggggcgcacaggggactcccgggcacactcagagaggcgggcgcggccccctggcggtggcgacgtagttatctggtgagc

SEQ ID NO: 242 - DNA, 132 bp, Homo sapiens
  misc_feature 1..132: note = chr2:176945137-176945269
  misc_feature 1..132: note = hyper
  source 1..132: mol_type = genomic DNA
ggccgccgccgccgaggaggccgcagccgctgcggctgccgcggctgccgcggcagaggccgcgctgttgagccccgcggcggccgcgggagcctggtagagaccagggtggcggaagctacacagcagctc

SEQ ID NO: 243 - DNA, 203 bp, Homo sapiens
  misc_feature 1..203: note = chr2:176945581-176945784
  misc_feature 1..203: note = hyper
  source 1..203: mol_type = genomic DNA
cgccgcagcctgggttagggagcgccccgtgttcccagctcctgtcccaggacctctgccccttccggacctctgaatggcttggtctacttctctccgaccaagcccaaccccgagtaccctgtggtctcccagctgggaaagtgtggacggcagtgtgtggaccgccgtgggcacaccgtcctcaacgaagagggtcctct

SEQ ID NO: 244 - DNA, 68 bp, Homo sapiens
  misc_feature 1..68: note = chr2:176957347-176957415
  misc_feature 1..68: note = hyper
  source 1..68: mol_type = genomic DNA
cccggcgggggccctcggggcgggaggcggccccccgaccggcccaggccccctcccaacctgaactt

SEQ ID NO: 245 - DNA, 53 bp, Homo sapiens
  misc_feature 1..53: note = chr2:176957576-176957629
  misc_feature 1..53: note = hyper
  source 1..53: mol_type = genomic DNA
cgcggggccagggccagggccggggccgggccaggccgggccatgagccgcgc

SEQ ID NO: 246 - DNA, 207 bp, Homo sapiens
  misc_feature 1..207: note = chr2:176957914-176958121
  misc_feature 1..207: note = hyper
  source 1..207: mol_type = genomic DNA
ggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacat

SEQ ID NO: 247 - DNA, 298 bp, Homo sapiens
  misc_feature 1..298: note = chr2:176959213-176959511
  misc_feature 1..298: note = hyper
  source 1..298: mol_type = genomic DNA
tggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaa

SEQ ID NO: 248 - DNA, 168 bp, Homo sapiens
  misc_feature 1..168: note = chr2:176980770-176980938
  misc_feature 1..168: note = hyper
  source 1..168: mol_type = genomic DNA
cctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggc

SEQ ID NO: 249 - DNA, 130 bp, Homo sapiens
  misc_feature 1..130: note = chr2:176981376-176981506
  misc_feature 1..130: note = hyper
  source 1..130: mol_type = genomic DNA
ggccggccggccaggctctggagcacgtgacccgagaggaggctgcggctcaaggccattttcaaatctcattggcttggttgtcatgtggtcggcagaggcatccacaattacacggggaatgttttcc

SEQ ID NO: 250 - DNA, 57 bp, Homo sapiens
  misc_feature 1..57: note = chr2:177001206-177001263
  misc_feature 1..57: note = hyper
  source 1..57: mol_type = genomic DNA
tttatgacctatttgcggtcgtcattggctgcggctggtcatgtgcaggcgccgctc

SEQ ID NO: 251 - DNA, 432 bp, Homo sapiens
  misc_feature 1..432: note = chr2:177001264-177001696
  misc_feature 1..432: note = hyper
  source 1..432: mol_type = genomic DNA
ccttcacggcctttttcctgatttccccggcgaatttccccccgcattctgctttcccagagcctcaccccctctttttctaacctttgtctctgcagaggtgggctccagtcaccggctgcgggattgcggagtccgccgcggcctcggctcccgcccggcgcccggcctggccccaccgccgctcactcggtccgcatcgccgccacctccggagctggtggggagcccggcgagggagggcctggaaggggccctgggcgccgagtcccccgccggcgccgacaccgcctgccaggagcagccggcctgctcgaggtgactgcagccgcgcggttctggcgcggcttcttcaccaacatgagcgggtctctgcgtccgagagtgagcgcagccgggcagcgcctagtggattacagcagacgcccggac

SEQ ID NO: 252 - DNA, 75 bp, Homo sapiens
  misc_feature 1..75: note = chr2:177001781-177001856
  misc_feature 1..75: note = hyper
  source 1..75: mol_type = genomic DNA
cgacccccttgggcagctcagtccggctgctcccctacatttcccggggaagtggggggtcgctgtctaagcccc

SEQ ID NO: 253 - DNA, 19 bp, Homo sapiens
  misc_feature 1..19: note = chr2:177053935-177053954
  misc_feature 1..19: note = hyper
  source 1..19: mol_type = genomic DNA
cctcggccgtcttctcggg

SEQ ID NO: 254 - DNA, 364 bp, Homo sapiens
  misc_feature 1..364: note = chr2:177053999-177054363
  misc_feature 1..364: note = hyper
  source 1..364: mol_type = genomic DNA
cggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggtaagtccgcgggccttggatggggccacctggggttggggacggagcctcccccgcggaaatgcgctgggagcgtggtgtcgctgcctttccagacagcggtttgggttttgtggaggagacgcgttcccgggcgaattccatggagtctgcctcgagtacagattcggaaaatgtgccag

SEQ ID NO: 255 - DNA, 158 bp, Homo sapiens
  misc_feature 1..158: note = chr2:182321397-182321555
  misc_feature 1..158: note = hyper
  source 1..158: mol_type = genomic DNA
ccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaa

SEQ ID NO: 256 - DNA, 27 bp, Homo sapiens
  misc_feature 1..27: note = chr2:182321811-182321838
  misc_feature 1..27: note = hyper
  source 1..27: mol_type = genomic DNA
ctggcatttgggccacgccgggctggg

SEQ ID NO: 257 - DNA, 154 bp, Homo sapiens
  misc_feature 1..154: note = chr2:182322038-182322192
  misc_feature 1..154: note = hyper
  source 1..154: mol_type = genomic DNA
cgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggc

SEQ ID NO: 258 - DNA, 631 bp, Homo sapiens
  misc_feature 1..631: note = chr2:182322399-182323030
  misc_feature 1..631: note = hyper
  source 1..631: mol_type = genomic DNA
cgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcga

SEQ ID NO: 259 - DNA, 495 bp, Homo sapiens
  misc_feature 1..495: note = chr2:182547437-182547932
  misc_feature 1..495: note = hyper
  source 1..495: mol_type = genomic DNA
cgtgcctaggctctcatttttccaactttggggagttccggaggagaactggggacggagtgggagaaaggactccagctagcttcgaggtcaggggtagcctagaggtccctctgctaaatccttgtcctcacccccagaaagcagaaacctccagttcgcgacatcctgtgcaatacaggagaattatggtggagtcagatgttcttgagcaagagggacgcccgagtgttttgccagacggagactcaaatgcgtaaagtgcgggaattactagtctgtttcctccctctacccttgataaattcatctctaatcccactgcgcgttgttcgctcaggcctggagatttgtacaaaggaaaggccactccaggatgtttcagagacagggctgaggttgggtctcacggtagctgtccttgggcttcccatcccgcagcgctccgatgtgaccctcctctgcgcggaaaatttcgacccggggcgccggcat

SEQ ID NO: 260 - DNA, 100 bp, Homo sapiens
  misc_feature 1..100: note = chr2:182548061-182548161
  misc_feature 1..100: note = hyper
  source 1..100: mol_type = genomic DNA
cgagagaagagagtcagccggatcccggagaggacagagctgaaggcgcggcggggcttagcactgaggaccttctccgcggccccgctcctcctcctta

SEQ ID NO: 261 - DNA, 29 bp, Homo sapiens
  misc_feature 1..29: note = chr2:200327423-200327452
  misc_feature 1..29: note = hyper
  source 1..29: mol_type = genomic DNA
ggaggtagagactgtggaggtcctcctcc

SEQ ID NO: 262 - DNA, 394 bp, Homo sapiens
  misc_feature 1..394: note = chr2:219736151-219736545
  misc_feature 1..394: note = hyper
  source 1..394: mol_type = genomic DNA
caggccccagctgaccgccccagcccgcgctgattgcacctgtctgcattcacagacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggtgc

SEQ ID NO: 263 - DNA, 102 bp, Homo sapiens
  misc_feature 1..102: note = chr2:220299533-220299635
  misc_feature 1..102: note = hyper
  source 1..102: mol_type = genomic DNA
aatcgccggccgccccggtgaccttctgggtagcacaggccgaaggcgggcgggcagcaggaaggcaggccgccggccccccagacttgtctcctagggcac

SEQ ID NO: 264 - DNA, 174 bp, Homo sapiens
  misc_feature 1..174: note = chr2:220299885-220300059
  misc_feature 1..174: note = hyper
  source 1..174: mol_type = genomic DNA
cgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgag

SEQ ID NO: 265 - DNA, 618 bp, Homo sapiens
  misc_feature 1..618: note = chr2:220349101-220349719
  misc_feature 1..618: note = hyper
  source 1..618: mol_type = genomic DNA
aagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttgg

SEQ ID NO: 266 - DNA, 749 bp, Homo sapiens
  misc_feature 1..749: note = chr2:223158730-223159479
  misc_feature 1..749: note = hyper
  source 1..749: mol_type = genomic DNA
ctttcagttccatgtcgttactcaggcgcagagacaccgcgcatgaagggaccttgatccgagctgggcttggctgccgtcagatcaccaatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggccctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctgaatgcatggatcctgcggttcgccttaagggaggaagaaccaaagccgacttgtccgcgcc

SEQ ID NO: 267 - DNA, 145 bp, Homo sapiens
  misc_feature 1..145: note = chr2:223161540-223161685
  misc_feature 1..145: note = hyper
  source 1..145: mol_type = genomic DNA
acgtacacacacacacgcgcgcctttacgcaccttcacaaacctcagaaataactcattggagagccccagatgtcagccgttaccccccgcccggtcttccccaacacaggggaccacagtctgggagccaggagggcaaggcc

SEQ ID NO: 268 - DNA, 220 bp, Homo sapiens
  misc_feature 1..220: note = chr2:223161806-223162026
  misc_feature 1..220: note = hyper
  source 1..220: mol_type = genomic DNA
cgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcc

SEQ ID NO: 269 - DNA, 32 bp, Homo sapiens
  misc_feature 1..32: note = chr2:223162859-223162891
  misc_feature 1..32: note = hyper
  source 1..32: mol_type = genomic DNA
tttcacaagtgtgggcgcagccgggacaattt

SEQ ID NO: 270 - DNA, 297 bp, Homo sapiens
  misc_feature 1..297: note = chr2:223162928-223163225
  misc_feature 1..297: note = hyper
  source 1..297: mol_type = genomic DNA
cggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagtaggtcctcgcccccgactggtgcttcttggggtgtggggtgcccagggaatgggcttcctggaagcaccaaaggagcctgcggagcctggggatggggtgaggcagccggtcccaggccctgggatccagg

SEQ ID NO: 271 - DNA, 337 bp, Homo sapiens
  misc_feature 1..337: note = chr2:223163472-223163809
  misc_feature 1..337: note = hyper
  source 1..337: mol_type = genomic DNA
cggggaggggggctgtcggttcctagtccagaggccggagctggaacccgggaaaggggaggacggggaggccccggagtccaggatcccgagcccagggcggaaaagtttggtacgagtctgggcaaatgttccagcgactggggtccctgaaaagggggctcagagagccacggcgagccggggagcctggtgaggctggagcgcggcctgcctgagtctcctcctgtggtgacaccgagtgcggggatccgggctcgggagcatttattagttcttttacccaaagcttggtcaggagccctgagctgcgattggccgacgggtagaccgtccc

SEQ ID NO: 272 - DNA, 193 bp, Homo sapiens
  misc_feature 1..193: note = chr2:223163810-223164003
  misc_feature 1..193: note = hyper
  source 1..193: mol_type = genomic DNA
ggtggcggagacacgcgctgattgggcaacagcgaccactttctcttcccatctctggtggtgccgaggcctctgctggccccgagggggacccgcgctgcgccccttgcccaggagagaaggttggcccggtggaaactgagagagacagccccagggagatggcagttgctgagggcggagaagttcctgt

SEQ ID NO: 273 - DNA, 416 bp, Homo sapiens
  misc_feature 1..416: note = chr2:223176096-223176512
  misc_feature 1..416: note = hyper
  source 1..416: mol_type = genomic DNA
gaattctaagcttctcgccttcctgttacagccgatctgctctgcatttggaatgcggcgtctttgcgggcgttctgagtcattcctactccgctgcaagccccgcagagaacctcgccttcttcccgaccgccaagtctgattgtacagacttcatagaaggtctggaataaggactgtgttgctgcagaggccgggtcttgggcccctgggcgtgaggacgcaggctcggcccctgggaagaaatgtactaacgcacctcaagactcctaaggtgtttccaagtcccccctccaactttcgtgtccaggtcacgctgccccgccctcggacaatgagagggtgtgtcaagatgctctttgcatctttggaagccgagggggaaataggagactttcgacggggagcaggttttc

SEQ ID NO: 274 - DNA, 307 bp, Homo sapiens
  misc_feature 1..307: note = chr2:223176719-223177026
  misc_feature 1..307: note = hyper
  source 1..307: mol_type = genomic DNA
cgtgggcatcttggaatattaaaaacgtcatccggttgtaaataacctactccccagcccttgaaatccgggacgtcacaggtgaggctgaataccaggttcgcacaaaggcaaaccaaactcagccgggatgccgagtgatggggttggcaagatagtgtggcctctggttccctccacgcgtgataagtgggatcatgacagcgtccttgtgccttcgatttgtccccaagccctcctctgcctttccgatctcaaactaacccgtaatggagctggcaagtgggacgaacgggacagcctaaag

SEQ ID NO: 275 - DNA, 277 bp, Homo sapiens
  misc_feature 1..277: note = chr2:233350263-233350540
  misc_feature 1..277: note = hyper
  source 1..277: mol_type = genomic DNA
gccagctccagacctcgcggagacgtcaacccagcccgccggcgcgcctctccctcctggccctcactgcctgccagagggctgggaaattgcggctcccgcggctcctctaaacaccgcaattaccccagggaaattacttgcgccctcctcccgcgctctgcctctgtgcgctcccctcccctcccctctcctgctcgtctcttccctcctctcctctcacgcacccgcctcccgcgcgcagggacccctgggcaaggccactgcgccccggatc

SEQ ID NO: 276 - DNA, 436 bp, Homo sapiens
  misc_feature 1..436: note = chr2:233350843-233351279
  misc_feature 1..436: note = hyper
  source 1..436: mol_type = genomic DNA
cgccaggcccacccccgggccgcgccagcaggcgccgtaggcgctcctcgttttgctcgccgatggccgcgatggtgccataggtgagcttgtcgtcggggatggcgtggcgccgcagccaaccgccgcaggcgaacgagtagaagtcctggcatgggtcgatgctggcgtccaggttggcggccaggaagcgagcggcgcgcgcgaaggccttgcgctcagggcagccctcgggacaggcgccgccgccggccgcgaccgggcccaggtacttgagggccagcatagccgccagaatggcgcagaggccggcggcgaacaccagccccgacagcaggcacacctcgcgccggttccagcgcggcagcccggaccgggccccggtggcgctgcgcgcagcgcccaacgggaagcccgggggcagggaggccccgcg

SEQ ID NO: 277 - DNA, 181 bp, Homo sapiens
  misc_feature 1..181: note = chr2:233351415-233351596
  misc_feature 1..181: note = hyper
  source 1..181: mol_type = genomic DNA
cgtggccgccggcctcctcgtgggcctccgcatggccctggggccgcagctgcgggaagggcggaagcaggctcaggaggcgccgcagccggatggggctcagggtcaccgcgaggagggacacaggcctgggtgcagaggccccagccgcgggcctcattcactgcggaaaccagggact

SEQ ID NO: 278 - DNA, 351 bp, Homo sapiens
  misc_feature 1..351: note = chr2:233352101-233352452
  misc_feature 1..351: note = hyper
  source 1..351: mol_type = genomic DNA
cgagacgggttccctccccccactcccaccatctctgtccccgccccgagccactcctggcttcaacaggttctccccagaacccaaacttgggcgaagtttcacccccggcggggagcgagctggctggcgacccccgagccccggcgccgtgcggcgcagtccgcggagcccgagagccgagcccgggagccgcagccgcagccgcagccggagccgcagccgagaggacgcagacaaagccgggaggctccgcgcagtggcggcggcggcgacggaagtggccgcggtggtggcctcagcggcagggactcgggcgccacttacccggcaggtgcgcgcccgagccgg

SEQ ID NO: 279 - DNA, 257 bp, Homo sapiens
  misc_feature 1..257: note = chr2:233352506-233352763
  misc_feature 1..257: note = hyper
  source 1..257: mol_type = genomic DNA
cgggcgtccggtgtctcccagcgcccgccgcctcctctgccgccgcgccgagcccgccgcgccgcccgcctgccggcccgagggagggggcgcgccggcggctccaccctcctccgcccgccccgcgcgcccctccttcctcctgcatctctcgggccacctggcagtggggcggcagcgcggacgtgggtcggcggccgcggagacaggctcccgggggtcgtgcgcgggctgcggtcggggactccgggtccagc

SEQ ID NO: 280 - DNA, 136 bp, Homo sapiens
  misc_feature 1..136: note = chr2:233352775-233352911
  misc_feature 1..136: note = hyper
  source 1..136: mol_type = genomic DNA
cgagtgagggcagcgagtactcccgtgaagggtcccctccgatccagtgtccccactcccagccgcccaccagccggctggaaaggggctggagctggagatgaggagccgaggactcctccgaagggctgggggc

SEQ ID NO: 281 - DNA, 357 bp, Homo sapiens
  misc_feature 1..357: note = chr2:237072641-237072998
  misc_feature 1..357: note = hyper
  source 1..357: mol_type = genomic DNA
cgaaaaccaagtctgggccattttccgccaccggaactgttgggaacgcggcgggaaagggtgactcggtcgctcccagccttcaccctgcgcctgaagtttgggtggaggtcttggtccccaggcccctccgccgtggggaggtgacggcctgtaagtagtaaaaattaagtcaatattagtactaacccatggcgggccgcgcttccccttcttcggctgagaacctcgccgagggccgagcgccgctgcatcgcagcggctcaccggcctcccctccttcccccactcgaaaggctgaggctggcgaagccccggcttctctcgcgcttcgggctgctggcttggtggcaccac

SEQ ID NO: 282 - DNA, 16 bp, Homo sapiens
  misc_feature 1..16: note = chr2:237072999-237073015
  misc_feature 1..16: note = hyper
  source 1..16: mol_type = genomic DNA
ctcacactcgctggcc

SEQ ID NO: 283 - DNA, 440 bp, Homo sapiens
  misc_feature 1..440: note = chr2:237073056-237073496
  misc_feature 1..440: note = hyper
  source 1..440: mol_type = genomic DNA
cgcgcttcggggtccggcagcgagcggacagggctctgagcgcagggccggggttgggacaggagtgggcttggggaccaggcacgccccaccgagatggggaggcgcgcagctccccgtcccttgcagaccgactcccagctcccctgcgtagcctctcccgttttccccctttgtggtgcggactaccggggcgtccttggggtggggcggtgcccgggtcccgccccctcgaccccgcccggagggggaggtgccggggccgggggcgctccagccagcctccgcctccgactgagggctgccgggaagccggctgggctcgctgggtttttgctcctgtcgccagataacgcccggagcctgatttatggaccctccactctgccggcaggcgagcaccgcttcttttcgggccggagatatttgtaaaggaaaga

SEQ ID NO: 284 - skipped

SEQ ID NO: 285 - DNA, 377 bp, Homo sapiens
  misc_feature 1..377: note = chr2:237082343-237082720
  misc_feature 1..377: note = hyper
  source 1..377: mol_type = genomic DNA
cgtccaacacacggagaaggaagaagcagaggccagagacgatggccggcgcttagctgtgagccccatgagcttccaatgctcgccaggagaccgtgtgtctaggagaggcaggccatggaccctatgagtcttccctggaggctggaaccccccgggactcctggacaccccaaaccaagtccccagccgctgcctccacgacggccccgacccccttcagggaagtagtattttaaagaggatgcggtctgcccggagggcacgcatttaaccctttagaaaccgcgctggagggagcagaagggtgttgaatcaacagccatgcacaccaggggcacccctccaactttagcttcttccgggaccaaatgagc

SEQ ID NO: 286 - DNA, 187 bp, Homo sapiens
  misc_feature 1..187: note = chr2:241393223-241393410
  misc_feature 1..187: note = hyper
  source 1..187: mol_type = genomic DNA
ccgggacccccagggcggcgacgctgccgccggtgccgccgagcctttgttccgccgccggggccggtttcacgcctgtcgccctcgcaagcagccgcgggtgacaggagccttagccggcctggggcgcggaccctcccacccggggcagaggtgtccctacgacgcccctcggtttcgggtcgca

SEQ ID NO: 287 - DNA, 522 bp, Homo sapiens
  misc_feature 1..522: note = chr3:239347-239869
  misc_feature 1..522: note = hyper
  source 1..522: mol_type = genomic DNA
ggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccgg

SEQ ID NO: 288 - DNA, 182 bp, Homo sapiens
  misc_feature 1..182: note = chr3:11035171-11035353
  misc_feature 1..182: note = hyper
  source 1..182: mol_type = genomic DNA
ttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccc

SEQ ID NO: 289 - skipped

SEQ ID NO: 290 - DNA, 194 bp, Homo sapiens
  misc_feature 1..194: note = chr3:13590447-13590641
  misc_feature 1..194: note = hyper
  source 1..194: mol_type = genomic DNA
cgcgccgggcggcctctaggagccgggtcagcgagtctgggctctgagcgagcggcgccggcccggccccctctccggcgggcggccgagaccccgccccggaggcggaggcggagtcaggggagggggccgggggccggctggtcccgcctctcgcgcctccgccccgccccgcgcgcacacagccaggggcc

SEQ ID NO: 291 - DNA, 48 bp, Homo sapiens
  misc_feature 1..48: note = chr3:13590973-13591021
  misc_feature 1..48: note = hyper
  source 1..48: mol_type = genomic DNA
cgggttcccccaccccaggtccgcagcttcctccgctctgggtttcac

SEQ ID NO: 292 - DNA, 606 bp, Homo sapiens
  misc_feature 1..606: note = chr3:32858353-32858959
  misc_feature 1..606: note = hyper
  source 1..606: mol_type = genomic DNA
gcggcgttggccacgcggctcccgagctcgccgcgcggggctgttgccggttccactgattccagcgcgcccgagaggagcctccatccccgaggctcgggatcggaggggggaccaaggcgagggcgaaatggcccgatgacaaaggaaatgtgatcccccttctctgccaaggtttcagagaggacggacgtgaggaggaggaggggcgcagggcgcgcgcggagctcggatagcattgcacgacggcccgcgcggagcgggtacatctaatatcttcctgccgatgaataattcagggcggcccgcggggacctgcggccccgcgcgctaagccgaaggggaaggagcgtgcgtgaggcgcccaggccaggcgaggcgggggcacgagggctccgggccgcgtggggcgcgcgtgcgtgttaagcgcgggcagccgcggcccggctgggcaggcgcgcggaagactcgaggcgcgtgggacgcgcgtgcgtactgcacgcgtgcggccgcggctgggccaccacgagctgcagctgctgcggggcccaccgccctgcaggggaggccgtgcctggctgtgcgcaagccccaagcgcagcacgc

SEQ ID NO: 293 - DNA, 30 bp, Homo sapiens
  misc_feature 1..30: note = chr3:32859255-32859285
  misc_feature 1..30: note = hyper
  source 1..30: mol_type = genomic DNA
cgctcgcccctcgcctgtcggggcttgttc

SEQ ID NO: 294 - DNA, 800 bp, Homo sapiens
  misc_feature 1..800: note = chr3:32859417-32860217
  misc_feature 1..800: note = hyper
  source 1..800: mol_type = genomic DNA
gggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgc

SEQ ID NO: 295 - DNA, 321 bp, Homo sapiens
  misc_feature 1..321: note = chr3:44063500-44063821
  misc_feature 1..321: note = hyper
  source 1..321: mol_type = genomic DNA
ttctcctcaatctaacggagccattaacatctattaataacgccgacagggtaagtaacggagccgcgctcctcggggtggtcaccgggctgcgtggtcctcggccggcctcctgcatccgctgcccctgtgcgctccgggccggatgcgcaagggcggcgcggggaccaagcctggctgccggccgcctactcctccccttccctaaggtaaggggtcgttttcacactcaccagagctcctgcgggctgagctcgccccctcccccgacttctttgcggggcattttctcttgctggtgtattacgtgtcatttctcac

SEQ ID NO: 296 - DNA, 409 bp, Homo sapiens
  misc_feature 1..409: note = chr3:48693292-48693701
  misc_feature 1..409: note = hyper
  source 1..409: mol_type = genomic DNA
ggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcag

SEQ ID NO: 297 - DNA, 31 bp, Homo sapiens
  misc_feature 1..31: note = chr3:48693851-48693882
  misc_feature 1..31: note = hyper
  source 1..31: mol_type = genomic DNA
ggccccttcaaagaccgcgcgcccagaggcc

SEQ ID NO: 298 - DNA, 272 bp, Homo sapiens
  misc_feature 1..272: note = chr3:48693883-48694155
  misc_feature 1..272: note = hyper
  source 1..272: mol_type = genomic DNA
ggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgca

SEQ ID NO: 299 - DNA, 164 bp, Homo sapiens
  misc_feature 1..164: note = chr3:48698847-48699011
  misc_feature 1..164: note = hyper
  source 1..164: mol_type = genomic DNA
tcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtc

SEQ ID NO: 300 - DNA, 363 bp, Homo sapiens
  misc_feature 1..363: note = chr3:48699376-48699739
  misc_feature 1..363: note = hyper
  source 1..363: mol_type = genomic DNA
ggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatcc

SEQ ID NO: 301 - DNA, 443 bp, Homo sapiens
  misc_feature 1..443: note = chr3:62353488-62353931
  misc_feature 1..443: note = hyper
  source 1..443: mol_type = genomic DNA
gtttgtggcatccaccgagatttcggagttaaatctgcatattcctctgggtcccaatctcccctaagcgaactgcagccagaacgagctaacatttaaattccccctcgcttcctcttcccccctcccctggctgcgtcttcctagacttgaggggaggaggggaggaatacaaaaaaacgaggacgctctcctttcaggaaatggaattctaatgtacgcgttcctatttctgaatcggaggtactaaaaatacccccgcgacagcctgaggaagctgtcgccgtcctctgtgcaaacaaaatcgacaattctccttccccgcgcaatgggtctgcgaattgggcggcgggcggggacagaaccgttggctgaccaggacacaacctccatcctgccccagagcgtctttctccgagccccaaccccgagattcttcctcc

SEQ ID NO: 302 - DNA, 446 bp, Homo sapiens
  misc_feature 1..446: note = chr3:62355774-62356220
  misc_feature 1..446: note = hyper
  source 1..446: mol_type = genomic DNA
tagtcaggtcctttgcggagggggcagcagggcccacgctgtcgtggagtttgcgcacatgtttctttaagtcaaagtttctgcaaaaccctttgccgcaagtggcgcacgtgaaaggcttcttgtcgttgtgggtgtgcatatggaaggttaggttgtagacctggtggaaggccttgttgcagatggtacatttgtactgcttctcgccgctgtgggtcagcttgtggttcttgtagttccctacaacagatcaagaacaaaaaacgtgggggtatggagtagaatggtggggaggaagaggcgggcgtcccaggggcagcccaggtgcctgctcaaaaaaggcgacgcttggctaggcgggcgcgacctcttcgagtgaagaagttgtcaaacttcgtaagcgtcaagccgggtgctctcccgacaagaccgagactgagtcc

SEQ ID NO: 303 - DNA, 279 bp, Homo sapiens
  misc_feature 1..279: note = chr3:62356366-62356645
  misc_feature 1..279: note = hyper
  source 1..279: mol_type = genomic DNA
cgcacgaacccgggcttcatcctttttcttttcccccttctcatttttaaagttacttctttctcgccccccaactaccaactgaagatccaaaagtgccttggaaaatccgatccaggggccaaggatcataccggtttcccccaatcttagattgttcccgggagggttattttgcctccaatatttttcatttgaaagggaagttccggatacaaaaggaacctttttctatagggcaataccctctccttttcctacatcctttccttctgtccc

SEQ ID NO: 304 - DNA, 367 bp, Homo sapiens
  misc_feature 1..367: note = chr3:62356792-62357159
  misc_feature 1..367: note = hyper
  source 1..367: mol_type = genomic DNA
cgccttctctctccagatccctctttgccttcctgccagccagccgcgacccgagtcctgaggtgaggtgagaagagaaggcctcgcctggcacgttacctttttggtgaaagcctttgccgcaaaattcgcagacgaagggcttgtagcccgcgtggatgcggatatgcgtgttgagcgtggagctgcggttgaacgctttgccgcactggttgcatttatgtggcttttcctgaggaaaggggcgagtgcacagtaaggagaggccacctcgggaacacctggaagggacatcccccccacccccactcaaccctagagggtaagggataatctttggccatcgtatccccggtgttatcactaa

SEQ ID NO: 305 - DNA, 1051 bp, Homo sapiens
  misc_feature 1..1051: note = chr3:62359440-62360491
  misc_feature 1..1051: note = hyper
  source 1..1051: mol_type = genomic DNA
tatcagtctagtagccgaagtatcccttagccctccgcagccgagctgggcatcgtgctaataaactgccatttacccacggaaccggcgccagccccgaacacgcgcaaatgataattacctcattaggatgtggcgcatggacgcgggcgccgcgtttggaggggggaacttgttaatggggaaatattaatttatgcaaaagcaatgagctcgccttggctggcgtcggaggtcgggagaaagctcccactgactaaggacgaccccgaagcgtcacggagagcaaggccgctcgccggcatctcgggggcctcggcgccgcgcaggtgcgcctccagctttatggccagctctgggtctgaggctgggggagactaaaccgagagctggaagactttcggagatcctaatagatcagaattgttgatttatgatcgggtttctgaggcaaagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagacaggccccaagtaagttcggaggaattcagcgttttgtgcctggcgcacaaaagcagcgcgctccgcgcttggtttggaggggctgaattcatctgtttgcagaccattccacctgcgtatcacaacaaactgctcaaagacgctccagcactttcaacaggccgggtgctcttggcgacaacaaaagtgg

SEQ ID NO: 306 - DNA, 31 bp, Homo sapiens
  misc_feature 1..31: note = chr3:68980916-68980947
  misc_feature 1..31: note = hyper
  source 1..31: mol_type = genomic DNA
gggtgggggtgggggcggggggacgctgacc

SEQ ID NO: 307 - DNA, 270 bp, Homo sapiens
  misc_feature 1..270: note = chr3:68980948-68981218
  misc_feature 1..270: note = hyper
  source 1..270: mol_type = genomic DNA
gctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacagg

SEQ ID NO: 308 - DNA, 173 bp, Homo sapiens
  misc_feature 1..173: note = chr3:121902777-121902950
  misc_feature 1..173: note = hyper
  source 1..173: mol_type = genomic DNA
taagcttctttccatcgccaaggagtaggggtcagggaagaggacagcgggaacaggatttgagagccgggaacccctggctcggcacgggagagggcaggagaggacctaagcgcggggctcgccgtctgctggggacccgagccggcctgtggccctcggggaaccgaaga

SEQ ID NO: 309 - DNA, 229 bp, Homo sapiens
  misc_feature 1..229: note = chr3:121902990-121903219
  misc_feature 1..229: note = hyper
  source 1..229: mol_type = genomic DNA
cgggctaaggagacggtgaaggaaccgggactaactggggtaggggttagaaggcagcccgcgagtgggctacgaggggagctgggctcggcagttggggaccccgagggggcaagcgggcggggagcaggagaggggcggagctccggggccggggccggggccgcagcggccgcccagagggtctgcgggggctgctgtggccggacccgaaggcgggcgccgggag

SEQ ID NO: 310 - DNA, 325 bp, Homo sapiens
  misc_feature 1..325: note = chr3:121903323-121903648
  misc_feature 1..325: note = hyper
  source 1..325: mol_type = genomic DNA
cggccgaggggccggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggcagcgggtcgcccacgcgaatgaacgggagcgcgcaccaaaacgcct

SEQ ID NO: 311 - DNA, 92 bp, Homo sapiens
  misc_feature 1..92: note = chr3:129693108-129693200
  misc_feature 1..92: note = hyper
  source 1..92: mol_type = genomic DNA
ctcttgctctactctcgcccgtctgcgttctacattggttctgcggccgtgtccctttcgtgtgtgtctgccctgtgtttctccgtcgtctc

SEQ ID NO: 312 - DNA, 195 bp, Homo sapiens
  misc_feature 1..195: note = chr3:129693304-129693499
  misc_feature 1..195: note = hyper
  source 1..195: mol_type = genomic DNA
cgtgttctcgtcaacagatctccagaggtggtgcagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgcgacccctccc

SEQ ID NO: 313 - DNA, 259 bp, Homo sapiens
  misc_feature 1..259: note = chr3:129693954-129694213
  misc_feature 1..259: note = hyper
  source 1..259: mol_type = genomic DNA
ggacagagctgggtattcagggcgtcggcctgagaacctgggagttcgaatcccaatctcaacgctagaaatagaattttagcgttgaagttaggattttagcgttagaatcagattcctggcttagtcatgaaagcttagcattagaaatagaatcttagctttgcaaatagactttgagctttagaacctgaatcttagcgatagaaatgggatcttcgcgttggaatgaggacgtcggccacggagcttggagtta

SEQ ID NO: 314 - DNA, 698 bp, Homo sapiens
  misc_feature 1..698: note = chr3:137479943-137480641
  misc_feature 1..698: note = hyper
  source 1..698: mol_type = genomic DNA
tacgcgcaggagctgcgtgaaaggagaggcccagagccagaaaagaggaaggcgcatcctggacgctctgcgccctggagggagacgaaaggcccggagagaagcagattaggtcggtgcccttagaggcctcttccttcacttccgggaaacagcggcggttccctgacaaaatccctgttgctcgggggttcggacgccttgctaaggctggcacgcagcggaccttgagtagctgcgctgtgtactgaacgtgtgcacagcttctccaggcaaatgtgcaagcggaaagacctcatccaagcgttatctccagccctggaggagaatgaactggtagcctggggccaaacttcaggccgtggacaaagcaggaggagtatttaggcaacctctgtcctaatgcttgttctggttgtgaccgaagttgctgactctcctcaggggtcacgtctccaggacgtgctacccggtggtttagacccgtcagggaggcacagcgtgaagggacagcgcagcgcagtagaggcacctgctggagacagcaccaggccagaccccaggatcacgggaactcctgctcccgccacagctctaaagagtgttgaataaaccggtggtcaccggtactgcgtaaggggtgtgcgtggctttgcagttcgcctaggagacaagctgatgcacggcctggaaggtgc

SEQ ID NO: 315 - DNA, 145 bp, Homo sapiens
  misc_feature 1..145: note = chr3:137481170-137481315
  misc_feature 1..145: note = hyper
  source 1..145: mol_type = genomic DNA
attccttcccaaagccgtcgggatcgcccagtagaattagaattgggtgattcctgaatctcctatccctggctggctctgaatatagcgcaccgctggtcagacctgagtaggggttgccagcgacgctcggaaaccctttcca

SEQ ID NO: 316 - DNA, 519 bp, Homo sapiens
  misc_feature 1..519: note = chr3:137488807-137489326
  misc_feature 1..519: note = hyper
  source 1..519: mol_type = genomic DNA
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaaggg

SEQ ID NO: 317 - DNA, 15 bp, Homo sapiens
  misc_feature 1..15: note = chr3:137489684-137489699
  misc_feature 1..15: note = hyper
  source 1..15: mol_type = genomic DNA
agagaaagacctgac

SEQ ID NO: 318 - DNA, 1135 bp, Homo sapiens
  misc_feature 1..1135: note = chr3:137489875-137491010
  misc_feature 1..1135: note = hyper
  source 1..1135: mol_type = genomic DNA
cggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccgaatccc

SEQ ID NO: 319 - DNA, 161 bp, Homo sapiens
  misc_feature 1..161: note = chr3:138658703-138658864
  misc_feature 1..161: note = hyper
  source 1..161: mol_type = genomic DNA
cgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggt

SEQ ID NO: 320 - DNA, 668 bp, Homo sapiens
  misc_feature 1..668: note = chr3:138665557-138666225
  misc_feature 1..668: note = hyper
  source 1..668: mol_type = genomic DNA
ccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtgg

SEQ ID NO: 321 - DNA, 105 bp, Homo sapiens
  misc_feature 1..105: note = chr3:138679188-138679293
  misc_feature 1..105: note = hyper
  source 1..105: mol_type = genomic DNA
agtagcatgaagaggcgggaaattcaggatgggagagggctgcaggacaaagactgcgggcagtccggccgggttcctgggtggaggaaggaaggcacgtttccc

SEQ ID NO: 322 - DNA, 82 bp, Homo sapiens
  misc_feature 1..82: note = chr3:139653491-139653573
  misc_feature 1..82: note = hyper
  source 1..82: mol_type = genomic DNA
gctatctactctgcccgacaacccctagcaccactaggcgctgctctagtgtgcgcctggcgccctccccagaccagtcgac

SEQ ID NO: 323 - DNA, 298 bp, Homo sapiens
  misc_feature 1..298: note = chr3:139653574-139653872
  misc_feature 1..298: note = hyper
  source 1..298: mol_type = genomic DNA
cagaacgcccagagacccagccaagggcaagacccttagcgacgcccgtcagtcctctccgcccagatatcagttcaaagggcatggcaggtcagggtccctcgcgccaccccagatgaccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagac

SEQ ID NO: 324 - DNA, 682 bp, Homo sapiens
  misc_feature 1..682: note = chr3:139653873-139654555
  misc_feature 1..682: note = hyper
  source 1..682: mol_type = genomic DNA
gctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcaga

SEQ ID NO: 325 - DNA, 674 bp, Homo sapiens
  misc_feature 1..674: note = chr3:140769628-140770302
  misc_feature 1..674: note = hyper
  source 1..674: mol_type = genomic DNA
gtagagcaaagagaccgacttcctgcgcctcgggtgggcggggaacgctccttgagcaggtgcggtatgaaattggactttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatgaatccgggaggacccgcgcgcaggaatgaatgcgagagctagggagtgagcgggcgagtgggcgggtgagtgaatggcgaccgcgccgccgccttggcacaggggcgcgggcgcgggctccacttccctctcccgccagctggtggcctcgagaaggtggcggcgccggcagcggcccgagctgggacggccggggcgcgggatggtgggggaaggggcgttcccggcgaccgcgccttccgcggctattggattagtggccttcagggatgagctcagccagatcggctttcagctgcagcctccgggccggccgggaaggcggggagcgggcggcggcggcggaggagggggaggcggcggcggctgcagcatccagagctggccgtggcggc

SEQ ID NO: 326 - DNA, 183 bp, Homo sapiens
  misc_feature 1..183: note = chr3:140770407-140770590
  misc_feature 1..183: note = hyper
  source 1..183: mol_type = genomic DNA
cgctggggaagacgcccggcgcgccgggggccagcggccgaggcgcggcccgtgcgccctgagcgcgggactcgtcgccctccgggtcaggcgccaagcttccaagcggctagagcgcgggccttggagcgcccccaggatcgcttcagtaaggcgcttccccactccaggcccgacccccgg

SEQ ID NO: 327 - DNA, 40 bp, Homo sapiens
  misc_feature 1..40: note = chr3:140770643-140770683
  misc_feature 1..40: note = hyper
  source 1..40: mol_type = genomic DNA
cgcagagggggcgctgctgccgggcatcagccgtgaggac

SEQ ID NO: 328 - DNA, 356 bp, Homo sapiens
  misc_feature 1..356: note = chr3:140770684-140771040
  misc_feature 1..356: note = hyper
  source 1..356: mol_type = genomic DNA
cgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatca

SEQ ID NO: 329 - DNA, 355 bp, Homo sapiens
  misc_feature 1..355: note = chr3:141516389-141516744
  misc_feature 1..355: note = hyper
  source 1..355: mol_type = genomic DNA
acagttctcctgccacggcaaacaaaacatgtacattctgattccctcttctgtttggattgtgctgtcgactggatctggtttgtgatgagctgggggaagaggcatccgcgggcgatttctggctcggcgtgccagtgtgcttttgctgggccgcgccgggatcgcggagcttcctctccggctcctttctccccgtctgcgtcgctaatccagcctggcccggccaccccaagggaagacacggccgtttcttttgatagtggaattggaggttgccaagttttcagatttaatgggaggtggagggttgctcgtgtccttgaccttgaaggacctgcgcacactcatactt

SEQ ID NO: 330 - DNA, 229 bp, Homo sapiens
  misc_feature 1..229: note = chr3:147078959-147079188
  misc_feature 1..229: note = hyper
  source 1..229: mol_type = genomic DNA
gcctcattttctctccgttgttctcgggggaaccaaaataggggttgagattctggtctctacaagcctttcaagcgccttcaactttggcggcggcagcagcaggttgcgttgccatggatactgtactgtatggctgtggcggcggccacggcggccgcagctcgaatcccctaaacaatgccgagccaagtgcaggtttctcgcccttttccgtgcacttttctct

SEQ ID NO: 331 - DNA, 497 bp, Homo sapiens
  misc_feature 1..497: note = chr3:147110228-147110725
  misc_feature 1..497: note = hyper
  source 1..497: mol_type = genomic DNA
cgtgtaggagaggaaaggaccccgagaacccggaagcctagattcctgccggagctgcaagtgctgcggaaatgggggaagaaggtttctgggcgctttaaacaaatggctgcctcccagcgctctgagttaagggaccggctacctagcgtctagctgaggaggaagacgcgcagctggagaactgttgcctttgtagttgcttctcccgccgcatccaggaaaaacaggcgctttggggctggttagaacaaacaaagccccaattcccgagccctgttgaggctcggacagagaggtttgcgcacaacctgcgcttctgcgcaatcagcggctcctgagcccgggtctccggcaccacctggtcgctggattcccaccctacaggagcacagctagtacactgaacagtctggaaggtgttggcacctgccatttcgcgggacactggcaccattttataaaacagtgatagaaagatgcggaataaatcagtg

SEQ ID NO: 332 - DNA, 236 bp, Homo sapiens
  misc_feature 1..236: note = chr3:156009064-156009300
  misc_feature 1..236: note = hyper
  source 1..236: mol_type = genomic DNA
cttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggac

SEQ ID NO: 333 - DNA, 265 bp, Homo sapiens
  misc_feature 1..265: note = chr3:156009318-156009583
  misc_feature 1..265: note = hyper
  source 1..265: mol_type = genomic DNA
cgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaa

SEQ ID NO: 334 - DNA, 858 bp, Homo sapiens
  misc_feature 1..858: note = chr3:179168782-179169640
  misc_feature 1..858: note = hyper
  source 1..858: mol_type = genomic DNA
cctggaaggaggcctcggggagtgacgagaaaccaggggggtctgcaggacttggaccgccgaccgttcctcgctccccggggcgagcggtctggaccgcccgggaagtgcctgcgccggcggtcgtggggccagttcccgcgtggcagctgggcgcgacacaggcgcgccctcctcgtccctcccgggcagcgtcggccgcccgagcccggggagacccgccccgccccgcgccgtcacccgggccccgttccgcaggggtggctcgcggcgccccacgtccctgcgagaagcccgggatcgcttcgcggggcgcaccgacgagccgccgctcgcgagctcgccgcctacctggagggagctcaggcccgcgtcgaccgcgcgctgccggtgtccgctgggcgctcagcagcccctggagcgcggagccggcgtggagagcgcagctcacagccgagaccagagccgccggccacacccagtcccgcacctcccagcagccaactccgcggcgcgccggagccggggcggggacgtggctggaggcgcgaggcgcgaggcacgaggcgcgcgggcccggcggggacgtgccggggacgcgcagaccctcggagcgcgcgcagcccgggcggggggcgaagggagcgggcgccgcgcgcagcttctgcttcctattttctctctcgtttcctgccagaaggagaagaaaaacattcattcccgggcagtttcgttttcttgttggtgtggcgccggggcacgctgctaagtagcgcccgtctaagtggcgtggccagtttcctttccggcgctgacaggcgccagtttgcttgttagcaggatcgaagggcagagcta

SEQ ID NO: 335 - DNA, 255 bp, Homo sapiens
  misc_feature 1..255: note = chr3:179754505-179754760
  misc_feature 1..255: note = hyper
  source 1..255: mol_type = genomic DNA
agccccctggagctccgggtactcggccggccggcggccactcggcagcgctgcgggctgccgggaactgttctccgctcggggtgctgaaagcggacgcgggagagcgcgcagagaaggcgaggagccgggtcggccaggctctcctgcaggcgcgggtcctgctcgcggggcgtctctagaactcactccttcttcgccgaactctttctcgcttcctgccaggttgcctcatgtctctctctctctgagctg

SEQ ID NO: 336 - DNA, 70 bp, Homo sapiens
  misc_feature 1..70: note = chr3:179754803-179754873
  misc_feature 1..70: note = hyper
  source 1..70: mol_type = genomic DNA
cgccgccgcagctgccgagcggggcgcgcgccgttctcccagccgcgtgcctgccgagaggccgcgggac

SEQ ID NO: 337 - DNA, 286 bp, Homo sapiens
  misc_feature 1..286: note = chr3:179755086-179755372
  misc_feature 1..286: note = hyper
  source 1..286: mol_type = genomic DNA
ggccggaagaaaggcgggaagacatgcatcgtctctccgggggccatccaccgcggctgagcctgttatcctacagacattataggctgagtgcaggggttgccgaagagtttacttcggttctgattcagctctcgaaagttacgtccgtatcacccgttaaataaagactccccgctcccctcatccccagttcatcgccgagcattctatttaaaacggcaaaccctagtccctgaggatctggcatgttttatttttttccctagcacgtaacatcacctaa

SEQ ID NO: 338 - DNA, 743 bp, Homo sapiens
  misc_feature 1..743: note = chr3:181421539-181422282
  misc_feature 1..743: note = hyper
  source 1..743: mol_type = genomic DNA
tgaacccgcgccaaccgataaggtaagaaacggtgcgctgacagccgaggtccgaaggctgctcagtggttcccgcagcccgtggggtagggaggccaaagccagcaaaatgttggaggcgacgccagaaagagagtatatgcctgctattcggaagtgatgtcgaacgtgcaatagcagagtcctggagatttccaccccgttccgcacccagggatcccagcctgtggggtagcaggttgttgggtgaaggcaggagggagaagccgcacctggctgagggcgggtgggcgtgccgggagcgagtgcccaactttctagggcccatggagaaagcataacccctagttgaggaaagagagctaaacaagtgggtggcccaggcctgggaatgccacccagctctcccgacgcagtgttatttctgtggtcccagggggccccagcacctgcccgaatcccactccccaaggccgccagcaggaaggcagcccctccatctttgagggctgaggagggggcagcgagtgacttgattccttagtagcagggaaaaccgcagcggctggcaacgggccgcgtttctccgcggcggcaaagcgccctttaggggcggggcgggcatttttggtctcctgtcccagcgtccaggcctgagcccgcgcgggttggctgggcgccctgctttgtaagtaaccaatcttgctggattctgaggactatccaggcggatgggcccactt

SEQ ID NO: 339 - DNA, 729 bp, Homo sapiens
  misc_feature 1..729: note = chr3:181441019-181441748
  misc_feature 1..729: note = hyper
  source 1..729: mol_type = genomic DNA
tcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaaccta

SEQ ID NO: 340 - DNA, 448 bp, Homo sapiens
  misc_feature 1..448: note = chr3:181441962-181442410
  misc_feature 1..448: note = hyper
  source 1..448: mol_type = genomic DNA
ggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttc

SEQ ID NO: 341 - DNA, 130 bp, Homo sapiens
  misc_feature 1..130: note = chr3:187387791-187387921
  misc_feature 1..130: note = hyper
  source 1..130: mol_type = genomic DNA
ttttctcaagagcttcgggagctgagggacccagaaaagcaccaaaactctttagaaggactgagcatcccttacgtccaaaccaatggggcaggagcaaggcttagggagggctggagaatccgggaga

SEQ ID NO: 342 - DNA, 183 bp, Homo sapiens
  misc_feature 1..183: note = chr3:187388006-187388189
  misc_feature 1..183: note = hyper
  source 1..183: mol_type = genomic DNA
cgccggtgacacagcccagggccaggacgatggacagcgcagccagcgcgcactggaggcggcaggacagcatctcggcgccgcgaaagccgagctggagagtggctggtcaaactctaggcgcggatcagcaggcagcagcgatggctccgaacctcgctcctaaagcggcttgtgtgctct

SEQ ID NO: 343 - DNA, 406 bp, Homo sapiens
  misc_feature 1..406: note = chr3:192126305-192126711
  misc_feature 1..406: note = hyper
  source 1..406: mol_type = genomic DNA
acttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggc

SEQ ID NO: 344 - DNA, 63 bp, Homo sapiens
  misc_feature 1..63: note = chr3:192126786-192126849
  misc_feature 1..63: note = hyper
  source 1..63: mol_type = genomic DNA
cgggggcagctgtttccagctgcggtgagagcaactcccggccagcagcactgcaaagagagc

SEQ ID NO: 345 - DNA, 110 bp, Homo sapiens
  misc_feature 1..110: note = chr3:192126850-192126960
  misc_feature 1..110: note = hyper
  source 1..110: mol_type = genomic DNA
ggaggcgagggaggggggagggcgcgagggagggagggagatcctcgagggccaagcacccctcggggagaaaccagcgagaggcgatctgcggggtcccaagagtgggc

SEQ ID NO: 346 - DNA, 49 bp, Homo sapiens
  misc_feature 1..49: note = chr3:192126961-192127010
  misc_feature 1..49: note = hyper
  source 1..49: mol_type = genomic DNA
ctctttctctttccgcttgctttccggcacgagacgggcacagttggtg

SEQ ID NO: 347 - DNA, 59 bp, Homo sapiens
  misc_feature 1..59: note = chr3:192127314-192127373
  misc_feature 1..59: note = hyper
  source 1..59: mol_type = genomic DNA
atggggattacccgccggacgcaaggccgatcactcagtcccgcgccgcccatcccggc

SEQ ID NO: 348 - DNA, 175 bp, Homo sapiens
  misc_feature 1..175: note = chr3:192127556-192127731
  misc_feature 1..175: note = hyper
  source 1..175: mol_type = genomic DNA
cgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggaggggg

SEQ ID NO: 349 - DNA, 54 bp, Homo sapiens
  misc_feature 1..54: note = chr3:192127936-192127990
  misc_feature 1..54: note = hyper
  source 1..54: mol_type = genomic DNA
cgcccaggtggggccgagctgggggccgggcccctggagcgctgggaagcacag

SEQ ID NO: 350 - DNA, 290 bp, Homo sapiens
  misc_feature 1..290: note = chr4:8858758-8859048
  misc_feature 1..290: note = hyper
  source 1..290: mol_type = genomic DNA
ctgatcgcgacactgcactccagcctgggcgacacagcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggt

SEQ ID NO: 351 - DNA, 557 bp, Homo sapiens
  misc_feature 1..557: note = chr4:8859381-8859938
  misc_feature 1..557: note = hyper
  source 1..557: mol_type = genomic DNA
cggatcgttccgccgttcgccctgggtctgagtctgggggttcgggaaacaattttggacgtttctggttggattgtgtctaaatcgtgcattttacgcgacaggggactcgaggtccttgaggatcccaaactgccgcagcccctccctcctcctccccttgcccttgcccctgcccagagaagtgcgctcctccagggtcatccacacgcgccgtgccgagccccgggccccagttccaggagccgcgtctctacgggccagtgggtcctgagagagtagggcttcgggcgctcggggagaggaggcggaggaggggtgaagccgaggggtggcttttaacgaaaaagaagttgaagcatcagctaagccattagggctaatgcgatgtactgtaagacggggatcaatgccgggcctcggggaccggcgtgggggagggggcagcaggccgaccgcccccaagccggtcgaggcccccgtccatttgggggaaatggattttcgcgatttaagaaacaaacccaaatcaaatgagcgaggcccggatgtgctga

SEQ ID NO: 352 - DNA, 156 bp, Homo sapiens
  misc_feature 1..156: note = chr4:8869115-8869271
  misc_feature 1..156: note = hyper
  source 1..156: mol_type = genomic DNA
gctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcc

SEQ ID NO: 353 - DNA, 445 bp, Homo sapiens
  misc_feature 1..445: note = chr4:8869368-8869813
  misc_feature 1..445: note = hyper
  source 1..445: mol_type = genomic DNA
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattcca

SEQ ID NO: 354 - DNA, 273 bp, Homo sapiens
  misc_feature 1..273: note = chr4:10462775-10463048
  misc_feature 1..273: note = hyper
  source 1..273: mol_type = genomic DNA
tgccagtctctgagacgttttctcaactgcaaaacaggagtaactggagcaacctttcgtggagggtgccaggcgctggagcgtggctaaggcagggaccacgtcccagccgccctttcccgccctgcggcgcaggcccactctcttggctctcctggcccgcacactcagctcggccgccgcggctgccgcggaagcgcgcagtgaggctagtggggccacgagcggcgcgctgagcatgcgcgcccgatagagcctcgagatgcgccgggc

SEQ ID NO: 355 - DNA, 184 bp, Homo sapiens
  misc_feature 1..184: note = chr4:10463072-10463256
  misc_feature 1..184: note = hyper
  source 1..184: mol_type = genomic DNA
cggcctgcagtgtcgctgcgagcccggctggcccagctcggcgtgtagagctctaccccgcgcggcgggcggtgcagccccgcgctcacctgggcgtcttcgctcccgctcgccccgcgcttccgaaaatcgggaatgtaatgttttgtttttacattccaatttgctccctccccaggctggc

SEQ ID NO: 356 - DNA, 280 bp, Homo sapiens
  misc_feature 1..280: note = chr4:10463257-10463537
  misc_feature 1..280: note = hyper
  source 1..280: mol_type = genomic DNA
tggaatccgagggttcctgatgactgcagctcctcgcccctcccgctgtgttcccgccgcctctgggctgaaagcgccatcaggacccgtggcgcgtgggctttgttaagtcattaactgcttgggacatagcaggagcatggtgcgcggcacagaacaggcttggcttccacggcccatccaggcggagccgtcagcgtcccttgcctagaccagagctctggaaagcggagaggcggacaggggccgttccccagatctgttccggaggatgcagatc

SEQ ID NO: 357 - DNA, 83 bp, Homo sapiens
  misc_feature 1..83: note = chr4:13545940-13546023
  misc_feature 1..83: note = hyper
  source 1..83: mol_type = genomic DNA
cgcccctctggcgcggccagcccgccgcgctcctctttcttgttgaggatcgcctggatggagaaggacgtcaaggtgttggc

SEQ ID NO: 358 - DNA, 35 bp, Homo sapiens
  misc_feature 1..35: note = chr4:13548555-13548590
  misc_feature 1..35: note = hyper
  source 1..35: mol_type = genomic DNA
gtgagaaaggggctacgttccgcgtcttccggagg

SEQ ID NO: 359 - DNA, 328 bp, Homo sapiens
  misc_feature 1..328: note = chr4:13548634-13548962
  misc_feature 1..328: note = hyper
  source 1..328: mol_type = genomic DNA
cgcttagtcgatcattaggtctgtgggtgactgtaggcagagccgggagttgggtgcttggcgcggagggtgaactcgcgggtcttgagctgcaactagaagctgctcctagcaaggggtcgggtggagatgaaaagactgtggggaaggggaggtggttgtatgcccagagatatcccggcgtaactacggagtccaggcccagagtggcggtgtgtggcgaaggcgcagcaggcctgcgcctgtcggaggacggcagatctggacgcgaccgcgcgggcgtgcctgggtcccgcttcctgcccatcgagggcgacttccttcgggc

SEQ ID NO: 360 - DNA, 73 bp, Homo sapiens
  misc_feature 1..73: note = chr4:41258716-41258789
  misc_feature 1..73: note = hyper
  source 1..73: mol_type = genomic DNA
cccaccaacaaatcccgtctccacaaccaccagattatctcaccggcgagtgagactgcaaggtttgggggcc

SEQ ID NO: 361 - DNA, 381 bp, Homo sapiens
  misc_feature 1..381: note = chr4:41259085-41259466
  misc_feature 1..381: note = hyper
  source 1..381: mol_type = genomic DNA
cgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgt

SEQ ID NO: 362 - DNA, 333 bp, Homo sapiens
  misc_feature 1..333: note = chr4:41750266-41750599
  misc_feature 1..333: note = hyper
  source 1..333: mol_type = genomic DNA
tgtgtaagcaaatttcgtttggtaaatactaaacacatttccattttcaaatgcaatcaaggcttcctatatacgggcggaaaggcggcttcctccgctgagaaagctgaaggtccttacctgcggcgtacggactgctctggtggtccctgagggtgcccaggctgcaggatcccggcgtgagggaagggcagccggacgtggccccaaaagtggtccttatcgggttatactggaagccactggcctggctgcaggaactgaagtcagcataggctgaagccaggctcgaggtgtccatcccagccatacaggactcgtaggcagaggaat

SEQ ID NO: 363 - DNA, 341 bp, Homo sapiens
  misc_feature 1..341: note = chr4:41875410-41875751
  misc_feature 1..341: note = hyper
  source 1..341: mol_type = genomic DNA
aaccttttttgtaaccggctgaatggctgtatctacggagccagtaggttgcggaaaggcgttcgcagggtggaggagcgggtagttggggaaccgggcgcgcctgatggggcgcaggaaggaaaaactgatcgacgcaatggcccccgccaccggccatttggggctttcaaacgccctaacgaggagtccgagcggccactgaaagcctccctgttcctgggcagggcagccagagtgccctcccctctcccttcccagcctcccggcggcgccaccattaacccggagccagacccaggcggaggccccggcgccgaggcccgcggaagcaagagaca

SEQ ID NO: 364 - DNA, 689 bp, Homo sapiens
  misc_feature 1..689: note = chr4:41882935-41883624
  misc_feature 1..689: note = hyper
  source 1..689: mol_type = genomic DNA
gggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaagaaccttgcctaggagcgcgtggaaacagcaagggcgcccgagcgggagaggttccctcggtgagggggtccgcgcagcggcggaccccgcaccccggcccccaacggcgcctaggaagttgtcactcctctcatttaaagcctcagaaaaatgcattcatgagattgtttctttatttttcctttctgcccctctccgcattctttgcctatttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgatggatccgttttcaaacggcgcggggacggcagtgccggaggccgcgtctccttagtaatcgcgcgggcagggctcggcaaggggtcgctgcaagggtcgcgctcacccgccccg

SEQ ID NO: 365 - DNA, 451 bp, Homo sapiens
  misc_feature 1..451: note = chr4:42152961-42153412
  misc_feature 1..451: note = hyper
  source 1..451: mol_type = genomic DNA
cgactcccggggcaggaaggaggggcgggatggttccccgcgcccgaaatccacggcgtggcggacgcggaggagccccgagtctcacaaccaaggggtgggaaggaaaagggacagagcgagacagagcgcccccgagaaacacaggcgcacaaaaaaagacagaaggaaaaacggaactgagagccagccagcatggactgcgacagcgtgagagtgcatcaaagaggtggcgaagaaagcactagaaggcaaaggagaagtggagagaagaagaaacaaatggaggaagaaggagaaagggaaaaagcagacggaaaaagtgaagtagtacgagggcgtcccagcggggcggcccgagaagctccagcttcttcccgagcggccgccgctatcccccgggggggcgtctggccccactccggaccacgcccgagcgatcctggtcgcc

SEQ ID NO: 366 - DNA, 101 bp, Homo sapiens
  misc_feature 1..101: note = chr4:42153532-42153633
  misc_feature 1..101: note = hyper
  source 1..101: mol_type = genomic DNA
cggggaggccccaggtgcgccccgacatcccgacacggcccagcacgggtaagtgtcggcggccccccgcttctccttcctgggtcccctcccgctgcccc

SEQ ID NO: 367 - DNA, 504 bp, Homo sapiens
  misc_feature 1..504: note = chr4:42153881-42154385
  misc_feature 1..504: note = hyper
  source 1..504: mol_type = genomic DNA
ggcccggccgggcccgggggggtaggagctctgcgcctggaactgctgcggcggcggctcgctgctgctgatggagacggcggcgtgcggcgcgaagggcggcgggggcggcgggggcgcccgcacgtgcggcagctccaccagggtgggtcgctcgtagcgcttggccagcgccggtctcttgctggggaacgtcttgaggacgctgtaggggctgcgctgcttgtagattttggggacgctgggcccctcctctgccggctgcatctcttcctccatccggcgcctcggggccggtccctcggagcacgtcccctccccgccgggcgccgggctccgagggtgcctccgccgcctgcccgccgggtctgccctggtgcgcgcgtgtgggagggtgtgtgtctgtgccgtggccgccgccgccgccgcctgtcgctgaggctggcatcgccgagcccccgcgcggggggctgccgcccgagctcctgattgacaggctgcctc

SEQ ID NO: 368 - DNA, 611 bp, Homo sapiens
  misc_feature 1..611: note = chr4:42154386-42154997
  misc_feature 1..611: note = hyper
  source 1..611: mol_type = genomic DNA
ccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccggcttccgaaacgagctcgtggcgccccctgcatgaccccaaactctcggggttgcacagaggaggggctagtcgttggggcggggtcgtcagagtacgtgtgtattacagcaagttcttctaccaatcgggaattgctctccgatccttctgaaaagaacctcttgaagatcttggcccgggtggtcgcgcggtgtttacggggctttggggtcctgctttccccgagcatcgcggcctctgagctcatgcggaacataaaagctcgcaaggcgtagaactttttcacgttttcatttgtttcccgtaggggccccgagaacgtgcatgacaccat

SEQ ID NO: 369 - DNA, 130 bp, Homo sapiens
  misc_feature 1..130: note = chr4:54975802-54975932
  misc_feature 1..130: note = hyper
  source 1..130: mol_type = genomic DNA
tgtccttttctaggtcgggggtggggaggggcggtgggtggacgcagagggaggaaggctcagccttggatccttgccacctgaacaacgtcgcctctgcccacgtggaaagcctcgcttgtctggcagc

SEQ ID NO: 370 - DNA, 126 bp, Homo sapiens
  misc_feature 1..126: note = chr4:54975990-54976116
  misc_feature 1..126: note = hyper
  source 1..126: mol_type = genomic DNA
cgggcaccagcgtccgggcgggaagggacgtgtgcccaagcctcgcctcctggccctcagtgggctgggacgcccttgatcaccggcgcaggaaagaggctccccagcccgtgagcttcgtccggg

SEQ ID NO: 371 - skipped

SEQ ID NO: 372 - DNA, 159 bp, Homo sapiens
  misc_feature 1..159: note = chr4:57521505-57521664
  misc_feature 1..159: note = hyper
  source 1..159: mol_type = genomic DNA
cgccctccctcccggcctcagcctcctggttcgccaaaccggaggactgaatttatggctagctggtctctggggcgccttccagctctgacattcccgcctagaatagatcttcccgaaggtttcgcagacagaccagaggggaccgagccgggaagg

SEQ ID NO: 373 - DNA, 683 bp, Homo sapiens
  misc_feature 1..683: note = chr4:57521700-57522383
  misc_feature 1..683: note = hyper
  source 1..683: mol_type = genomic DNA
cgcagagggagaaagcgtgtatcccgggctgccggggagagtggaaaagaaaggactggtgaccgaggggtttctgcgcagctcccggggaaccacggctggatgggggtggcggggagaccgggcgcccatgggagcggggaagcggggaggcggcggcgggagccatgcagggtctgggcccctgggatgcgggcagaagcgatgggagatcatggggagggcagcccggcgggaggcgcggacgaacaggaccgcccagccgcgagaaggctcagcccaggcaggggtcggggcgcgctgggcgcgtgtggggacgcacctgggtctcctcctcggaaaggcctgcctcggccgcgatgaggcacagcgtggtggaatccgggtgcttgtcgaccttgttgaagttgtactccaggatttccacctggtcctctgtggggccgctcgcggtctccgccgacatggtccctgcgcgctgcggggcagggagaagcggcggcggtgagcgaggcgtggagcgggcgggacgcagcgaaggaaggcggtcgcggcgccgccgggcagccccagccccaggccgccccctccagcggtgccacggccgcgcaagtccccggtggctgcacgctgagcgggggcttacggctgccccccacccgggcctccctccctggactgag

SEQ ID NO: 374 - DNA, 396 bp, Homo sapiens
  misc_feature 1..396: note = chr4:57522419-57522815
  misc_feature 1..396: note = hyper
  source 1..396: mol_type = genomic DNA
cgcctcccgcgccccccgggaccccttgcaggaactgtatccctgcctgcgacgggggcgagatagatgattccgcgggccctcaccgacctccggctctaaggaaggagtgaaggaagcgcgggggtgattttgagaaatccccttaaaaacttcctcccgaaagggggacctcccctggggacagacttgacagatcgcgagggtgggttcgcccgagtccgcgactagccggcctccggcctccccggtaggcggccttctgtctccgcagtgggttggcgctttggggccctctccaggcagggctgcacaccccacccttcctccaaaaaagttccccgcaagacaagttacttctcaaagttggggagacggaggcggtgcttttaatgt

SEQ ID NO: 375 - DNA, 30 bp, Homo sapiens
  misc_feature 1..30: note = chr4:85404111-85404141
  misc_feature 1..30: note = hyper
  source 1..30: mol_type = genomic DNA
ggggcgcgtgtcagcgttggagagcctgcc

SEQ ID NO: 376 - DNA, 252 bp, Homo sapiens
  misc_feature 1..252: note = chr4:85404224-85404476
  misc_feature 1..252: note = hyper
  source 1..252: mol_type = genomic DNA
cgacctgcagggggcgtgcccggcatgggaagctcaggctacgtctccgaagcttgcgctgaaaacaccagaggtagggaaaacggggagagcgtactgtgctgggctctaccctggacaccccagtttcattctctgcgaagccacgcgctggcagggctctcgggacggcgatacccagggatgatggtacccctggtctcggcgggacctcccgggaacttgtcctgggggagggagcccaactggcca

SEQ ID NO: 377 - DNA, 44 bp, Homo sapiens
  misc_feature 1..44: note = chr4:85404649-85404693
  misc_feature 1..44: note = hyper
  source 1..44: mol_type = genomic DNA
cgttcggccgggctcagtaaagaatttgccgaaaggtagaaact

SEQ ID NO: 378 - DNA, 123 bp, Homo sapiens
  misc_feature 1..123: note = chr4:85419120-85419243
  misc_feature 1..123: note = hyper
  source 1..123: mol_type = genomic DNA
cggggggctgccgagggatgagagcccccccgtggccgggggcttcaggccgcctgggttgtgggtgcccagaggcggggagggcgacgaggaggacgacgacgaggacgaggaggagggggg

SEQ ID NO: 379 - DNA, 365 bp, Homo sapiens
  misc_feature 1..365: note = chr4:107955250-107955615
  misc_feature 1..365: note = hyper
  source 1..365: mol_type = genomic DNA
ctgcaaaattgtccccgtgagagggcagtagggggccaagcccgggtcttgtctctctgtccatcccagaatggctcggccctctcaaccaaccttcagccggctggctgcgctgtggacaggggcggcggaggacaccgagagcgcgcaaaacagcagcatcagtcggttccaaggaaactcggatctctggggcgtgggccgctgccaggggttgacacttgtgttgtgcgaggtgcgtgtgccattggtaaaatggctttctcagttttggcttcccacaaaaggagcggaagggggagctgtcatgattcccagtgcccacagagccccctctcctggccacagcgcgccagccacaactg

SEQ ID NO: 380 - DNA, 239 bp, Homo sapiens
  misc_feature 1..239: note = chr4:113441947-113442186
  misc_feature 1..239: note = hyper
  source 1..239: mol_type = genomic DNA
gagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcatcccacatggtattctcggtctcccccacgttttccccttgaatcctgtccggggaggattcggcttgaacctagccctggagaggtcc

SEQ ID NO: 381 - DNA, 237 bp, Homo sapiens
  misc_feature 1..237: note = chr4:113442246-113442483
  misc_feature 1..237: note = hyper
  source 1..237: mol_type = genomic DNA
cgtccgaggaatcggcatccaccacagcagacagaaggcagggaagatcatcccccaggccccaagccccactctagagaccctggccccaagcccgcacgacgtgctctggtgcctccaagccaaacattccgggattcggcttgacacacaaggtcagtcagcttgctagcgcggaatcggccccgcaggtgctaggaggctcacttccttcttcgcagacgctataccctatcc

SEQ ID NO: 382 - DNA, 275 bp, Homo sapiens
  misc_feature 1..275: note = chr4:113444020-113444295
  misc_feature 1..275: note = hyper
  source 1..275: mol_type = genomic DNA
tatcagaaaaggatacgtgtatgtaacaataaaactgtgtaatgcaatagtgttgggagacgggggtatggtttattttcagggatctaaagatatactttagaatctaaaacattgggggttgacacttattgctgatttatccattctttctttccccccgaagtatttctcgagcgcctaccgagtgccaggcgcctagcgaggcgcagcgttagcaccaggcgcgaaccagacagctgtggcctgcctggtagaaacgaccctgcgataac

SEQ ID NO: 383 - DNA, 133 bp, Homo sapiens
  misc_feature 1..133: note = chr4:113444296-113444429
  misc_feature 1..133: note = hyper
  source 1..133: mol_type = genomic DNA
cagttgctagtacagctctcggcggaggagccagggccgggtctccaggccgggagggggcggccgcggtgcgcccgggcagcgctccctgcgcaagtagttcttctatgtctttacacgcacttccaaaaaa

SEQ ID NO: 384 - DNA, 251 bp, Homo sapiens
  misc_feature 1..251: note = chr4:122301462-122301713
  misc_feature 1..251: note = hyper
  source 1..251: mol_type = genomic DNA
cccccagccagttgtcggaaatgttctggagcatggtgacgggaatgcagaagaaggtgatgagcaggtcactgagcgccaaggagcagataaagatgttggtgacggtgcgcatggccttgctgcgggtcaccacgtagaacaccagagcattgccaaagagcgccagggcgaagatgagcacgccggtgagcacgagggccagcttggcgcgtcccggcagctctggggtgtagacgagcggtcgcagc

SEQ ID NO: 385 - DNA, 48 bp, Homo sapiens
  misc_feature 1..48: note = chr4:122301962-122302010
  misc_feature 1..48: note = hyper
  source 1..48: mol_type = genomic DNA
cgggaaaggagagcagctcagggatcaaacccacgataaagaggcggg

SEQ ID NO: 386 - DNA, 244 bp, Homo sapiens
  misc_feature 1..244: note = chr4:122686209-122686453
  misc_feature 1..244: note = hyper
  source 1..244: mol_type = genomic DNA
caggaagaagaagagcgccaggtagagcagcaagttgagttcccactccatgctggaggcgccggcgctcgctggccctgcgcgctcggcgcgggctgcagctggagggcgagcgcgccgcccgcacacccacctcccgcactcccgcccctcgcgagggcgtcccgctatgggcgccgactccggggtccgtgctttgcctcccccggctccgaggaaacgcgccaaggagctgaggaaatcc

SEQ ID NO: 387 - DNA, 16 bp, Homo sapiens
  misc_feature 1..16: note = chr4:122686454-122686470
  misc_feature 1..16: note = hyper
  source 1..16: mol_type = genomic DNA
gcgcagactctcccag

SEQ ID NO: 388 - DNA, 761 bp, Homo sapiens
  misc_feature 1..761: note = chr4:134071850-134072611
  misc_feature 1..761: note = hyper
  source 1..761: mol_type = genomic DNA
gagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccgggg

SEQ ID NO: 389 - DNA, 304 bp, Homo sapiens
  misc_feature 1..304: note = chr4:134072676-134072980
  misc_feature 1..304: note = hyper
  source 1..304: mol_type = genomic DNA
cgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacat

SEQ ID NO: 390 - DNA, 565 bp, Homo sapiens
  misc_feature 1..565: note = chr4:140200592-140201157
  misc_feature 1..565: note = hyper
  source 1..565: mol_type = genomic DNA
caaaggaaagtgtcccgaaggccgcttcctttttgggggttgtggatctcagagccaggcgctcgcggggttcaggctgctgagaccctgccaagggttaggtttatttaccccacgaacattcgcccagcgtccactgagcgggccctgcctcactgcctcccagcgcttgccgggcccgctcgctgatcggcgtccaccttcccaccgttcctctgcttcctcaggagattggagagcgaatggtgcctctaacaataaaagtggtaagctgcgactttgtcagccaggcacgtttttaagtgcttttaaccatacattaactcattaaaaaggaaaaccatcatcgccctcattttatagatgaggaaacaggttaagccatttgtccaagatcaggatgcgaacccagataatctggactctgaggcaccctggaaaagttccctacttccaaagtctgcaggagcttcgggacgtcttcccgggagtctcccccagtctcctcgacctccaatccaggcttctgctgctctgggtcgggtttggccaactgggtgccggc

SEQ ID NO: 391 - DNA, 270 bp, Homo sapiens
  misc_feature 1..270: note = chr4:140201192-140201462
  misc_feature 1..270: note = hyper
  source 1..270: mol_type = genomic DNA
cgcccgtcctcctctccgggctagacctccttactcaccgtcctttccgagcggcgcggggttggggggcgccctcagcggcagcgccagagtcttggagaccgccctgcggagatacatcgcgcccgctgtccgccgcgcagcagcctcggtacccaggcgcaggctgcccttccacagagaggctgagagcctggcagcgccccgcccggaggaggcacgtcgaccttcatccagccccgcctccgcggcccccgggaggtggggaga

SEQ ID NO: 392 - DNA, 510 bp, Homo sapiens
  misc_feature 1..510: note = chr4:141418921-141419431
  misc_feature 1..510: note = hyper
  source 1..510: mol_type = genomic DNA
agacagccatagtttcgagaaggaagaacaggagaggggaaaagcagtgcacagacggggtccttgaacctttgaggaaaagggagcggcgggtaccctgggccagatgcgttagcgcgcgtgcaggccggacgcggccctggaggaggaggtcggggcgcgggttacagcccagccgccgctgaccggggtaggcgcggcctcgggaaggcaccgacgcgggcctcccagtgccagcgcgggcggccgccgccagcttcccgcatcgcctccgcacccgccgaccctgccccgcctgcattcctgcagccccgaagcccccgcggcgggaaaggaggcgggaggagggcccgccgcttactggtttgagttatcctgtagatggagaagcaagagaagctgaacaacgcgacggcgaccagggtgatcagcaagttcacctgcttggtcctcatggccctggccaggctgcgggaggccggcgggtggaggcggcggataatgccaggg

SEQ ID NO: 393 - DNA, 104 bp, Homo sapiens
  misc_feature 1..104: note = chr4:144621336-144621440
  misc_feature 1..104: note = hyper
  source 1..104: mol_type = genomic DNA
gaagaccaagtccaccgccagcgtgaagggcagcaccagagtgtgagtcggggcgtcgtagcgcagctgcagcagcacccgggcgcgtccggggctgtgggagc

SEQ ID NO: 394 - DNA, 383 bp, Homo sapiens
  misc_feature 1..383: note = chr4:144621514-144621897
  misc_feature 1..383: note = hyper
  source 1..383: mol_type = genomic DNA
cgcggcagggcgtccagtaccgtgacttcgcaccggtcccccggctgcactccaatcaccagatcccggagcgggtcgagccaaagggaacgacccaggggcacccggagtccagggttggcaatcagcacgctggggccgtcggggcgagtgccgtcaagcgcaccccgggcgggcaggtaaagcgccgggtcgggctcggtcccaagtgaggatgcccgtccctgcagcgcggggcgactcaagagcaggcaggcgagcgccacaaggagctgccggggcgtcccagtcgggtgccgagaagcccccgccatggccacggatggctcctggcgttgggattcccggggtggggtgccctgtgcaaagagggatctgctgag

SEQ ID NO: 395 - DNA, 173 bp, Homo sapiens
  misc_feature 1..173: note = chr4:144621981-144622154
  misc_feature 1..173: note = hyper
  source 1..173: mol_type = genomic DNA
cggctgctgcaggtaacggcagcgggggaaggggctctgcccacttcctgctcagccccggtcgcaagtctctctctgctggcttctggggaccccagatacgcgcccagcgcggcgagacttagcgagggtgcagcgctgtcccctccgctcctgggcgcttcacccagcct

SEQ ID NO: 396 - DNA, 889 bp, Homo sapiens
  misc_feature 1..889: note = chr4:147559190-147560079
  misc_feature 1..889: note = hyper
  source 1..889: mol_type = genomic DNA
gggagggggaggagtcgcatgcgcacagacgacccgagcctgctccgcggctgtccaatccgctgagagctgcgagaaatcgagtgagagaaagccctgcagcccctccgaccccatgtctctttggcaccaggcacccgccgggccgtggggggctcgtagccgaacgccgacctccgctcgtattgggctgggagttcagagccgcgcgcagaacccgggttggccgcaacgtctgtgttctcagcggtggccgggaacctgggatcagggtcacctgagctgacggggtgggggcgggccgagtggggttggaagcctggaacttagtggtaagcaggaggcgtaggaggtggcagccaggtaagaggcactcttacctacccaacgctggcttgggccgcaactttatttgggagtttctttttccggtgagacagagacccggcagaagaagcgggaggggctggaggctggtccttaggtaggcactgcccggcgactggagcgcggacctggccatttgggtggggttgagtgggggcgcgattgtgagtagcagccgcgggacgctgcgaaggggcggcggcaacagagcacgggcgggggcagaaaagaggcggcggagggcgcggtgggggagcgcgaggcgagtgctgagagagcagaaaggactcaagcctgaggggagtagagaggaagaaggggcaacgcgagaaaccgaacaggagccggcgtttcctggcaagggagggcggaggcgcgcgggagagagggagagagggagggcggggggcgcgggggtaggcgcggggagaggggagtataactcgccggccgcgaggagcgggggcagtttcgggtgccgaggtctgcagctagcggcaag

SEQ ID NO: 397 - DNA, 286 bp, Homo sapiens
  misc_feature 1..286: note = chr4:147560133-147560419
  misc_feature 1..286: note = hyper
  source 1..286: mol_type = genomic DNA
cgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccct

SEQ ID NO: 398 - DNA, 52 bp, Homo sapiens
  misc_feature 1..52: note = chr4:147560459-147560511
  misc_feature 1..52: note = hyper
  source 1..52: mol_type = genomic DNA
cggcggcggcggcggcggcggcggcggcggcggaggccgaagcagcagctcc

SEQ ID NO: 399 - DNA, 135 bp, Homo sapiens
  misc_feature 1..135: note = chr4:154709476-154709611
  misc_feature 1..135: note = hyper
  source 1..135: mol_type = genomic DNA
aaggcttaccttcctcggtggctggcaggaggtggtcgctgctagcgagggggatgcaaaggtcgttgtcctgggggaaacggtcgcactcaagcatgtcgggccaggggaagccgaaggcggacatgaccgggg

SEQ ID NO: 400 - DNA, 70 bp, Homo sapiens
  misc_feature 1..70: note = chr4:154709758-154709828
  misc_feature 1..70: note = hyper
  source 1..70: mol_type = genomic DNA
cggcctgctccagcacctccttcatggtctcgtggcccagcaggttgggcagccgcatgttctggtattc

SEQ ID NO: 401 - DNA, 675 bp, Homo sapiens
  misc_feature 1..675: note = chr4:154709829-154710504
  misc_feature 1..675: note = hyper
  source 1..675: mol_type = genomic DNA
atgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcggg

SEQ ID NO: 402 - DNA, 149 bp, Homo sapiens
  misc_feature 1..149: note = chr4:155663475-155663624
  misc_feature 1..149: note = hyper
  source 1..149: mol_type = genomic DNA
atgtgatgcgcaatcgtttgtgaatgaacaaaagtcaccggcaagcagggagacggggacagatcgctgacggcagattgagggtggcagcaaaggcccggcctccaaggataatggggagccgttttccctcacgcctggtctctatg

SEQ ID NO: 403 - DNA, 88 bp, Homo sapiens
  misc_feature 1..88: note = chr4:172734188-172734276
  misc_feature 1..88: note = hyper
  source 1..88: mol_type = genomic DNA
cgcctccacctcccgcagccgccgcgccccggctcgccgcgctcccgccggcaccatggaggaattcctgggacaaccgcctgcagcc

SEQ ID NO: 404 - DNA, 115 bp, Homo sapiens
  misc_feature 1..115: note = chr4:172734277-172734392
  misc_feature 1..115: note = hyper
  source 1..115: mol_type = genomic DNA
gcgacttttccccaggaatctctggcctggcgccctttgggtgagatgacggggtgctggcatccctgtcggtcccagattacccggaaaagccctggcaggtaaagagaggacc

SEQ ID NO: 405 - DNA, 14 bp, Homo sapiens
  misc_feature 1..14: note = chr4:172734591-172734605
  misc_feature 1..14: note = hyper
  source 1..14: mol_type = genomic DNA
ggggagtggggcgc

SEQ ID NO: 406 - DNA, 244 bp, Homo sapiens
  misc_feature 1..244: note = chr4:174430310-174430554
  misc_feature 1..244: note = hyper
  source 1..244: mol_type = genomic DNA
actcaacactctaatcgtaaatcaaagctccagggcctacttttgcgaggggcactggagaaagaagagagggttgcgcgcgcgcgtgcgggagcttcggaagctaaatctcactcgcggggaggatgggacgcgtggggactgaaggcggcatctgcctgaataaagccctcgcgcgctctgagcctcccactctgtcctggaggcctgaacctcgcgagtagagcctggcgcttttcctccc

SEQ ID NO: 407 - DNA, 279 bp, Homo sapiens
  misc_feature 1..279: note = chr4:174430793-174431072
  misc_feature 1..279: note = hyper
  source 1..279: mol_type = genomic DNA
ggaacccgctcctgggccgcgcggctgcagccgggagcgcggactcggggtgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcaaggaagccgaggcggccggggagattcacccacatgcctgttgactcgggcccagtacctgcgtctccttccttct

SEQ ID NO: 408 - DNA, 243 bp, Homo sapiens
  misc_feature 1..243: note = chr4:174451855-174452098
  misc_feature 1..243: note = hyper
  source 1..243: mol_type = genomic DNA
gggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctg

SEQ ID NO: 409 - DNA, 836 bp, Homo sapiens
  misc_feature 1..836: note = chr5:1294607-1295443
  misc_feature 1..836: note = hyper
  source 1..836: mol_type = genomic DNA
cagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggctgggagggcccggagggggctgggccggggacccgggaggggtcgggacggggcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggc

SEQ ID NO: 410 - DNA, 75 bp, Homo sapiens
  misc_feature 1..75: note = chr5:1295604-1295679
  misc_feature 1..75: note = hyper
  source 1..75: mol_type = genomic DNA
cgctggcctgatccggagacccagggctgcctccaggtccggacgcggggcgtcgggctccgggcaccacgaatg

SEQ ID NO: 411 - DNA, 517 bp, Homo sapiens
  misc_feature 1..517: note = chr5:1875025-1875542
  misc_feature 1..517: note = hyper
  source 1..517: mol_type = genomic DNA
gagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatt

SEQ ID NO: 412 - DNA, 478 bp, Homo sapiens
  misc_feature 1..478: note = chr5:1875829-1876307
  misc_feature 1..478: note = hyper
  source 1..478: mol_type = genomic DNA
ggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcc

SEQ ID NO: 413 - DNA, 223 bp, Homo sapiens
  misc_feature 1..223: note = chr5:1876637-1876860
  misc_feature 1..223: note = hyper
  source 1..223: mol_type = genomic DNA
cgcaagacagtcctgcgtctccggctatcctgtcccaggcaagggcctgtggtcgcctcctcgccgcccccgggccgctcccgtagtccttgggacacctgggcctttgatgagcccagcagggcttcgggcggagggctcggggtggggggtggggggcgagaggagaggcctcaagtccgccaggcgcctgcgggggatgcggaaccgcctccgccgcggg

SEQ ID NO: 414 - DNA, 187 bp, Homo sapiens
  misc_feature 1..187: note = chr5:1883430-1883617
  misc_feature 1..187: note = hyper
  source 1..187: mol_type = genomic DNA
cagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactg

SEQ ID NO: 415 - DNA, 347 bp, Homo sapiens
  misc_feature 1..347: note = chr5:1883879-1884226
  misc_feature 1..347: note = hyper
  source 1..347: mol_type = genomic DNA
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggc

SEQ ID NO: 416 - DNA, 174 bp, Homo sapiens
  misc_feature 1..174: note = chr5:1884557-1884731
  misc_feature 1..174: note = hyper
  source 1..174: mol_type = genomic DNA
atataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaa

SEQ ID NO: 417 - DNA, 67 bp, Homo sapiens
  misc_feature 1..67: note = chr5:1885314-1885381
  misc_feature 1..67: note = hyper
  source 1..67: mol_type = genomic DNA
ccttccttccagacccggcggggcttaactggagccgaagccccagaacaggcggccattcatcttc

SEQ ID NO: 418 - DNA, 103 bp, Homo sapiens
  misc_feature 1..103: note = chr5:1886739-1886842
  misc_feature 1..103: note = hyper
  source 1..103: mol_type = genomic DNA
cttgctccctgggtacggcctgaggctggacggagcgccgtccgggcgtccaggactcaggcctggccactccgagccccccaccccccgccccgcgccggcc

SEQ ID NO: 419 - DNA, 149 bp, Homo sapiens
  misc_feature 1..149: note = chr5:1886997-1887146
  misc_feature 1..149: note = hyper
  source 1..149: mol_type = genomic DNA
cgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccgggg

SEQ ID NO: 420 - DNA, 36 bp, Homo sapiens
  misc_feature 1..36: note = chr5:1887546-1887582
  misc_feature 1..36: note = hyper
  source 1..36: mol_type = genomic DNA
gggaggtcacacagccctaacaggacagtgggaagg

SEQ ID NO: 421 - DNA, 101 bp, Homo sapiens
  misc_feature 1..101: note = chr5:1887655-1887756
  misc_feature 1..101: note = hyper
  source 1..101: mol_type = genomic DNA
cgtttgggctgccccacccagggacgcttgggccgggcgcgaagagcccggaaatagccacccttgtcgtcggcccggtttccctccgaggtcttagtatt

SEQ ID NO: 422 - DNA, 31 bp, Homo sapiens
  misc_feature 1..31: note = chr5:1930974-1931005
  misc_feature 1..31: note = hyper
  source 1..31: mol_type = genomic DNA
ctcctgggattaggccggaggaatcttggat

SEQ ID NO: 423 - DNA, 223 bp, Homo sapiens
  misc_feature 1..223: note = chr5:1931064-1931287
  misc_feature 1..223: note = hyper
  source 1..223: mol_type = genomic DNA
cgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgc

SEQ ID NO: 424 - DNA, 133 bp, Homo sapiens
  misc_feature 1..133: note = chr5:1931444-1931577
  misc_feature 1..133: note = hyper
  source 1..133: mol_type = genomic DNA
cggtggttctgtggctgtgagggccgtttctgtccgtccacaccgccttccctctgcaggtgaggaatggggtctgcttcgtttggaatgtgcctttgccgggtcctgcctgacctccaccttccagccggga

SEQ ID NO: 425 - DNA, 349 bp, Homo sapiens
  misc_feature 1..349: note = chr5:1931617-1931966
  misc_feature 1..349: note = hyper
  source 1..349: mol_type = genomic DNA
cgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgt

SEQ ID NO: 426 - DNA, 253 bp, Homo sapiens
  misc_feature 1..253: note = chr5:3590405-3590658
  misc_feature 1..253: note = hyper
  source 1..253: mol_type = genomic DNA
ttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcc

SEQ ID NO: 427 - DNA, 844 bp, Homo sapiens
  misc_feature 1..844: note = chr5:6448738-6449582
  misc_feature 1..844: note = hyper
  source 1..844: mol_type = genomic DNA
gcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccaggtaaggcgagcgcgccggggctgggggcgcggggccgagatcgggtctgcagcgccgccgggcgcccgggccccgtggtgagggccagcgccggcccctccggccatctcgctccctgctctgactacaccagcgccccacggggatgctccgagcgcctccacctcttttccctgagcgttttcttcctgcccctgctttccgtcccgtctctcccgtccc

SEQ ID NO: 428 - DNA, 31 bp, Homo sapiens
  misc_feature 1..31: note = chr5:10564628-10564659
  misc_feature 1..31: note = hyper
  source 1..31: mol_type = genomic DNA
tgaccccaccaccgccgtccccaccccgggg

SEQ ID NO: 429 - DNA, 428 bp, Homo sapiens
  misc_feature 1..428: note = chr5:10564800-10565228
  misc_feature 1..428: note = hyper
  source 1..428: mol_type = genomic DNA
cgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccc

SEQ ID NO: 430 - skipped

SEQ ID NO: 431 - DNA, 358 bp, Homo sapiens
  misc_feature 1..358: note = chr5:10565264-10565622
  misc_feature 1..358: note = hyper
  source 1..358: mol_type = genomic DNA
tgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagag

SEQ ID NO: 432 - DNA, 207 bp, Homo sapiens
  misc_feature 1..207: note = chr5:42951105-42951312
  misc_feature 1..207: note = hyper
  source 1..207: mol_type = genomic DNA
ggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccagg

SEQ ID NO: 433 - DNA, 693 bp, Homo sapiens
  misc_feature 1..693: note = chr5:42951419-42952112
  misc_feature 1..693: note = hyper
  source 1..693: mol_type = genomic DNA
cgaccgagagacctcggctggcgaaatggtggtgccgggagcctgcgagtgacgccagccggcggggttgtcaaggacaacattcgttttgacgcagccaatggcgccgtcaccaagaaaccatcgactctgagaaaaaagagaggttcggccaccgagaaactccgtacgacaagtgctgtggcagaaaaaccgcctactccgcgccacaggcaaaacagccaatggaaaccccaggtgctgcgaccgtgacaccggcactagagggtctcggatggagaaagcggcgcacggagaccaggaaactatgtgtagcacaactagcagaaaaccgtctggtcggccatccgggagaaagcgcggatcagaaacaagcgacttcgatgcagggaaccgcgcagccactgaagaaagtgacccacgtggcagtggtgccagcgaaacactgcagtttggacggcagctgtggggatgccacagagaaacatgcactgccactgaagtacatccagctccgcggagctagtgttcatatgatcaagaaaccgccagttgggctctgctagaaacttttagtcctcccttaacggctatcctacccacaacagacaatgcctttacccagcacctagcggtgctgagacccgcctgggccagcacagagcgcagagcagtacgggtacggagaaacgc

SEQ ID NO: 434 - DNA, 457 bp, Homo sapiens
  misc_feature 1..457: note = chr5:42991785-42992242
  misc_feature 1..457: note = hyper
  source 1..457: mol_type = genomic DNA
tggaggagccaaatccgtcccattctggatccttattccagctcctttccctctgcgaatcgcacttggtgggtcgcggggccctcagtaattagggatcacggatcagccaagaaaaatacaggttttcttaagcctgaagccactgacttgaggagggagcgtgggagtaatgtcagtagcagttttttatttcgttttcgtttttattttctagtcactaggccaccaaagaaagttccacccaacggccagtcgatccgtcgcagcgactctcttttccctgaacggagggtttatggctgacacctccacttgtttctcagagccggggctgactgccggctgcatctttgaatggcgaccaaaaaagacatgcatttgtctggcaaagtcgctggcgttcgcctggtgcccgcgcttgccgggtcctagagcagccagattttcacaccag

SEQ ID NO: 435 - DNA, 180 bp, Homo sapiens
  misc_feature 1..180: note = chr5:42992375-42992555
  misc_feature 1..180: note = hyper
  source 1..180: mol_type = genomic DNA
cgtcccattctccatccgaggccttctagtcccggtgtcactgtcgcagcacctggcgttcgttagctctttcaccagcggcgcggagcgggcggttttgctgtcacggcacatgtggcacggagtttctcggtggccgaaaccctcttttttctcagagtccagtttcttggtgacagc

SEQ ID NO: 436 - DNA, 42 bp, Homo sapiens
  misc_feature 1..42: note = chr5:42992556-42992598
  misc_feature 1..42: note = hyper
  source 1..42: mol_type = genomic DNA
ctgttggttgcgccataaggaatgttgtccttgacaacccgc

SEQ ID NO: 437 - DNA, 239 bp, Homo sapiens
  misc_feature 1..239: note = chr5:42992782-42993021
  misc_feature 1..239: note = hyper
  source 1..239: mol_type = genomic DNA
cgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttctt

SEQ ID NO: 438 - DNA, 240 bp, Homo sapiens
  misc_feature 1..240: note = chr5:42993321-42993561
  misc_feature 1..240: note = hyper
  source 1..240: mol_type = genomic DNA
tgactacgatttctatcccctggttcaagtcggggaatagccaaaatgtgatttctcaacccaagcaagtacccacttaggacaaacaccagcctagccctggcggcgatttctaggtcgtaggaagtcgatgtttcgccacagaaaggctgagtgaccctgtgactcatttcccagcaactccgggtttcctgtagcctaatcataacaaacgcagagttagccctgcctcaagtttct

SEQ ID NO: 439 - DNA, 276 bp, Homo sapiens
  misc_feature 1..276: note = chr5:42993861-42994137
  misc_feature 1..276: note = hyper
  source 1..276: mol_type = genomic DNA
ttctaagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagc

SEQ ID NO: 440 - DNA, 157 bp, Homo sapiens
  misc_feature 1..157: note = chr5:50263484-50263641
  misc_feature 1..157: note = hyper
  source 1..157: mol_type = genomic DNA
cctcgccccaattaacgccctacagccagtcagccttacacctgctggaaaaatcttggtggcagtggtgggaggtggtggttttggtttttagcagagcgcgggagcaccctgtcacaccctcctgagaccgccctaggaccgtcctctggaatat

SEQ ID NO: 441 - DNA, 347 bp, Homo sapiens
  misc_feature 1..347: note = chr5:54516334-54516681
  misc_feature 1..347: note = hyper
  source 1..347: mol_type = genomic DNA
gtggctcaggttcaacgcgctccggctgcagtctgtgcgcagcccccggaaggcgccatgcaggttcccgggcctggtgtcagtattcgcgggctctggcagcagtcggggccgcttgggatcgcggctctgaagggcttcatcgcagcgctcggaaatctccctcaggatggcgtccacttccgcgcaatcctgccccgcagcgctgaccaactcctccaggctccttttggccttcgccttgagcaggaagggctcggccgccgccccacaatcccgggactgtgtgatcatcagcttctacgaaagacagggaagagcgccgccctggggcctgccggaccctc

SEQ ID NO: 442 - DNA, 96 bp, Homo sapiens
  misc_feature 1..96: note = chr5:54516831-54516927
  misc_feature 1..96: note = hyper
  source 1..96: mol_type = genomic DNA
cgccccacttacatccagcaccgaggccaggtgccgggttcggctggcgagttccttcagctgcacgttccgctccttgagcgaggcgatctcctc

SEQ ID NO: 443 - DNA, 156 bp, Homo sapiens
  misc_feature 1..156: note = chr5:54519133-54519289
  misc_feature 1..156: note = hyper
  source 1..156: mol_type = genomic DNA
ggaacccagcaggcttgcactgccacggtggggagcgggacgcacggagcacgacactgactgggggaagggggcagcagttcgcggctcctgcagagcagctgcgtggcgggaatgggtccttccaccggcggtgcggcggccctgcgccggctc

SEQ ID NO: 444 - DNA, 80 bp, Homo sapiens
  misc_feature 1..80: note = chr5:63255163-63255243
  misc_feature 1..80: note = hyper
  source 1..80: mol_type = genomic DNA
cctcaggtgtctacccgcgcttcagggcgccccagagcgtaggcggaggaacccagatcctgtaagtcagcagccgggag

SEQ ID NO: 445 - DNA, 481 bp, Homo sapiens
  misc_feature 1..481: note = chr5:72529345-72529826
  misc_feature 1..481: note = hyper
  source 1..481: mol_type = genomic DNA
ctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccgg

SEQ ID NO: 446 - DNA, 374 bp, Homo sapiens
  misc_feature 1..374: note = chr5:72529889-72530263
  misc_feature 1..374: note = hyper
  source 1..374: mol_type = genomic DNA
cggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgttt

SEQ ID NO: 447 - DNA, 35 bp, Homo sapiens
  misc_feature 1..35: note = chr5:72594802-72594837
  misc_feature 1..35: note = hyper
  source 1..35: mol_type = genomic DNA
tgtgaagcatgtgagcggggctcagtttacaggta

SEQ ID NO: 448 - DNA, 71 bp, Homo sapiens
  misc_feature 1..71: note = chr5:72594867-72594938
  misc_feature 1..71: note = hyper
  source 1..71: mol_type = genomic DNA
cggcctcgaggatttcggggggtttgcgccgccgaggaaaccctacccggacgaggcgagcagcctggtgg

SEQ ID NO: 449 - DNA, 383 bp, Homo sapiens
  misc_feature 1..383: note = chr5:72599059-72599442
  misc_feature 1..383: note = hyper
  source 1..383: mol_type = genomic DNA
cgaatgcagcgcccgggagtcagggctgttagtggcgtggcccgccgggcattgagctgtttcctccaacgcccggtcccccgcggcctaggcccagtgtttgcttttgcagatacgtcagagggaacattcaggaggggcgggctcccaggctcccaggagaccgcccggagcctccggagcgcgacgaggcgcggggcctcggagatctggcctgccagattgagggggaggggagggggcctggcccagcagctggacaggcgcgcagtgcccgcagcccgcgagtgggcgcccagctggcttcgcacgggtgaggggctcagcctgcacttccctcctccaccccgaccgccgaacgcgtcccggctggcttcagagtg

SEQ ID NO: 450 - DNA, 371 bp, Homo sapiens
  misc_feature 1..371: note = chr5:72599462-72599833
  misc_feature 1..371: note = hyper
  source 1..371: mol_type = genomic DNA
cgcgcaccctagggagatgcgcggcgtccgcgcgggtcagcgccccagtaccactccccagtgtactccccaggtacacgcttcccttgcgcggcgagtttcaactcaggtcagaacggagctgagcggtgggcggagtggagaaaggtcccggaaattggccaagagggggcggtttcgaggtagtgccttcgaagtgttgtccagaccagcagggagggtcgcctccacctgcggggcctcctccagctccacaaggtagccccgtagggacttgcagatctgccagacctagcagtgagaccactgctcccactgaatggcgccgcctgcgggctggcccaagctctatgcaccggctttatctcatt

SEQ ID NO: 451 - DNA, 92 bp, Homo sapiens
  misc_feature 1..92: note = chr5:76249579-76249671
  misc_feature 1..92: note = hyper
  source 1..92: mol_type = genomic DNA
ggggggcagagggctcgcggacatctcggggaaggggctggccggaaccgccaggggcgcggtccccttagctaaggatcggtccgcggagg

SEQ ID NO: 452 - DNA, 212 bp, Homo sapiens
  misc_feature 1..212: note = chr5:76249695-76249907
  misc_feature 1..212: note = hyper
  source 1..212: mol_type = genomic DNA
cgcgcccggggcgcaggaacccagcgcagcctaggctggaagtcggggcgctgggcactacagagcccgggaatggggcgcgcggagagcggccgcccgaggacggcgctgcggcggctgcagcccgggacttattgccccatgccctcctcccccagggtgcctggacatgctgagcctccagggccagttcaccttcaccgccgaccggc

SEQ ID NO: 453 - DNA, 174 bp, Homo sapiens
  misc_feature 1..174: note = chr5:76249944-76250118
  misc_feature 1..174: note = hyper
  source 1..174: mol_type = genomic DNA
cgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtg

SEQ ID NO: 454 - DNA, 345 bp, Homo sapiens
  misc_feature 1..345: note = chr5:76923679-76924024
  misc_feature 1..345: note = hyper
  source 1..345: mol_type = genomic DNA
ggaagcctgtgatatcgatttgcctccaagtttaaaacacaccgcaaaccttcccctcggccgaccgaagaaacggcatttttttcctactcctttggggcagtcccctgagcacgtgcctgaagtcgaggttagtacgcagccagcagggaccctgacaggaaaccagagcagccccggggttgggggagccctggtaggtgctggtcgtcccggacacgcctcttctggagaagcgcgtttgtcccttacttgggaggtcccgggtatctgaagcggatcccgggtctggggacatgaaggggcgccgtggccttagggaaggccccaaagaggcctaggccc

SEQ ID NO: 455 - DNA, 214 bp, Homo sapiens
  misc_feature 1..214: note = chr5:76924086-76924300
  misc_feature 1..214: note = hyper
  source 1..214: mol_type = genomic DNA
cggcgccggagagcagaactccaggctctgaaggccgagggtgcgaattgtggtcccctcccacccacggcctccccatcacgcgcacgcagcccgcgaggggcgccctccgcgccactgccccagggacaccgttcatctgaggaactctcgcgccctgcgtttcgtgccgacagcgacgctcggagtcccacctgggaaacctgggttggcc

SEQ ID NO: 456 - DNA, 323 bp, Homo sapiens
  misc_feature 1..323: note = chr5:76934331-76934654
  misc_feature 1..323: note = hyper
  source 1..323: mol_type = genomic DNA
actcacctagcctggcgtccaggaggtcggcatgagacagcatcgcgcaccgctccagggcgaaagctgttcccccccaaattttagcggctttaagttatttaaaatagatataagctataagctatacgatatagatatatatagatcacctaaatgaaagaaaattcggtttgtggttaaaaagggggcttcttgcattataatgtcctttagagagacggggaggtgcttaacagttgaatgaacccgtgagcagctcggcgaggggaccaatcaggagggcagcctgcaaatgtcagcgcccggagagtcccccactc

SEQ ID NO: 457 - DNA, 194 bp, Homo sapiens
  misc_feature 1..194: note = chr5:76934676-76934870
  misc_feature 1..194: note = hyper
  source 1..194: mol_type = genomic DNA
cgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcct

SEQ ID NO: 458 - DNA, 602 bp, Homo sapiens
  misc_feature 1..602: note = chr5:76936119-76936721
  misc_feature 1..602: note = hyper
  source 1..602: mol_type = genomic DNA
aaggaggcggcaaagcgaactctcgggcagttttgtttcctccttccctcctgcagcccgttcgcctcctctcctgcacacacacgtgcgcgcgcacacatatgcacacacgtgtgaatgcagggtattggccacaccagtttcttctgagctgcggagaccgcttcccgggaagctccgggccggactgggtttcagcggctgctgcagctgctaccaacgcggcctatgtgggactgggcgccggggtcgtggactcaggctcgcggcgtgtctgggagccgctagggtttttggcaagcggccgcagcccttctgagaaacgctttgcctgggaggagaattccgagacctaaagcaaacaaagtctccccaataaaagctttctttgcccccaaacaaaacctcaaatctagaagctagagcgctgggagcgcacagcaaaaggaggccagacagcagcccagggaggggcggcgtgagctcaggacggtgactcgggagtacgcaccggcccgcgcacgtccagggactcgcaggaggtttctgcccacctgggtggggcttgcagggtgtccacaccggaacgcagggtcagaagt

SEQ ID NO: 459 - DNA, 182 bp, Homo sapiens
  misc_feature 1..182: note = chr5:77140529-77140711
  misc_feature 1..182: note = hyper
  source 1..182: mol_type = genomic DNA
tgagccattttcccgcgaggcccccagcggcgcgggggctgtggggaggtggtgtgggagtacggtcgctgctgcgcggcgtggggagaactggagcggctgcccggacgcccccgccctggtcccgggtactttctcggcctggctgcagccgcgtggatgtctctcgaagcctccaccct

SEQ ID NO: 460 - DNA, 101 bp, Homo sapiens
  misc_feature 1..101: note = chr5:77147549-77147650
  misc_feature 1..101: note = hyper
  source 1..101: mol_type = genomic DNA
aagtgcgtgtgtaggcgcgtgtgcaagtgcgcgcgcgtgtgtttacacttccagaagtcaaatcctttctaggactcccccttgcttcacccggaagtgtt

SEQ ID NO: 461 - DNA, 260 bp, Homo sapiens
  misc_feature 1..260: note = chr5:77147872-77148132
  misc_feature 1..260: note = hyper
  source 1..260: mol_type = genomic DNA
gccggggcttcagtgacaccaggcacccgccccgggccgcgggaggaggaaattccctgcaaaatagcaatggttccgagaaaaggatcacaacaaaatattgaataaattcccttttaatttatttgatcattccacattacggggctatgaattgctcaaatttgataacaagtactcaattcaactcattatgtaagttaaattagacttcgataaaatttcagtggcgcgcagtggttcctcgaatgaaatgtaat

SEQ ID NO: 462 - DNA, 280 bp, Homo sapiens
  misc_feature 1..280: note = chr5:77148393-77148673
  misc_feature 1..280: note = hyper
  source 1..280: mol_type = genomic DNA
ggagctgacgctgaacgcctgaatgggcagcgcgccaacttcgctgctccaggaggggggtggggagggagaggaggaggaggaggatgaggagagaggggaggtggaaggctgtggtaacggtgggcggaggcgggaccatggcgcatgctccgcgacgtcccgggccgcgggcggaatcccccggctaacctccttgggggtgagactgggtgggatgggggtcggtgggggaagttgcatggggtgttatacccgcccggttacaggccgctgccct

SEQ ID NO: 463 - DNA, 367 bp, Homo sapiens
  misc_feature 1..367: note = chr5:77268367-77268734
  misc_feature 1..367: note = hyper
  source 1..367: mol_type = genomic DNA
gctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccgcagcctgggctggggatccggcacctgggcagggtgagcttggccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgc

SEQ ID NO: 464 - DNA, 227 bp, Homo sapiens
  misc_feature 1..227: note = chr5:77268735-77268962
  misc_feature 1..227: note = hyper
  source 1..227: mol_type = genomic DNA
gcccccggggaccgcgagcaacaaaagcccggcccgcagcccctgctcctcgccttccttttcaattctcccctgatctcaggtggaattaggaggattaaagcagcaagtaaatgaggcgagtgtgcaaaatgactcctttctgaaccaaacggcatgctccgtgctggggaaatgagatgcacatttaaatctcatccatccaccgcctgcggccaccgccatgt

SEQ ID NO: 465 - DNA, 364 bp, Homo sapiens
  misc_feature 1..364: note = chr5:82767429-82767793
  misc_feature 1..364: note = hyper
  source 1..364: mol_type = genomic DNA
gagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgc

SEQ ID NO: 466 - DNA, 63 bp, Homo sapiens
  misc_feature 1..63: note = chr5:87955602-87955665
  misc_feature 1..63: note = hyper
  source 1..63: mol_type = genomic DNA
ttggccagtgcccttcggtgtcactgaagctcagcccgcggacggcggtgtgtcagtgtgcac

SEQ ID NO: 467 - DNA, 495 bp, Homo sapiens
  misc_feature 1..495: note = chr5:87956168-87956663
  misc_feature 1..495: note = hyper
  source 1..495: mol_type = genomic DNA
gcaagcgctcaccaacgccggccaccgagcaaaacttccccgcccccgccccccacccagcttccccgcagggagaccctttccgttagcagcttttcactaagttaataacggtgtgtgtgtggtggtggcggggaggggggatttgggggttacacaatatctatatcaatgatattgatcacgtccagggaagaagcctgggcaaaactagagacaccgagtgtcagcaaaagaaagcttcttaaccacaagttgcgtgccgcctgaggaaggtgccctgtggcagggggtggccgctgggagatgcctgcctctaaccgacgtccaggcgtgactaaacctcgacgccacccccattcacaagctcaactcagggattcccaagcaaccgcagaccggaggtggcgcagaggcagtgaccgaggtcgctgattaggggccgagaggctggcaaataataattttaaaaaaaaaaaaaaccggaatagcctt

SEQ ID NO: 468 - DNA, 427 bp, Homo sapiens
  misc_feature 1..427: note = chr5:87956679-87957106
  misc_feature 1..427: note = hyper
  source 1..427: mol_type = genomic DNA
cgtgccaggcaaaggacagtctgacgacccgcccctgccgagccccgcagcgcggcgccggtgtccagcagcctccaaggcgccgagcgcgggcacgggaacttgagctagcgcaaacttgggcggcctcccagcctgctacccgggccgcagcgcgcccccggcctcccagtcgcgcgccaacccgggagcgcgcgcgccggcgcaccagctccatcagctagaggagcccgtctcccgggaaacaccaatcagacgcccgctttcaggcgagggccgcgagccgcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctt

SEQ ID NO: 469 - DNA, 304 bp, Homo sapiens
  misc_feature 1..304: note = chr5:87967773-87968077
  misc_feature 1..304: note = hyper
  source 1..304: mol_type = genomic DNA
aagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactcta

SEQ ID NO: 470 - DNA, 11 bp, Homo sapiens
  misc_feature 1..11: note = chr5:87968675-87968686
  misc_feature 1..11: note = hyper
  source 1..11: mol_type = genomic DNA
gcaccggctag

SEQ ID NO: 471 - DNA, 86 bp, Homo sapiens
  misc_feature 1..86: note = chr5:87968772-87968858
  misc_feature 1..86: note = hyper
  source 1..86: mol_type = genomic DNA
cgatactcacttgatctccctgcgccaggcaatgctgccccccaaatccagctgggcaggaaccgaggcgccggctgaaagacaag

SEQ ID NO: 472 - DNA, 73 bp, Homo sapiens
  misc_feature 1..73: note = chr5:87970041-87970114
  misc_feature 1..73: note = hyper
  source 1..73: mol_type = genomic DNA
gaagggtgggggcttcgaggggaaggtgggcttcctgcaacacaagcggagaggctgtcaggggtgtgggcac

SEQ ID NO: 473 - DNA, 792 bp, Homo sapiens
  misc_feature 1..792: note = chr5:87970115-87970907
  misc_feature 1..792: note = hyper
  source 1..792: mol_type = genomic DNA
ggggtgcggggaggcggtgcaggaatccgtcccgccgagtgccgtcggcccctgtgggcctgtttgcgcgcctggggctggccgcattctgggcgcgggtgtctgcgtgccggggtggtagttccgagcctgcgcgcgtgcgaccgggtacgggagggggaagagtgccgtaaaaattcagacgagtggcccgtatgtaaatgcagcccgcggggagcagggaggcggtaatgacagccgctggcgctcagccccgccggcggcccctagctttcccgccaagtgcagccggaggacagacagccatgcgtgtccttggcgggagagcccccacccgccgcgcgcgcccgacccccgcgcacacgcacacactcccctcgcaggcgtggggcccaatggccacgaacatgtcaggaaaacaaagctggggctgcgaggtggaacgatgaaacggcacacttggcggccgagggcagagcggagaagtcgccaccacagccaccggcgcccctttcttgcctgctcgtagatctgccctccggcccagaagaggccgaggaccatttcttagctgccccagaggagggggcgagcagaggagggggcggatgtgcacagggaggtgccagcggtccggtgcgcgggcacgcacacgccggcgcgcagggctgccgcgggcggaaggaggggaatgacaaggcctcggccgcgtctcggagaggcactacctccgcgctgaggccgctgagtttcaagtgcaaaacaccaggccaaatccggcaaggcggcggc

SEQ ID NO: 474 - DNA, 124 bp, Homo sapiens
  misc_feature 1..124: note = chr5:88185263-88185387
  misc_feature 1..124: note = hyper
  source 1..124: mol_type = genomic DNA
agtgtttctagagctcggaggctgctggtagggggtgagtgcgccacgtgcgtgcgccacgggcgagcaggaggcaggctctgggccctcctggggacctgctggacctgctggacctgggtgc

SEQ ID NO: 475 - DNA, 399 bp, Homo sapiens
  misc_feature 1..399: note = chr5:88185388-88185787
  misc_feature 1..399: note = hyper
  source 1..399: mol_type = genomic DNA
acgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccatttt

SEQ ID NO: 476 - DNA, 248 bp, Homo sapiens
  misc_feature 1..248: note = chr5:112629488-112629736
  misc_feature 1..248: note = hyper
  source 1..248: mol_type = genomic DNA
cagacccctccccagcgcgggtcattcatctcagcctagggaagagaccaccttgcctgaacgtagccaaacgcatcgcacgtgggagccaagtgggagatgaaataatccaatgcgtccccctcaccaccaccacccccaccaaattagttaccgtcggcttaaactcatcgggaatgtccgtgtattttaccgatcagggaaataaaagggtgtatataaattagtggaagcgggtgggaaggaac

SEQ ID NO: 477 - DNA, 173 bp, Homo sapiens
  misc_feature 1..173: note = chr5:115151185-115151358
  misc_feature 1..173: note = hyper
  source 1..173: mol_type = genomic DNA
cgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcagg

SEQ ID NO: 478 - DNA, 736 bp, Homo sapiens
  misc_feature 1..736: note = chr5:115151649-115152385
  misc_feature 1..736: note = hyper
  source 1..736: mol_type = genomic DNA
cgcagacgcgcggtggcctcccttcccggcgcctgtccgccgttcccggccggaggtcagcaaggccagtaggatccaccttccgcctgcgctgtggccgcggagccccaagcgagtcgtgccagccccgcggctggccagcgagggggcgagcggcggacgcagcgcggcccgagcttcccgagccagtcactttgggctgcgtcccccacgtccattcctcctcagacggggcgagtgggcgccgcctggcattgaagctgcagcgcgctcacctgtactggtcgaacttggcgtacattgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaaggatgtcgtcgcagagacagcaagagacccacccccaggcccctggcagcgcagtggatccgggatcgctggagacgcggtgcacacacaaatcaggttcagatctgtggggttcatcctcccgggccccttttaag

SEQ ID NO: 479 - DNA, 61 bp, Homo sapiens
  misc_feature 1..61: note = chr5:115152616-115152677
  misc_feature 1..61: note = hyper
  source 1..61: mol_type = genomic DNA
ggcctaacgcctctccccgctccacctccgccgctgtggttcgcgacgctgggacgtagac

SEQ ID NO: 480 - DNA, 102 bp, Homo sapiens
  misc_feature 1..102: note = chr5:127873552-127873654
  misc_feature 1..102: note = hyper
  source 1..102: mol_type = genomic DNA
gagcggtacacgttgcataaccggcctaaagccccgagcgactccaggaccgtcagcgggcgggggaggaaattacaaaagccctggcgtaaaatttcaaaa

SEQ ID NO: 481 - DNA, 112 bp, Homo sapiens
  misc_feature 1..112: note = chr5:134385952-134386064
  misc_feature 1..112: note = hyper
  source 1..112: mol_type = genomic DNA
ggagatcaagagtggcgcggcagggggagagcgccctgagcctcgctggagcccatcccggcatggctgctgggaccgacaggccgatcgcgggccgcgagcacatctcaca

SEQ ID NO: 482 - DNA, 512 bp, Homo sapiens
  misc_feature 1..512: note = chr5:134879478-134879990
  misc_feature 1..512: note = hyper
  source 1..512: mol_type = genomic DNA
cctcggagaacccggcggggcgcgcggggggacgcgtgggcactgccgcgtgggcgccctgaccccgcgcccgcgtggagcgagagccgggactctgggccagcaagttccagttccccgatggggccggctcgcccggagccgcgtgaggggattagggccgcacgagaggcgaccgcgccgcggcctccagccacgtgagcacagacacggcttcaaacgtccccaacgcactaatccttgttatccggcaggataaccgcggccgcgccagcacccggcctgcctcctccgtctggctgcgggcggggagtgcgcctggctcccgagcccctgacacggatttggggcctgcaatgacgatctaccccacaccatccacattcctgggaccctcggggcaaggtcctacagtccttggtgaccaccacgcctgcaaaaagcggtgggaaagttgttacgcttagaaaactaccaacacgcgcatgcctgtaatcccagttactcgggag

SEQ ID NO: 483 - DNA, 123 bp, Homo sapiens
  misc_feature 1..123: note = chr5:135265737-135265860
  misc_feature 1..123: note = hyper
  source 1..123: mol_type = genomic DNA
cccagaaaccacaagcgttggctcatgcctgtgtggagtcacaggcaggtggccacggggaattagctgaagaccagcaggcaggaagcctcccacatgccacctaaggggcgctcccggaac

SEQ ID NO: 484 - DNA, 12 bp, Homo sapiens
  misc_feature 1..12: note = chr5:135265919-135265931
  misc_feature 1..12: note = hyper
  source 1..12: mol_type = genomic DNA
cgccaggtgggc

SEQ ID NO: 485 - DNA, 197 bp, Homo sapiens
  misc_feature 1..197: note = chr5:135265932-135266129
  misc_feature 1..197: note = hyper
  source 1..197: mol_type = genomic DNA
ccatcgccgcggcctgctgggggaggcggcctttgaggagcgggcgcgaggcggggccaggcggggcggggccttgggcggctgcggtctgcgcggacccccgtgcctaggcgctcctgtgcctccagtgcgcggagccggcctcgctcgggcgtgttcctgcgccgaccggacggccggactccagcaccttggcc

SEQ ID NO: 486 - DNA, 110 bp, Homo sapiens
  misc_feature 1..110: note = chr5:135266577-135266687
  misc_feature 1..110: note = hyper
  source 1..110: mol_type = genomic DNA
ggagtttatagttgccacaaatgtcaaaaagtagccttctggcgagctgaaagcgctcacctgtgcgctttaaggtgtaccgtctttgtctttggcgagtgtgcctttta

SEQ ID NO: 487 - DNA, 228 bp, Homo sapiens
  misc_feature 1..228: note = chr5:140801034-140801262
  misc_feature 1..228: note = hyper
  source 1..228: mol_type = genomic DNA
cgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcct

SEQ ID NO: 488 - DNA, 861 bp, Homo sapiens
  misc_feature 1..861: note = chr5:140855598-140856459
  misc_feature 1..861: note = hyper
  source 1..861: mol_type = genomic DNA
gcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctc

SEQ ID NO: 489 - DNA, 87 bp, Homo sapiens
  misc_feature 1..87: note = chr5:140856546-140856633
  misc_feature 1..87: note = hyper
  source 1..87: mol_type = genomic DNA
cgccggcgtgcggcaactattcgccttagaccttgtaaccgggatgctgacaatcaagggtcggctggacttcgaggacaccaaact

SEQ ID NO: 490 - DNA, 92 bp, Homo sapiens
  misc_feature 1..92: note = chr5:145722375-145722467
  misc_feature 1..92: note = hyper
  source 1..92: mol_type = genomic DNA
tgaaaatttaaaatacggctgatgcaatattaattgcctatagtggtataaaacacagggcaggagcccagccgggctgcagaggagacaac

SEQ ID NO: 491 - DNA, 467 bp, Homo sapiens
  misc_feature 1..467: note = chr5:145722560-145723027
  misc_feature 1..467: note = hyper
  source 1..467: mol_type = genomic DNA
cgggctctggagagaaccggaaatctgcctccatcctcttttcgaaaagttctctgccgttatttatttagtctttttttttcttttaattgacaactgcaaaagtttgggagacttttacggagaggatgagaggagctgcctcctgagcgcaaggtctgctccaagacggtccagtagcactaggtccagtctccgagccatgcctctgagcctagtcttcttcaggcgcctgagacggtgatgcgcaggagtattttcaccagttcctacgtgcaggccggagctgcagcccggtcagcgaagcgctccaccctttccctcctcctgagtgcgccggaacggcgccgtcgcctcactcttcggcttgcttcaggaagcaactggagatgtggtttccccaggattgtgtagtcgcctttgccactcgtctggcggaggcacagacctctcgggggaggggaggt

SEQ ID NO: 492 - DNA, 151 bp, Homo sapiens
  misc_feature 1..151: note = chr5:145725693-145725844
  misc_feature 1..151: note = hyper
  source 1..151: mol_type = genomic DNA
cgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctc

SEQ ID NO: 493 - DNA, 375 bp, Homo sapiens
  misc_feature 1..375: note = chr5:158527442-158527817
  misc_feature 1..375: note = hyper
  source 1..375: mol_type = genomic DNA
tcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagccc

SEQ ID NO: 494 - DNA, 251 bp, Homo sapiens
  misc_feature 1..251: note = chr5:158527818-158528069
  misc_feature 1..251: note = hyper
  source 1..251: mol_type = genomic DNA
ggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggc

SEQ ID NO: 495 - DNA, 100 bp, Homo sapiens
  misc_feature 1..100: note = chr5:170735131-170735231
  misc_feature 1..100: note = hyper
  source 1..100: mol_type = genomic DNA
ggaagaaaatgattccgcttgtctccccaaagctgcagcggaaggtgactacttcgtgtgcggtcctgtccacggtgccctgggccgggtagacagtcac

SEQ ID NO: 496 - DNA, 116 bp, Homo sapiens
  misc_feature 1..116: note = chr5:170736715-170736831
  misc_feature 1..116: note = hyper
  source 1..116: mol_type = genomic DNA
cggtctccagccttggcggtctcaatttcccctggatggagagcagccgccgcttcgtgaaagaccgcttcacaggtgagcagagctggcgaccaggctccaggcctccgccctct

SEQ ID NO: 497 - DNA, 454 bp, Homo sapiens
  misc_feature 1..454: note = chr5:170737281-170737735
  misc_feature 1..454: note = hyper
  source 1..454: mol_type = genomic DNA
cgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccacccccgccccaaacacacag

SEQ ID NO: 498 - DNA, 69 bp, Homo sapiens
  misc_feature 1..69: note = chr5:170737795-170737864
  misc_feature 1..69: note = hyper
  source 1..69: mol_type = genomic DNA
cttcttccagcccgccctctcggattttcaacaatcctcgtggacgccggtttcctctccccccatctc

SEQ ID NO: 499 - DNA, 755 bp, Homo sapiens
  misc_feature 1..755: note = chr5:170737935-170738690
  misc_feature 1..755: note = hyper
  source 1..755: mol_type = genomic DNA
cgtctggaaaggggttcaagacaggccctgggcgaactggatgagactgacccagcccccgggcgtcgtgcgggtggtgcagagccagcctgctcacccgcggaccccagcgaccccggttcccgcagggccaagtcagttacacataggccctgcccttgctatctggcgaaaggaacaatctttattgttggtgaagccacaatacccgggcgtgcaggtgggcggcgggcagagtcccctcctggagaccctctggcacacaacaaaaacaaatgatcctaaccggctccctggatataagagcctcgggcgtaaagcgcgggctgggaggcagacgggttctgcgcctcgaggctcccggatggcctcggctcccgggagggccggggccccgccggcggccccgcggtgccgggtgcatgacggtactgtccctctccctcccccggtgcaggcggcagacggcggaggagcgggaggcggagcggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctccctggtgtgagcccaccagcgcgcaccgtcgccacggatcgccgcccccacccagccgggcgccccggaccccccaggcgggctgcgggggaaccgg

SEQ ID NO: 500 - DNA, 1116 bp, Homo sapiens
  misc_feature 1..1116: note = chr5:170738823-170739939
  misc_feature 1..1116: note = hyper
  source 1..1116: mol_type = genomic DNA
cgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttcacttaacgccgcttttatttcgttttcgttccaataatgctcggcgacccccggccctgcgccccacccctgcggcggtagaagccgagcggcggcgcgcagggcgcgtccacttccgcaacgttcgtctgcattcgcctcggctgcaaccccggcccgggcccccgaggaggatgcgcggtgcaggtcagttggtgccggccacccgcagcctgggtgcgcacgggatggggactggacatgggaaaggtgctccaggcccgaaggccgcgggccagcgccggggcgggctggggagtgaaaggctgggcctgggcagatgcctaggccgtccccaggtcaaatccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccggaactcagaactctaagcgctggtgtggtagcgtcgtggccggggtccacccagctccaccgtggctcaagagctggaagtttcagaattgcgaggtttggagcggctgaccccttcc

SEQ ID NO: 501 - DNA, 152 bp, Homo sapiens
  misc_feature 1..152: note = chr5:170742448-170742600
  misc_feature 1..152: note = hyper
  source 1..152: mol_type = genomic DNA
tggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggc

SEQ ID NO: 502 - DNA, 166 bp, Homo sapiens
  misc_feature 1..166: note = chr5:170742672-170742838
  misc_feature 1..166: note = hyper
  source 1..166: mol_type = genomic DNA
cgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccg

SEQ ID NO: 503 - DNA, 342 bp, Homo sapiens
  misc_feature 1..342: note = chr5:170743138-170743480
  misc_feature 1..342: note = hyper
  source 1..342: mol_type = genomic DNA
gaaagtaagcttcaaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccac

SEQ ID NO: 504 - DNA, 482 bp, Homo sapiens
  misc_feature 1..482: note = chr5:170743646-170744128
  misc_feature 1..482: note = hyper
  source 1..482: mol_type = genomic DNA
cgcggccgggccaggcgctctggaatagcgatggggggacacggcctccaactttctgcagagaccatcgggcagctccgggcctaagcagcgacctcaccgaaggttcctgggaacctttgccaaaatcccagcctctgcctcggtccagctaaaccgtgtgtaaacaagtgcaccaaggccgcagagcggctggtgtggtgcaggcgcctgcgttctggagtagtgaaggttcctccacagggaaggcggttttccttccgtgaaattcgaaattcagccccccagttccaagcgcctgctccgttaatagcatctactctcagcgacgcccagacccaggctgtgcactgtcttggctcagacactggcaaagtcctcgagaaattgccttggtgatcggtgccttccctcgggccacccagccgccggtggcacggagtcttccgcgcagttgtgcggaccctcgctgtgtggccctg

SEQ ID NO: 505 - DNA, 171 bp, Homo sapiens
  misc_feature 1..171: note = chr5:172659855-172660026
  misc_feature 1..171: note = hyper
  source 1..171: mol_type = genomic DNA
ggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagca

SEQ ID NO: 506 - DNA, 77 bp, Homo sapiens
  misc_feature 1..77: note = chr5:172660141-172660218
  misc_feature 1..77: note = hyper
  source 1..77: mol_type = genomic DNA
cgcccggggccgctccgcgttgtccgcctctgtcttctccagctccaccgccttctgcagcgcgcacagctctgagg

SEQ ID NO: 507 - DNA, 87 bp, Homo sapiens
  misc_feature 1..87: note = chr5:172671395-172671482
  misc_feature 1..87: note = hyper
  source 1..87: mol_type = genomic DNA
agccctgtgctgctgcggccggctcagtgctgaattgatgctggaaacggctggccagcgggcctagggtcgccgcctttccctcct

SEQ ID NO: 508 - DNA, 153 bp, Homo sapiens
  misc_feature 1..153: note = chr5:172671639-172671792
  misc_feature 1..153: note = hyper
  source 1..153: mol_type = genomic DNA
cgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggatt

SEQ ID NO: 509 - DNA, 303 bp, Homo sapiens
  misc_feature 1..303: note = chr5:178016681-178016984
  misc_feature 1..303: note = hyper
  source 1..303: mol_type = genomic DNA
cgggaccctgaggccggagcggagaccgcaaaaccccttggggccggcaccccctgcctccgccttggcgcagacgtgcccatctctgggacggccccgagcgcacgcagccggcgggcgaccctcctcccagagacctgcacgctgcccccggctcccagcgtaccgccaccctcaacccgacacacccaagtccgccccagccacgcgccaagacgctcacctcccgcagcaggcgctccaggtgcggctcggcccaggcgtccagggcgcctggcggccccgcgcgccgcagcagctccc

SEQ ID NO: 510 - DNA, 52 bp, Homo sapiens
  misc_feature 1..52: note = chr5:178017519-178017571
  misc_feature 1..52: note = hyper
  source 1..52: mol_type = genomic DNA
cggcgccgggctgatcccacgcgcagcgcgcacctctgccctcacctagccc

SEQ ID NO: 511 - DNA, 111 bp, Homo sapiens
  misc_feature 1..111: note = chr5:178017572-178017683
  misc_feature 1..111: note = hyper
  source 1..111: mol_type = genomic DNA
ggcgccggcacccgcccccgcacgcacctctgaggcttccccagcccaagcccgcactgtggaccccagaggtcggaggggagcccggcgacaccgcgccccttctgcagc

SEQ ID NO: 512 - DNA, 44 bp, Homo sapiens
  misc_feature 1..44: note = chr5:180075814-180075858
  misc_feature 1..44: note = hyper
  source 1..44: mol_type = genomic DNA
ctgtcccctcaaatccggggacccctggccttccgccccttctg

SEQ ID NO: 513 - DNA, 405 bp, Homo sapiens
  misc_feature 1..405: note = chr5:180076053-180076458
  misc_feature 1..405: note = hyper
  source 1..405: mol_type = genomic DNA
cgcacccaagtccggggcccggccgggatggatctccggcgcgcgtgggtcgggacggcgcggcgcggggaccccgcggggaagcgagtaagggcgcgaaggatccgggctcagcgcgcagcccggcagggcccggctccgaggacgcggagccaccgacggagacgcggattcaggggccgggagagctacccctgcgccgaggcgcggcccggccgccctggccctgacccggctgcggtccccgcccgccccttcctcatcccgaggtcccgcgccccaagcgccgtgctcccctcaggcgtccgcgcaccagggccaccgtgtcccccgcccgtacccggcggagcggtctcagcgcccgccccaggtgcgcggtaccccctccccggccagccccacgct

SEQ ID NO: 514 - DNA, 314 bp, Homo sapiens
  misc_feature 1..314: note = chr5:180076532-180076846
  misc_feature 1..314: note = hyper
  source 1..314: mol_type = genomic DNA
cgccccgctgcatctccggccgctgcgcgtgggtccgacccgagcggccgcggctcggggctgaaagtgtccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcgggtaacgcagacggtctcgcgatgcgctccggaggtgatggagc

SEQ ID NO: 515 - DNA, 534 bp, Homo sapiens
  misc_feature 1..534: note = chr6:391209-391743
  misc_feature 1..534: note = hyper
  source 1..534: mol_type = genomic DNA
gagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctc

SEQ ID NO: 516 - DNA, 20 bp, Homo sapiens
  misc_feature 1..20: note = chr6:391744-391764
  misc_feature 1..20: note = hyper
  source 1..20: mol_type = genomic DNA
cactctcagtttcaccgctc

SEQ ID NO: 517 - DNA, 135 bp, Homo sapiens
  misc_feature 1..135: note = chr6:391765-391900
  misc_feature 1..135: note = hyper
  source 1..135: mol_type = genomic DNA
atcttgggacccaccgctgccctcagctccgagtccagggcgaggtaagggctggagtcgggcaggaggaggggtgtgaggctgataccagagaggacccggagcgcgaaccagaggttcgacctccagggcagc

SEQ ID NO: 518 - DNA, 25 bp, Homo sapiens
  misc_feature 1..25: note = chr6:392409-392434
  misc_feature 1..25: note = hyper
  source 1..25: mol_type = genomic DNA
gctctcccgggcctgctccggggtc

SEQ ID NO: 519 - DNA, 372 bp, Homo sapiens
  misc_feature 1..372: note = chr6:392587-392959
  misc_feature 1..372: note = hyper
  source 1..372: mol_type = genomic DNA
cggagggtggaggaacccggggctgcgcccctggaacgcccggccgcaggcgaggtcctccgcgcgtggaggccgccaggggagtggaaactgacagagtcgcggggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcc

SEQ ID NO: 520 - DNA, 115 bp, Homo sapiens
  misc_feature 1..115: note = chr6:393124-393239
  misc_feature 1..115: note = hyper
  source 1..115: mol_type = genomic DNA
gggcgcgggcgcggacggcacgcggggcatgaacctggagggcggcggccgaggcggagagttcggcatgagcgcggtgagctgcggcaacgggaagctccgccagtggctgatc

SEQ ID NO: 521 - DNA, 233 bp, Homo sapiens
  misc_feature 1..233: note = chr6:393240-393473
  misc_feature 1..233: note = hyper
  source 1..233: mol_type = genomic DNA
accagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcgggg

SEQ ID NO: 522 - DNA, 53 bp, Homo sapiens
  misc_feature 1..53: note = chr6:1384127-1384180
  misc_feature 1..53: note = hyper
  source 1..53: mol_type = genomic DNA
aggggagttttgatgcgccaggaagttcatctatcgcccaggcgctcaggacc

SEQ ID NO: 523 - DNA, 19 bp, Homo sapiens
  misc_feature 1..19: note = chr6:1384625-1384644
  misc_feature 1..19: note = hyper
  source 1..19: mol_type = genomic DNA
cgagcgttgccacagccgg

SEQ ID NO: 524 - DNA, 261 bp, Homo sapiens
  misc_feature 1..261: note = chr6:1625257-1625518
  misc_feature 1..261: note = hyper
  source 1..261: mol_type = genomic DNA
caaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttag

SEQ ID NO: 525 - DNA, 260 bp, Homo sapiens
  misc_feature 1..260: note = chr6:6003269-6003529
  misc_feature 1..260: note = hyper
  source 1..260: mol_type = genomic DNA
aagcctcaggcttggcgctctgtccttggtgggcgctcagcaaacactgctgaatgaatgaacgaatatagtccctggaagccaccagcagttaccgaaatggattgtttcattataaaaccgattgcctaccgtggactctgtattccgagtgagaccctcggatgcaccctctcccgccccgctggaaagagggcagcctggacgtcctgagacctggcgcggatgatgagtggtctggagaggagaaggccagaggc

SEQ ID NO: 526 - DNA, 395 bp, Homo sapiens
  misc_feature 1..395: note = chr6:6004349-6004744
  misc_feature 1..395: note = hyper
  source 1..395: mol_type = genomic DNA
ggaacgggaagcactggggaagggaccgaggttaacttcgacctccgctggggcagatacgtaaaccttctcaaacctccgagttcaccttacagcgaacattaaatacccttgcgactacaatactaacaaatcgaacactgacgtaaaatcttaagaataaacgaatctttgttctgatagagctcgttcaaaatggaaatacactccacacatcttcctctataacgcatgtcacaaatacagctttgcagagaagaaacgaaataaaataaagtccaatctccccgtccacgtctctccccaccccttgcctacacccccaaaactcagtggcgaaagaagcccctaaaatgcattgacattttttaaggggaattggggctcgccggggg

SEQ ID NO: 527 - DNA, 329 bp, Homo sapiens
  misc_feature 1..329: note = chr6:6004836-6005165
  misc_feature 1..329: note = hyper
  source 1..329: mol_type = genomic DNA
cgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaaccc

SEQ ID NO: 528 - DNA, 192 bp, Homo sapiens
  misc_feature 1..192: note = chr6:6006691-6006883
  misc_feature 1..192: note = hyper
  source 1..192: mol_type = genomic DNA
tgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggc

SEQ ID NO: 529 - DNA, 86 bp, Homo sapiens
  misc_feature 1..86: note = chr6:10381507-10381593
  misc_feature 1..86: note = hyper
  source 1..86: mol_type = genomic DNA
ggatgaaaggagagccgtccacccagcgaggggcttgtgtgccctagagggcgctgggccccgcgcgctttcctggctgtccccgc

SEQ ID NO: 530 - DNA, 138 bp, Homo sapiens
  misc_feature 1..138: note = chr6:10381831-10381969
  misc_feature 1..138: note = hyper
  source 1..138: mol_type = genomic DNA
taggctcttgtccttcgacgcccccttggcacaagcgcactggcgccctccgctcaacccaccttgcctttggggcgggcttcaaccctgggaagacaggcctgggggaagcgagaggagaggcccgaatagaggttc

SEQ ID NO: 531 - DNA, 1050 bp, Homo sapiens
  misc_feature 1..1050: note = chr6:10390023-10391073
  misc_feature 1..1050: note = hyper
  source 1..1050: mol_type = genomic DNA
ggcttagaaaagacccgtttcgggtgcggggtgctgatgctgcttttttgttgttcgtttgcgctcgcgctcgctctcgctctctctctgcatccccctcaccccctttctcggagactgaactaagtgaaaagttgtttcaataatcgcagctctctgctccgccagggccgagggaggcgggcggaacacggagggtgttttgttaaatgctcccgtcgttcgcaggggctgggacttgataaaaggagacagttttctgaaaagatttgattgaaatggcgtgtgccagggctgatgggagccagcgagggacaaagcgccgagaatccatggacactcgagcaattatgcctccacgctgaaggtggattagcgcgctggaaagaagcatatgtttggcccggggcgacacttccccccggctgagcttagagaatgggagcgcggagagcggctggacccggaatatcaactatctgcgaagcccccccttctagcccaactccgccagcctccccgcccccgccggggaaaagtcggagtgcatttttacaaagatgagaggagaagagagggctaggggaggagcgggcagggaggggagtaggtgcctagaggtgcaaatggccctgggatcccccaggagcggccctccaggctctcctctctggcgatcccgagggcgcgtccgtccttgggtgtggaaacccagagggggtcaaataaatgctcccctatggaatttcccactgctaaggtagttcggtccaggatgcccgctcaacgcgtattggaaggtcagccgaattgttgcaatgaaacaaggttttaatgactaaagatgcaagtgcctaaaaggttgcgttgggcaggaggcgcttggagggcagcgcgggttcccagccattccttgggtccaggtcgaggaaggcctcgggagacgagtcccacagtgagatatttgatgaaatgggtcggggctggaaagctcggacaggccgcatgggagagaaagggtgcgggtgcggcagtcggatccccacgcag

SEQ ID NO: 532 - DNA, 103 bp, Homo sapiens
  misc_feature 1..103: note = chr6:10417427-10417530
  misc_feature 1..103: note = hyper
  source 1..103: mol_type = genomic DNA
ctttcttgccctctgcgggcttggaaaggccgccctccatcctctgccaccccatttcaacccccgtttccacctccccgctgccccgcgcccaacagatctc

SEQ ID NO: 533 - DNA, 363 bp, Homo sapiens
  misc_feature 1..363: note = chr6:10419077-10419440
  misc_feature 1..363: note = hyper
  source 1..363: mol_type = genomic DNA
tctcctacagaaacacgctgcctccgcgacccagccatctggacccctttccattcttcacacatcctagatctcccgaaatctgggggtaccaagagagacaggtgcaccagaacctgtccaacactcaaccctggggtctagggcgaggccgcaggcgcagcaggctgaaaaccttcaccgccgcgcaccacaaccccaggccttctccctccccccttccgaattagtcatcctcccaagtttctacttgaggtgggaggggggtgggggaaacggccacagcacaaaccacaagtgacccaccaggccacctgtggagcgtgcgccggacttccccggcgccgggccccgcgggctgcg

SEQ ID NO: 534 - DNA, 56 bp, Homo sapiens
  misc_feature 1..56: note = chr6:10419476-10419532
  misc_feature 1..56: note = hyper
  source 1..56: mol_type = genomic DNA
cgtttttcctgtcttcgctgtctcctgggagctctcctgggcgctgccaggcgcgc

SEQ ID NO: 535 - DNA, 96 bp, Homo sapiens
  misc_feature 1..96: note = chr6:10421356-10421452
  misc_feature 1..96: note = hyper
  source 1..96: mol_type = genomic DNA
ctggctttttccagacggtggaaatagggcggtgactaacttttcagagtggaagacacgcacgaagggcgcacctgcagctctccgggattcagg

SEQ ID NO: 536 - DNA, 568 bp, Homo sapiens
  misc_feature 1..568: note = chr6:10421548-10422116
  misc_feature 1..568: note = hyper
  source 1..568: mol_type = genomic DNA
cgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccc

SEQ ID NO: 537 - DNA, 157 bp, Homo sapiens
  misc_feature 1..157: note = chr6:26327825-26327982
  misc_feature 1..157: note = hyper
  source 1..157: mol_type = genomic DNA
gccgagtggttaaggcgatggactagaaatccattggggtctccccgcgcaggttcgaatcctgccgactacggcagtgggtttttgcatcttcaagcaggtttcatccgaccgatcgatatttcacgtgtaaaaaggctttcgatcttttacaagt

SEQ ID NO: 538 - DNA, 240 bp, Homo sapiens
  misc_feature 1..240: note = chr6:26501949-26502189
  misc_feature 1..240: note = hyper
  source 1..240: mol_type = genomic DNA
cgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttc

SEQ ID NO: 539 - DNA, 15 bp, Homo sapiens
  misc_feature 1..15: note = chr6:27228172-27228187
  misc_feature 1..15: note = hyper
  source 1..15: mol_type = genomic DNA
gaagagcccacctgc

SEQ ID NO: 540 - DNA, 170 bp, Homo sapiens
  misc_feature 1..170: note = chr6:27228289-27228459
  misc_feature 1..170: note = hyper
  source 1..170: mol_type = genomic DNA
cgctgcagtctcagagttggagcagcttggcgtttactcccgggcctttcccggatgggagaaggaacctgcgcgggaacttgaattttttcgagtcagaatcagcaagttgttgttgtttgagaccaagtgagccaccgcacccagccaagaatcggctgtttaagaaa

SEQ ID NO: 541 - DNA, 725 bp, Homo sapiens
  misc_feature 1..725: note = chr6:27279795-27280520
  misc_feature 1..725: note = hyper
  source 1..725: mol_type = genomic DNA
gtggggcagggtgggcgcggtggacgaactgaacccgatgaacttggtgaaggggctgaggtggccggcgtttcgtgggcctctcgggcaagtcggtgcgcacctgggctggggacgagggcgaaagttccagtttgctcaggaaactgcccatgaggagagatgaggcgcgggcagtgagttcaagcacggttttggcttccgaggtttcggacgtctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcagga

SEQ ID NO: 542 - DNA, 123 bp, Homo sapiens
  misc_feature 1..123: note = chr6:27512761-27512884
  misc_feature 1..123: note = hyper
  source 1..123: mol_type = genomic DNA
gtttccatctttttgcgtttttctgtgctggactctccctaagatatttggaaacctgtgttctgagttcttccttttccccgggctcgggtggctgaaggccttggctcttgggaatggtct

SEQ ID NO: 543 - DNA, 151 bp, Homo sapiens
  misc_feature 1..151: note = chr6:27512994-27513145
  misc_feature 1..151: note = hyper
  source 1..151: mol_type = genomic DNA
cgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccat

SEQ ID NO: 544 - DNA, 225 bp, Homo sapiens
  misc_feature 1..225: note = chr6:28367054-28367279
  misc_feature 1..225: note = hyper
  source 1..225: mol_type = genomic DNA
gcttccctctaacctcgtggtctgtgattataatctgaagtgaggaaggcccaggaaagggtccctaggacgccggcgagcgtctgtgacccaccactgtccagaaatgtcggtaagcgctgaacccaaggatacacagcccgaagcaaacgcggaaggtatgggccttacagcctggaattgctgcagagactgggagccaaaccctcatcctaatgtcccaac

SEQ ID NO: 545 - DNA, 67 bp, Homo sapiens
  misc_feature 1..67: note = chr6:28367280-28367347
  misc_feature 1..67: note = hyper
  source 1..67: mol_type = genomic DNA
cactttggggagggagagcttcccgcggatccgcctgggtttgggaggaccggggtccactctgcac

SEQ ID NO: 546 - DNA, 81 bp, Homo sapiens
  misc_feature 1..81: note = chr6:28367490-28367571
  misc_feature 1..81: note = hyper
  source 1..81: mol_type = genomic DNA
cgaacccttttgggacccggaacccatcaaaagtgacccacaaaggccggaagcggccacggggggtctaagaaccagccc

SEQ ID NO: 547 - DNA, 243 bp, Homo sapiens
  misc_feature 1..243: note = chr6:28367572-28367815
  misc_feature 1..243: note = hyper
  source 1..243: mol_type = genomic DNA
cgcggggcgcacttccgcggccgctctaggaagggagcgaaaggggctttcaactcggtagtgtttccgcgcgtctacgtgagaggaaggttgatggctttcaggcccgctggtaaatggaacgggtttatcttctcctcttctttacccagccattgtccacacttcccccgacccgatgggtggtcgaggcttgtagaactgatcttaagacagggaaatcccttgcgtctccattcactt

SEQ ID NO: 548 - DNA, 16 bp, Homo sapiens
  misc_feature 1..16: note = chr6:28411014-28411030
  misc_feature 1..16: note = hyper
  source 1..16: mol_type = genomic DNA
agcccttccaggctgc

SEQ ID NO: 549 - DNA, 57 bp, Homo sapiens
  misc_feature 1..57: note = chr6:28411031-28411088
  misc_feature 1..57: note = hyper
  source 1..57: mol_type = genomic DNA
gagcaacctcctctgcccttcacctgcccggcccatctctggccaagaagaccctgc

SEQ ID NO: 550 - DNA, 241 bp, Homo sapiens
  misc_feature 1..241: note = chr6:28411151-28411392
  misc_feature 1..241: note = hyper
  source 1..241: mol_type = genomic DNA
cggtagcccgactccgaagctcaccgaggcatccgtgagaggagatgccacctagcgcagatcacatctgctctgaatccttgacaaccgcagcccaaagaatgataaactacaaaggccggaaatgcgtcaccgcggcccgctctccgcgaaacagcggttccggctgtgttccttctaggaaggccggaggtttccacacctctgtggtcgtcactctgaatcccgtctgtagtcttaa

SEQ ID NO: 551 - DNA, 187 bp, Homo sapiens
  misc_feature 1..187: note = chr6:36252984-36253171
  misc_feature 1..187: note = hyper
  source 1..187: mol_type = genomic DNA
gggattctgagcattcgtcggcgcctccccaggggctgctgcgccccctgcttcccgcgcgcccaccacgcacgctgctctgggagcagggccggcggcgccgccgcctcgcagcgattggttgaaccggaggttgttgctaggctaccagtgcgccctgagcctggggccccgcagtcccatcctc

SEQ ID NO: 552 - DNA, 304 bp, Homo sapiens
  misc_feature 1..304: note = chr6:50691909-50692213
  misc_feature 1..304: note = hyper
  source 1..304: mol_type = genomic DNA
ctcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatctgtttggctgtaaggcgaacagatcatttattttgctctcaagatttggtctaattatgtcaacaccgacgctacgacgagtggggcggcgctgtggctttggagaggatgcgcgcaccggcccagcgcc

SEQ ID NO: 553 - DNA, 213 bp, Homo sapiens
  misc_feature 1..213: note = chr6:50692299-50692512
  misc_feature 1..213: note = hyper
  source 1..213: mol_type = genomic DNA
cgcggaggccgtgagtatggctcagaggcagatttagaggctccagggacccgcggctccttggagacagccgccgctgtttcctctgccccagtagcctgggatgagaagagaaaaagctcacccaggctccggcgcttgtctttcccatccagttgcagcacagacggtggcggggtgtgtgtgtgtgtgtgtcggcggggggacctgtct

SEQ ID NO: 554 - DNA, 318 bp, Homo sapiens
  misc_feature 1..318: note = chr6:50791177-50791495
  misc_feature 1..318: note = hyper
  source 1..318: mol_type = genomic DNA
cccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcatt

SEQ ID NO: 555 - DNA, 36 bp, Homo sapiens
  misc_feature 1..36: note = chr6:50791550-50791586
  misc_feature 1..36: note = hyper
  source 1..36: mol_type = genomic DNA
cggccatcccggaatggaagacgtccaggtaaccac

SEQ ID NO: 556 - DNA, 216 bp, Homo sapiens
  misc_feature 1..216: note = chr6:50804152-50804368
  misc_feature 1..216: note = hyper
  source 1..216: mol_type = genomic DNA
gcgcttgggaggatccgcggccgccacctgctcgcccacaaactctagtgtccttgcatccaggcctgcccgcgccgcgcaagtcctaccgcagattttgccgccctgggaacctttcactttcctggccctgcgcctggcgcctctcttcctgtcacccctaggacatctcagggggcattctccagcctgagtacaacgcggaactaacagccc

SEQ ID NO: 557 - DNA, 87 bp, Homo sapiens
  misc_feature 1..87: note = chr6:50810627-50810714
  misc_feature 1..87: note = hyper
  source 1..87: mol_type = genomic DNA
tcagtcccagctgctcgagaagggagggcgctgggaaaggaaacagagcggaatcgcccacattagcctcgctcttcggtgacccgg

SEQ ID NO: 558 - DNA, 490 bp, Homo sapiens
  misc_feature 1..490: note = chr6:50813325-50813815
  misc_feature 1..490: note = hyper
  source 1..490: mol_type = genomic DNA
gagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatg

SEQ ID NO: 559 - DNA, 527 bp, Homo sapiens
  misc_feature 1..527: note = chr6:56818720-56819247
  misc_feature 1..527: note = hyper
  source 1..527: mol_type = genomic DNA
cagactcctggaattcggtgggacatcctgggggagggaggaggagtcctggggccatcggtctctacgtgatttctccgcgagaagtttgcatgaaagttctgggggagttggggagccccgaagtttccatgccttactttcttacccctacgctccagcgaaggatgcgtgaaggcgaggctggcgcagccccggactacgctcaaattacccttaaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttgaacgacccgagaagaccgatttcatcggatg

SEQ ID NO: 560 - DNA, 420 bp, Homo sapiens
  misc_feature 1..420: note = chr6:62995455-62995875
  misc_feature 1..420: note = hyper
  source 1..420: mol_type = genomic DNA
aatgtccctgtagaccgcgttacatacactttatggtttctctatcaatgatcctaacaggtcacatcgccactgccattagatctccgtagctttggtcttctccaaattaagacgtggagaaggagcactgctgtccgccccaagaacggggtctgtccgcccgagctctaaggcgagcatcttcagggggacagtttctgcgaaggcggggagaggagtccctccccaacttcactcccctaatcaagccgcgggtgagataggcagccggcggtttgtgcccatctgtgggggcaagtcctaccttctgccaaaaggcgcgacgcatgcacaaaagatggatccaggctatctttctctgccatcagctcaggcaaatatttctcctcttccatagcgcggacttcggattgtccc

SEQ ID NO: 561 - DNA, 53 bp, Homo sapiens
  misc_feature 1..53: note = chr6:62996077-62996130
  misc_feature 1..53: note = hyper
  source 1..53: mol_type = genomic DNA
cgcagagccccggctcacaccagcggccttaactggagaggcgggaacaggac

SEQ ID NO: 562 - DNA, 83 bp, Homo sapiens
  misc_feature 1..83: note = chr6:62996131-62996214
  misc_feature 1..83: note = hyper
  source 1..83: mol_type = genomic DNA
cggcccacctccgccaaccactcattggtggtggtgccaggagaggcggggcgctggcagaaggccgcgggctctcattgggc

SEQ ID NO: 563 - DNA, 181 bp, Homo sapiens
  misc_feature 1..181: note = chr6:62996215-62996396
  misc_feature 1..181: note = hyper
  source 1..181: mol_type = genomic DNA
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgca

SEQ ID NO: 564 - DNA, 150 bp, Homo sapiens
  misc_feature 1..150: note = chr6:73329801-73329951
  misc_feature 1..150: note = hyper
  source 1..150: mol_type = genomic DNA
tttaaagcgggcacacgagtcattttaagtctctagatctttcaccctgaaagtccctgcacagaaactccatagggagtctaaatatagcaacagcaccccctcccgccccctccgccttcagtcagggtcccgcgcagctctaggatt

SEQ ID NO: 565 - DNA, 164 bp, Homo sapiens
  misc_feature 1..164: note = chr6:73330950-73331114
  misc_feature 1..164: note = hyper
  source 1..164: mol_type = genomic DNA
agtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgc

SEQ ID NO: 566 - DNA, 123 bp, Homo sapiens
  misc_feature 1..123: note = chr6:73331115-73331238
  misc_feature 1..123: note = hyper
  source 1..123: mol_type = genomic DNA
ggaagatgcctggtccttgcctcgcggacttggcagccgcgtcctgcgggtctgtccactgaactgctgaggactcgcccgtgtgcggggacccgagtgccacttcccggagcgttaccttgc

SEQ ID NO: 567 - DNA, 390 bp, Homo sapiens
  misc_feature 1..390: note = chr6:73331239-73331629
  misc_feature 1..390: note = hyper
  source 1..390: mol_type = genomic DNA
ctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagc

SEQ ID NO: 568 - DNA, 272 bp, Homo sapiens
  misc_feature 1..272: note = chr6:84417429-84417701
  misc_feature 1..272: note = hyper
  source 1..272: mol_type = genomic DNA
attatggaccaagagcgcaggccgcaccaccagcatcccaggcgcctctgccgtgcgcatgtccctcttatataaagagatgcttacagtccaggtgctttttcttggggcccattacttcatgagtagtggctttgcagaccgctcttgctacagcagagcctgtaacgctgtactgagcggcggcgatccgatccgtgagcgtttggcccgacatcttctgtggtcgcgtctaccgcctcctcttctgcaggaaacaaggggagacggtc

SEQ ID NO: 569 - DNA, 866 bp, Homo sapiens
  misc_feature 1..866: note = chr6:85472401-85473267
  misc_feature 1..866: note = hyper
  source 1..866: mol_type = genomic DNA
cttgggggagcctcccggtgacgccagaggggaagctccctgctggaagccgtcctcacagccgcctggacagcaaaggacagagaaagggaactggtgagggaaacagaggggaagccagccgcggagacgggcccacctggtggctgagaagaggaaaatgaccgggagaaaaggggaagctttggtgccatcaggtcctcctaaagaacaagccagtcgatagacacccacattctgcctgtcgaaggggcgcattcagagctccagtgtggcctgcttggtccccaagtcccaagcccgggagaggcgcgcgggcagcgtccaccccacccgctgggcctccgcagggccaaggccccagcagaaaaggcttcacgccgccgccggggtctgggacgcttgcccgacggagtcagaggagctcccgggtccagagtccccagtgcaaactccgacgcaacctgcgcctcgaagcgcaagcagcaaaagcgcccggactctggtcccaagagcctgggcctccttaagccataagcgtctgcggcgcctcgctttgggccttcttttgggccgggccggaggcatcttctagaaggctcttcagaccccgctttcgccaaactcccggcgccctgcgcttccagcccagcagagaaaagtgtgaaaagcaagcccgcggtcgccgtcggccttggcagagaaatcaagaggagaagggaagggaaccgctcaactacccttcgggaaaccaagtttccaaatatgccgccctcttcctggtttgcacaaacggtttagggcattcgttccggtttcagggtggggtatgccgtcgctcccctcctccccgccctgtgctttta

SEQ ID NO: 570 - DNA, 694 bp, Homo sapiens
  misc_feature 1..694: note = chr6:85473508-85474202
  misc_feature 1..694: note = hyper
  source 1..694: mol_type = genomic DNA
ttggccatgtagggacgcggcgcgcacgcacacccacagactcgcagaagttcaggttcgcgccggagagaagttataggcaggaaggggcccactcacccgcggctccgcgctccaggtctgcgccactccgagccggcccagacgtcgccccagccggcggcgggagcgcagcgccttcgtctccctcagaagaacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctctctcatatacactcacgcgggcacacgcgcgctctcgctcttcccccaccaaaaactaaaaggctctcggggcctcccgagatctgcccccttccccaccgcgggcaaaaaacagatttggcgtttccgctttctcgcttgtgttgggatccaggaaccggcgacgcgccggccaagtctcctttcctgggtctctctcgcgcgctctctcactgatgcactcctttgctcccaccccttccacctcctcctgctgctccgaggtctgcctcaa

SEQ ID NO: 571 - DNA, 119 bp, Homo sapiens
  misc_feature 1..119: note = chr6:85482703-85482822
  misc_feature 1..119: note = hyper
  source 1..119: mol_type = genomic DNA
gcaggaatcggactccgccaggggttcggagtcttctggggaaagggcgtgttgggagagaaaggcaagcccacgcaggagcgacctcctaattaattcatcatcgagaattctccagt

SEQ ID NO: 572 - DNA, 736 bp, Homo sapiens
  misc_feature 1..736: note = chr6:99271926-99272662
  misc_feature 1..736: note = hyper
  source 1..736: mol_type = genomic DNA
ccaagagtcagatggcgcgggttccctccctgtgagtttcgacagtgcatcatcttacggaagaggctaaactagtattgattttccactttctaaaaggagtaaccatttggagcaaaggcaagctctcagggacgcgggggttgatagggggcaggtctgcgaaaaagagaaacacttcaaacagcgctgcggagagtgggggatggagctgtggggagcgagcggaggcttctctctgcccaagtagtggggctgcaaagttcctgccacaacggctgagacgttctgattctgtggacctgccaggagaggcgtttcccttgccaaaatagagccttcttaggagaggtttatgtattgttcgggaaggcaggagtatcttctagtcgttttcactctcctccacctttattaccctgaatccttaggccctcccctcggaaccccttcaaagtggagagggagcgtgggagggagagagcgcgcgccaagtttcaaatgtcgccagtctttccagaagcccctggctctcgcaggactgggtgcaggcgcctctccgggcctcggagccccgccccgcctccccatccccacaatcccaaggctccaggctctgcagggaaccgcggcgggaattttccagcctcaaatacggggcggactaattttcaggtccactccaacccagagatcggattccacttgatcttggagttcgcgaagtaactgccaa

SEQ ID NO: 573 - DNA, 150 bp, Homo sapiens
  misc_feature 1..150: note = chr6:99277180-99277330
  misc_feature 1..150: note = hyper
  source 1..150: mol_type = genomic DNA
tagggggagaaaatgcgagcgtgcctgtgtgtgcgtgtgcgcgcacacacacgcgcgcgcacacacacacacagacacctttaggctccattgttaagaggtcatttaactgttagtcctttgaaagtgaaattgcgggaagcaaactgg

SEQ ID NO: 574 - DNA, 105 bp, Homo sapiens
  misc_feature 1..105: note = chr6:99295759-99295864
  misc_feature 1..105: note = hyper
  source 1..105: mol_type = genomic DNA
agtcgccgggagtggcgctgcggtgaaagccggtgcctagagtgggcttaggggtcccattccactcggaaagtcctctcacctccccaagggccattctgccgg

SEQ ID NO: 575 - DNA, 304 bp, Homo sapiens
  misc_feature 1..304: note = chr6:99296061-99296365
  misc_feature 1..304: note = hyper
  source 1..304: mol_type = genomic DNA
cgcttccgccctcccggcctccctcttgccgcatgagcagcgcagggcctcctgggctgtgctggggtcaagagttatgaacacttcgtgtcctcaggagctcacgggggtgacgagaggcggtctgggtctgaagccgctacacagaggggagcagtggggcctcggggagcagcggggcctcggcttggcggctccccccgccaccccgccacctttcaggacccaggccaagccgcctcacgaagaccaggaagcggcctctgccgggaagccacctgcagcctatagtcccctccccaag

SEQ ID NO: 576 - DNA, 49 bp, Homo sapiens
  misc_feature 1..49: note = chr6:99296407-99296456
  misc_feature 1..49: note = hyper
  source 1..49: mol_type = genomic DNA
cgcctggagggccctgacccttccggtgttccaccgcaatggggtcggg

SEQ ID NO: 577 - DNA, 46 bp, Homo sapiens
  misc_feature 1..46: note = chr6:100038661-100038707
  misc_feature 1..46: note = hyper
  source 1..46: mol_type = genomic DNA
cttcctcccactgtgcgagcttcggaaccctaaggccggttcactg

SEQ ID NO: 578 - DNA, 369 bp, Homo sapiens
  misc_feature 1..369: note = chr6:100038785-100039154
  misc_feature 1..369: note = hyper
  source 1..369: mol_type = genomic DNA
cggtggtgcccggcgggggtggggtgcccacggacgcagccgcctagctctgccggccgtcctgaggcagctgctggcgcccgccgggaggcgcgtggccacttgcacttcagcgcgcggttctctctccgcaggctgctttctaggatttgaaagggccatagcgacagaagtcgatctctaagaaggcataaactcggcctgagacgtgggggggagacactgcagagaagaggccaagttccagcgcagaaggggggttccgcggggccctgggattgaggagacaggagcgagccttccctttccgtcctctcaggaaaacagcctgacctgctggcacgtccacccccaacagaagagggaccc

SEQ ID NO: 579 - DNA, 251 bp, Homo sapiens
  misc_feature 1..251: note = chr6:100050858-100051109
  misc_feature 1..251: note = hyper
  source 1..251: mol_type = genomic DNA
cgctgacttttctttgcaccatgtcaaccgaaagaaccaagaaataagttggagaactccggttaaaaggcaacttgagagggattctgaatacttttattgagccgtttccaacggaggacttaaaaaacaacaaaaaaggcaccacaaaacccaccagcggcgtccgggctgcgtcctggctgccactttggagcctcccggccgccgcgcatccaccggccatgcaattaaggggaaaatggcctcat

SEQ ID NO: 580 - DNA, 149 bp, Homo sapiens
  misc_feature 1..149: note = chr6:100051359-100051508
  misc_feature 1..149: note = hyper
  source 1..149: mol_type = genomic DNA
cgcggctctctgcatccccgggttcaggactcctccggccccagttttgggattccgcgttgacctaggagggaggggtgtttggtgagtcaccagcaccagggtctccaaggctgagcccgcctccccaacccccgggacaactccct

SEQ ID NO: 581 - DNA, 187 bp, Homo sapiens
  misc_feature 1..187: note = chr6:100051771-100051958
  misc_feature 1..187: note = hyper
  source 1..187: mol_type = genomic DNA
cgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacg

SEQ ID NO: 582 - skipped

SEQ ID NO: 583 - DNA, 241 bp, Homo sapiens
  misc_feature 1..241: note = chr6:100441497-100441738
  misc_feature 1..241: note = hyper
  source 1..241: mol_type = genomic DNA
cggggccgctgcttcccggaaagccactccctttttcttttcccacctgtgtttccattttctttgccgagtgtgaaaccagccggccacccacccgccccgctccgtctcgtaggtgcctccacagagccaaactttgtaccttctggggatggagggggatcccccagcaatcagacactaccggcgagccagccccggggaggggcgactggtggaccaggcgccagaccttcccggg

SEQ ID NO: 584 - DNA, 337 bp, Homo sapiens
  misc_feature 1..337: note = chr6:100441761-100442098
  misc_feature 1..337: note = hyper
  source 1..337: mol_type = genomic DNA
cgcgcccacgccagagcccggccctcgcgcggcagcccgcgggacgtcacctgggtgctcgcgtcctccccgcgcggcggacagcccgggcgcccttcctctctgcgggactgcaggtctatccgctaagcgcgcgtgaccaaaaacggctctcagcgggtcccagctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcgggtgcgtcgtgctcttttc

SEQ ID NO: 585 - DNA, 132 bp, Homo sapiens
  misc_feature 1..132: note = chr6:100912919-100913051
  misc_feature 1..132: note = hyper
  source 1..132: mol_type = genomic DNA
tagggctgagtgacacgagtcggccccgagccgccctccgcgcgcccaggctccgggctctgaatcttactacccgcgggaccgctggactcctaatgagctcagggtgccgggtcggcgctgtccggttgc

SEQ ID NO: 586 - DNA, 104 bp, Homo sapiens
  misc_feature 1..104: note = chr6:105389509-105389613
  misc_feature 1..104: note = hyper
  source 1..104: mol_type = genomic DNA
gggcaggcgtcggggatcgtttttgctttggtatcggtgatgtaaattcatgaattaaaattaaggattttgaaaagaacggggaagaacgcacttggatttag

SEQ ID NO: 587 - DNA, 83 bp, Homo sapiens
  misc_feature 1..83: note = chr6:105584133-105584216
  misc_feature 1..83: note = hyper
  source 1..83: mol_type = genomic DNA
gtctggccaacaacccgttcccaaaggctcggggaaggaggttgcgggtgggtggcgcggacctcgggtccccagccatcggc

SEQ ID NO: 588 - DNA, 103 bp, Homo sapiens
  misc_feature 1..103: note = chr6:105584217-105584320
  misc_feature 1..103: note = hyper
  source 1..103: mol_type = genomic DNA
ctctcccggggccctctgacctcgctccttaaaggaggagggtccgtggcaacggtcctcctcggccaggcgctctcgggacgcgggggtgaggagtgagcgc

SEQ ID NO: 589 - DNA, 185 bp, Homo sapiens
  misc_feature 1..185: note = chr6:105584366-105584551
  misc_feature 1..185: note = hyper
  source 1..185: mol_type = genomic DNA
cgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggtggggccgagggcccggggacgctggggctgcctgacctgagc

SEQ ID NO: 590 - DNA, 1015 bp, Homo sapiens
  misc_feature 1..1015: note = chr6:105584552-105585567
  misc_feature 1..1015: note = hyper
  source 1..1015: mol_type = genomic DNA
gcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctc

SEQ ID NO: 591 - DNA, 427 bp, Homo sapiens
  misc_feature 1..427: note = chr6:106429049-106429476
  misc_feature 1..427: note = hyper
  source 1..427: mol_type = genomic DNA
ctctctgccttcctgcgttgaaagagtttcaagaagttgtggtgagtggatgtattcccagacggatgcgggcggtccccgggcagggaccccgaatccggggtcgcagggtggtagagccggaagattggattccatctccgcaaggattgagaaaaacggactcaccgactgaactattccatctccaagttgtttttattttccactttaagcataagaacgatgagaaccaggagccaggcggccccgcgtagcggtgggagcgcaggtacccgagagtaccctctgggggccggcccggcgcgctcgctcctcctcgcctttccgggaaccgtgcgcaggagctcacacggcacgcctgcggccaggggcaatcgggttctcggttcccggagtcccagttcccggtttccagtttccttat

SEQ ID NO: 592 - DNA, 35 bp, Homo sapiens
  misc_feature 1..35: note = chr6:106429589-106429624
  misc_feature 1..35: note = hyper
  source 1..35: mol_type = genomic DNA
cgggctctgccattcctatccggaaaattcaagct

SEQ ID NO: 593 - DNA, 1251 bp, Homo sapiens
  misc_feature 1..1251: note = chr6:106441869-106443120
  misc_feature 1..1251: note = hyper
  source 1..1251: mol_type = genomic DNA
tcctaatttatgaaacgtgaacgggggtaaggtatttatttgtacgctagttgaagtggggcaggagcactgattcctggacagtcactcaaaagctgcgcccaaagttttaaaaagcgcggggacggtggagagggaggcgaagagcccgcgctgctgggctgggctcgggtgccgcgctggggacgccgcatctactgagcggtcgccgaagacgccgggaggcgaggggcgaggtaagacgccgcctaaagaggcccgggctctcccccggggtcgttgttggaaaagcaaattccacggtgaactctaccaagctcagcgcgtacacagctagcggctctggattggactgcattcgcctaaattgcgtaattaaaaaaaaaaaatacaccactgccaccctacagcgacgcttccgctggaagacgagcggggacgcgtgacagcgcggggatagcttttctattacgtttcttgttctccgagctcgagcccccttttaaaaagtcgctcaccaaaaacggggtgggggatggaggtggggacgagaagtttccgaatgctgagttcatttggacgaggtgaggagaactagggtcctaacagcaggtccagaggactctcgagataggtttagagcccgtccttttgtctggagtgtcgcgggactccagaagtgggttgtgcaagacaaacttccagataaatctttgcccggatcctcctgcggtcaaagcatcagtcctgcccgtaacttcctaacgacatcttcttggagcagattccgcggcggggatggctgggtgtgcaaaccgaaaacagtttgtcagccctccagtcccgccgcgtcgggaatgcgagcccggccacgcggtccgaccgggtccggggacggcgcgcttgtcgcgggagcctcccggcttgcggagggcttgagttttttggcggagacagaggaaagcctctggtcgagaggattagagcgcgcgttttctccgccgagcacgctgcccgacgccgtcgcagccgcgcacttcccggttttgaaagccagagagatgagtcaagcgcaaaagctccggagtgacaatgcgagcttttggccagcctcatcctcctccccattcccttgccttcttttaggtcttcggttcgtgacaagtgcataggttaggcttgcacggaagagggtcggggcaggtgccagctcagggcacctacccggcgttgtcacgttccctttgggat

SEQ ID NO: 594 - DNA, 15 bp, Homo sapiens
  misc_feature 1..15: note = chr6:108438142-108438157
  misc_feature 1..15: note = hyper
  source 1..15: mol_type = genomic DNA
gcagcccaactgggg

SEQ ID NO: 595 - DNA, 303 bp, Homo sapiens
  misc_feature 1..303: note = chr6:108438260-108438563
  misc_feature 1..303: note = hyper
  source 1..303: mol_type = genomic DNA
cgtgggcgaatgtctggtggccgggtgagtggaacccgccgcccagtccttgcagcgggctctggtctagtgggtgaggatccctggggaggtcccaactccggtgcagcgtccgcggggtgaagggcgcgagtgcattcaggccccaagggaaactcggggacatctgcacagacaagaatccccaaggaggcccaggtcccacggccaaagtcctcgacccccaccaggctgtctccctctagtcctccccactcctgacctgccattcgggacggagccagtccgcgggcacccaagggc

SEQ ID NO: 596 - DNA, 567 bp, Homo sapiens
  misc_feature 1..567: note = chr6:108440078-108440645
  misc_feature 1..567: note = hyper
  source 1..567: mol_type = genomic DNA
cctcatattcttgtgcgggtgtctgactcgaatgacaagcgagctgattttttcagtacatagctgggaaatgtagtgagtgataatagagatttctctttcattttttacgcttgacttggttattgttgcttttcttttcccgtgattccttctgaggattagctctgacttccccactattggcggtcaaagtggccccgactcgggatgacaattgacggggatcaagggattgcccattctgtgcctgtaagaaccgattcgtgccagagaaactcatcaagtggaggcggagaataaagaccgttcgggggtaaatgtattcattgagaagggttctcccaaattgcttctaagtttttttaatgaaaagtaacgattgcggcaatcagcggctttttggcggattacaaatctggagggagctgcggcgctgcattgaaaagtgcccccgccttcgcaccgggcagccggttcacaggagcagcgcgaggggcgggggtccgatagcgggacaaaggcggggagggggcgagcggaggagggcggctcggggcgcccggg

SEQ ID NO: 597 - DNA, 223 bp, Homo sapiens
  misc_feature 1..223: note = chr6:108440744-108440967
  misc_feature 1..223: note = hyper
  source 1..223: mol_type = genomic DNA
cgagggaggtctaccgcagcaccaccagcactggggagattccgggcatctggagcgaggaaggtgtgctataggggttgagtccatcaccgtggaagtccggggaatgggaggtgcgactcggtcccccacctctaccccgggcacggtggtgtcttcttttaaagacgtctcacttcgcaattggaatcgaagcgtgggccggtgtcgggtcttcctggtg

SEQ ID NO: 598 - DNA, 665 bp, Homo sapiens
  misc_feature 1..665: note = chr6:108487779-108488444
  misc_feature 1..665: note = hyper
  source 1..665: mol_type = genomic DNA
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctattt

SEQ ID NO: 599 - DNA, 79 bp, Homo sapiens
  misc_feature 1..79: note = chr6:108489730-108489809
  misc_feature 1..79: note = hyper
  source 1..79: mol_type = genomic DNA
tgcggaaactttggccgttctaacttgccaagagcctgagtgaggccttggaagcctccagccccggctcaggtcggga

SEQ ID NO: 600 - DNA, 180 bp, Homo sapiens
  misc_feature 1..180: note = chr6:108490066-108490246
  misc_feature 1..180: note = hyper
  source 1..180: mol_type = genomic DNA
cgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggct

SEQ ID NO: 601 - DNA, 219 bp, Homo sapiens
  misc_feature 1..219: note = chr6:108490296-108490515
  misc_feature 1..219: note = hyper
  source 1..219: mol_type = genomic DNA
cggggtcaaccagcttgtctcgtgaccccaagtcaccttaacgtggctgggtggcggagtctgaggcacaggcccgctatgccccggaattttcgcgtccctccctcctgggccccgccccagcccggttgcctgtttctaatctgccccgggagccgcggctcagaggtctgctcagaggcaggactcgcactggtggtggcctagagggcaacagtc

SEQ ID NO: 602 - DNA, 60 bp, Homo sapiens
  misc_feature 1..60: note = chr6:108490537-108490597
  misc_feature 1..60: note = hyper
  source 1..60: mol_type = genomic DNA
cgaggaggggcccccaccctgcactggtcttccctccaccctcatcgggttctccagaga

SEQ ID NO: 603 - DNA, 551 bp, Homo sapiens
  misc_feature 1..551: note = chr6:108495915-108496466
  misc_feature 1..551: note = hyper
  source 1..551: mol_type = genomic DNA
cggggctccagggcctgcggccgggcaaggtcgcgcctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatgcatgtaaatcaaccccggagcgcttctttccagatgctgggaattggcctcgggctttcagtcgtatccttcccgtctttcagcaggagccgctggcgacccctagaattccccagggcaagacccatgcccacatcaggaacttgcgccccacagtcatctccacacaggcagcgcttggggggaccccactctccaggggaccggcgcgcattttctgcctccggtcctaatccctctttgcagcccttcgtggcc

SEQ ID NO: 604 - DNA, 208 bp, Homo sapiens
  misc_feature 1..208: note = chr6:117086271-117086479
  misc_feature 1..208: note = hyper
  source 1..208: mol_type = genomic DNA
ggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgc

SEQ ID NO: 605 - DNA, 160 bp, Homo sapiens
  misc_feature 1..160: note = chr6:117086480-117086640
  misc_feature 1..160: note = hyper
  source 1..160: mol_type = genomic DNA
ccctcaagccgactcccgggccggcccctcgctgccctcccgcaacctcctccctcccaggacctccccgtcggagccctggctcaccgtgaccttggggcccagaattgctgggggccccgccgctggagtagcaggggagaccccggggcggaagagc

SEQ ID NO: 606 - DNA, 310 bp, Homo sapiens
  misc_feature 1..310: note = chr6:117591206-117591516
  misc_feature 1..310: note = hyper
  source 1..310: mol_type = genomic DNA
gcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttg

SEQ ID NO: 607 - DNA, 37 bp, Homo sapiens
  misc_feature 1..37: note = chr6:118229695-118229732
  misc_feature 1..37: note = hyper
  source 1..37: mol_type = genomic DNA
cagggtgtgagccggcggcgcccagttattccgaagc

SEQ ID NO: 608 - DNA, 91 bp, Homo sapiens
  misc_feature 1..91: note = chr6:118229733-118229824
  misc_feature 1..91: note = hyper
  source 1..91: mol_type = genomic DNA
cccatgccggagggggcgggtgccgatcgccggcgcctccagtgctggaatctgcgtagtggattcaggacgttgacgttttaggatgagg

SEQ ID NO: 609 - DNA, 604 bp, Homo sapiens
  misc_feature 1..604: note = chr6:133563411-133564015
  misc_feature 1..604: note = hyper
  source 1..604: mol_type = genomic DNA
tgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagag

SEQ ID NO: 610 - DNA, 437 bp, Homo sapiens
  misc_feature 1..437: note = chr6:134210582-134211019
  misc_feature 1..437: note = hyper
  source 1..437: mol_type = genomic DNA
gatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctggtgagtgctcccggggctgcagctgcagtccagg

SEQ ID NO: 611 - DNA, 224 bp, Homo sapiens
  misc_feature 1..224: note = chr6:134211111-134211335
  misc_feature 1..224: note = hyper
  source 1..224: mol_type = genomic DNA
cgcgggcctagagcctccagggaccggaggcgggcggtctagacacggccctcgctctctgccctaccagcccccggagcgggagtgatttatgcgagggtttgacgtggcagcccaattaaaagtttgcaagtgtgttgagctggcacagaggagggatcccccgctcccgctccatcgccatcctccctggggtgcagtggctgctgcggaactgagaacac

SEQ ID NO: 612 - DNA, 35 bp, Homo sapiens
  misc_feature 1..35: note = chr6:137244114-137244149
  misc_feature 1..35: note = hyper
  source 1..35: mol_type = genomic DNA
tgaggcagagagagccggagagctttgagagtggt

SEQ ID NO: 613 - DNA, 231 bp, Homo sapiens
  misc_feature 1..231: note = chr6:137244235-137244466
  misc_feature 1..231: note = hyper
  source 1..231: mol_type = genomic DNA
cgaccctcgcccatgcttcacccggcatcgcccttcctgtcgccccctctcctggtcttcccctgtcaccccattctccgggagaggtgggagggccgcctgagcctgggagctggagtcctccaagcctggaccaagccggaaggagggggccgtgaacttccttgggtcacgaggggctggaatggaggtgggggatgggggcgaagctgagggttcccggggctactg

SEQ ID NO: 614 - DNA, 258 bp, Homo sapiens
  misc_feature 1..258: note = chr6:137809108-137809366
  misc_feature 1..258: note = hyper
  source 1..258: mol_type = genomic DNA
gcccctgtcctcctgcggtgcgagaaacccgaccactctgcttctacccgaaccccaggacgcaacagtaaaatcaaggcccgtcgttgaactcccaggtctgcgcatccctccctcctggctccctggggtcttggccccagcaggtccagtacccatccccagagggacccactaccctgggcgtcccagggtgccaggcacgatggcctgcaatgggggctgcaatttaaccgaggcgagttaaattccttttgc

SEQ ID NO: 615 - DNA, 472 bp, Homo sapiens
  misc_feature 1..472: note = chr6:137809445-137809917
  misc_feature 1..472: note = hyper
  source 1..472: mol_type = genomic DNA
cggctctcttccaggggctgtgatccgggtcggccagggagagcgaggccccggggtcctctgtgaggtccccagcgaagagacgcagctggggaaggcgccgcccccgggccccctgcgccaccctaaccgggcctctccttagcaaagttgacaaattcttgagagtgtcagcccagggctgcgcgtgagggcgctgggaccggggaggaaagagcacctgccgcgctcagcccgactttgaatttgtttgttgttaccgtttttgtttttcctcccagtttccataaacgcttagtatttcgaggcactttgcaggtgttggcgcaggtgatgatgggcctcgttggactctgcctcccacgcatccttttgttttctgcgcgccagcctgtctgactgtgtcctgcggggaccccgagacagtccggggtcagggcgtagagactcatgcttgccacttgacccatcc

SEQ ID NO: 616 - DNA, 929 bp, Homo sapiens
  misc_feature 1..929: note = chr6:137810032-137810961
  misc_feature 1..929: note = hyper
  source 1..929: mol_type = genomic DNA
cggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctc

SEQ ID NO: 617 - DNA, 151 bp, Homo sapiens
  misc_feature 1..151: note = chr6:137815020-137815171
  misc_feature 1..151: note = hyper
  source 1..151: mol_type = genomic DNA
atccgcttgcgttcgcgtccgttgatcttcagcctcaactgctgtaggtcctgctccgacagctgcttcttgattttgtacttgctgctctctcccgcggccttggcgccagcccgcgagaggctttccccgggcatcttctgcatcatat

SEQ ID NO: 618 - DNA, 515 bp, Homo sapiens
  misc_feature 1..515: note = chr6:137815224-137815739
  misc_feature 1..515: note = hyper
  source 1..515: mol_type = genomic DNA
cggtggtggtggtccctcaggtacatctcatccatgtccggagatgaagctctgctggagacagagctcgaatcagaattcattttattacaggggatgcggccctaccgtggggaggctttaggcgggaaattaaagaaaatcttgaattaaaaaaaaaaaatctgcactgcccaggaacccacttctccgcggcaagacgtgagaagaaaagcggagacgctgcttttccccgcctctctccctcccacgcccctctctctggttaggctgcttcctggacagctagttggtgtgtgcttgaactaacctcacgctgaaaaagaggggcttttatagagctgcggcggagaaaagagacaaaaggagccctcctatctatcctgggctggttaggatgacgtgccatcattcagggcggtgcgctttgctgtcccatttagcaaggattcctattcatattcattgtggggccgccctgggacacctctgctccgaaccgctaggagccccca

SEQ ID NO: 619 - DNA, 777 bp, Homo sapiens
  misc_feature 1..777: note = chr6:137816459-137817236
  misc_feature 1..777: note = hyper
  source 1..777: mol_type = genomic DNA
cttcctggaccttggcgctggcgcaaaacggtgggacggtccgcgcccgaagctccgccgggcctcctctggccgctgtgctgacgtgccccgagctccgggaactcagcggcaccccggcctgcgcgggtgggtccaccaggctggggccgccgtacggcgtcggacagggaaatcagaagctcataataaactatctgatgtcggggtggtggggcgggggggtggggtgcgtgggcaaagaagcacgggggaagggaaacaacgaaaggacctagaaagccccttgtgcgtgcccgggcactgcggttcagcgcagagtcgtttctgggaataaagaggaggtcggagtttggagccttcggtgcgagtgcggaggtgggcgtagatctttcttcccccttgctgtgtttttgtgatcaagactttagctcagcagcacgaggggcgggaaggcagaaatcccgggaagggagagagccccaggagtggtctctagaagaacccggacaccgcccctctcccggcttggtggaacgggaaacaaacgctagctagtgactgagagtctcggtggaagtgtgaaatcgaatcaatcgcggaacctcgggcacttggggcctcttgcgccgctgagtcacttcgaagaacaggatgcccccctttcccttgactcaaaccgagcggtcagtgggagagggatgcgcgcccaggtccggagtttgcacgctctgaggctgtgccccactgacagtcacgctgcgaaggcagctctgg

SEQ ID NO: 620 - DNA, 94 bp, Homo sapiens
  misc_feature 1..94: note = chr6:137818505-137818599
  misc_feature 1..94: note = hyper
  source 1..94: mol_type = genomic DNA
ggcttgacaactagacgaggggagtgagtaaaggtgccacaactttgcttaccgtaaaatgggttaatactcgccggggcccaaaaggctgagt

SEQ ID NO: 621 - DNA, 649 bp, Homo sapiens
  misc_feature 1..649: note = chr6:137818618-137819267
  misc_feature 1..649: note = hyper
  source 1..649: mol_type = genomic DNA
cgtggagtctcttttcgacccccgccaccgcagctcagttcctcggattgagccctgaacccgagaaggagcaggcccggagctcaggagggcaggcacacggatttctttctgagggctgactaccaacgcccaccccagacttgtacggaaggagagagtaaaggagtcgccgcctggccaaggctgcagcagcctacagaggctcagccggagacgcaccatgaccttggccctggccgagacccctttcggagggctcagaccggcgaggagccggagcgagcgaccctgctgcggtggctcgggctgcgctctctcgggccacaccccgcgccctcgcggctggggcgggctgcgccgcggaggcggggatcgttctccggcaacaggtgcgtcccaaggcaggcaggctacttccctccaagcctgtcttggctctgagaagagcctggagtttctcagccttcctacaacatatgaaaacagcgggtcggcgcgtggaccggggcagaagagccgtcctgctgtacccgcgcgcccagggcgctccgcggggaccgcgcactcgggaagctgtgctgtgctcaacacccccctgtgcctcccagatcaccagggatcgtctcttacctgacacccagtgcgc

SEQ ID NO: 622 - DNA, 280 bp, Homo sapiens
  misc_feature 1..280: note = chr6:137819268-137819548
  misc_feature 1..280: note = hyper
  source 1..280: mol_type = genomic DNA
ccgctcggtgcccgacgcccactgctccgcagccttagccaccgagttcctctccagcagctgccggctctgcctgaggccgcggcgattttggctcaggagcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctg

SEQ ID NO: 623 - DNA, 52 bp, Homo sapiens
  misc_feature 1..52: note = chr6:150285317-150285369
  misc_feature 1..52: note = hyper
  source 1..52: mol_type = genomic DNA
ggttgtggactgcagcgggtttcagaggaggggaggcttctggaaggaccgg

SEQ ID NO: 624 - DNA, 342 bp, Homo sapiens
  misc_feature 1..342: note = chr6:150285544-150285886
  misc_feature 1..342: note = hyper
  source 1..342: mol_type = genomic DNA
cggtggctcctttccgccgggtccgcttcctgcggctgctgcttgcccctcaggccaggaggtttctggaaggaccggtgctgtctccccgaacatcgtggtctccccgaacatcgcggcctctccgaacatcgccctctctccgagcaacgcgatctccccgaacatcgcggtctccccgaaaatcgcgatctccccgaacattgccatctcaccgaacatcgcgatctcgccgaacatgcccggctgaaggcactcagttcccctccgcggctcctttccgccgggtctgattcctgcggctgctgcttgccccgcaggccaggaggcttctggtagcac

SEQ ID NO: 625 - DNA, 429 bp, Homo sapiens
  misc_feature 1..429: note = chr6:150286099-150286528
  misc_feature 1..429: note = hyper
  source 1..429: mol_type = genomic DNA
cgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctg

SEQ ID NO: 626 - DNA, 533 bp, Homo sapiens
  misc_feature 1..533: note = chr6:157556764-157557297
  misc_feature 1..533: note = hyper
  source 1..533: mol_type = genomic DNA
aaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggc

SEQ ID NO: 627 - DNA, 1231 bp, Homo sapiens
  misc_feature 1..1231: note = chr6:166579715-166580946
  misc_feature 1..1231: note = hyper
  source 1..1231: mol_type = genomic DNA
tttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggc

SEQ ID NO: 628 - DNA, 1021 bp, Homo sapiens
  misc_feature 1..1021: note = chr6:166581218-166582239
  misc_feature 1..1021: note = hyper
  source 1..1021: mol_type = genomic DNA
gtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcctcgctctcttataaaaacaggacttgttgccgaggtcagcgcgcgcatcgagtgtgccaggcgtgtgcgtggtttctgctgt

SEQ ID NO: 629 - DNA, 607 bp, Homo sapiens
  misc_feature 1..607: note = chr7:8473635-8474242
  misc_feature 1..607: note = hyper
  source 1..607: mol_type = genomic DNA
agaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagc

SEQ ID NO: 630 - DNA, 47 bp, Homo sapiens
  misc_feature 1..47: note = chr7:8474515-8474562
  misc_feature 1..47: note = hyper
  source 1..47: mol_type = genomic DNA
cggaggaggcttcttctctagaagttagcgaccggctgtaccctttg

SEQ ID NO: 631 - DNA, 264 bp, Homo sapiens
  misc_feature 1..264: note = chr7:8480763-8481027
  misc_feature 1..264: note = hyper
  source 1..264: mol_type = genomic DNA
gaccttaacagtcctcgccgttctaattaaggaaaggcaggcgagcctgccagccgagagcggttgggtcagcggcttcatggtgcagccgagtctcaaagcgggtctgcactctcgcctccctctgcattctcttagccactatttgcctggtcccgtcgcgtgtgtgcaggaagtttcagtcttgatttatccactagtcaagttcccgaccagctctttttctggatgtcagcactaaccccctcccggagcttggtaaac

SEQ ID NO: 632 - DNA, 596 bp, Homo sapiens
  misc_feature 1..596: note = chr7:8483358-8483954
  misc_feature 1..596: note = hyper
  source 1..596: mol_type = genomic DNA
agcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaag

SEQ ID NO: 633 - DNA, 37 bp, Homo sapiens
  misc_feature 1..37: note = chr7:19145857-19145894
  misc_feature 1..37: note = hyper
  source 1..37: mol_type = genomic DNA
agaactggaaaaccccgtttcctttgagaaacgcgtc

SEQ ID NO: 634 - DNA, 154 bp, Homo sapiens
  misc_feature 1..154: note = chr7:19146031-19146185
  misc_feature 1..154: note = hyper
  source 1..154: mol_type = genomic DNA
cggcgcacatttcagcttttcagcttcacggtggagctcgcagtaattgagtcgcgagggttatttttcctggcctcacctcgcggtcctgagcctgcagggagctttcggaaagacatcgccccctccccctgagtccccggcagcttctgaa

SEQ ID NO: 635 - DNA, 345 bp, Homo sapiens
  misc_feature 1..345: note = chr7:19146237-19146582
  misc_feature 1..345: note = hyper
  source 1..345: mol_type = genomic DNA
cggctagaggttgaggccggaggctgacaccaccagggacccaacggagggtttattctgcccagcttcacatctgggggtcaaatcgcattaaagccaaaccaccaacggggcagggagcaggtggttaactgcacaaaataaagttacagaaaaaacctcgttttgcaggcgagtgacttagtttccctctgtagctttgccgtcataaaaagcaagtccctcccctctcctgagctggaaggcggggaaaggttatcagcggctccagatggacgcccgtaggcagggtcagtttaggaagaccggcaggcaggcgtattaggcgcgcgggctcccatcctc

SEQ ID NO: 636 - DNA, 932 bp, Homo sapiens
  misc_feature 1..932: note = chr7:19146942-19147874
  misc_feature 1..932: note = hyper
  source 1..932: mol_type = genomic DNA
cttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctccttagatattactccaggacggaaacctgattgcaaaccgctgttccttcgaaacttgcaaaacccggaacagaaaactcccgcccagccaattttagctctcgctgaactctcccgcctgcgttacgtttgcacagcaactctttgtaaatgtccgagtcctctcggaggaaagatcgttagggcgacgagaacattaagaggggacctggagggcagatatcctcgatcccaagagagcaactttgtcgcctcagaaaacacgccaacttccctcctgctctttccttggtcaactcagaatcaaccgattgtattgaaatctcctgaaatcccgaacagggattggcccagtcggcttctgaaaccgaggccggggaatggcaggaatggggggcagagaggatcggaaagaagagtccttcccccacagacattcccagctgggacacgagctcgctcgcagcgcgtttatggaaagagggggcgctgggaaccgcgctggcggcgagcagactccagggtcgagattattcgacacgtgtcttttattcctcacaatccatttcttacgggtgatttatgaacgaatctctttgatcagggacggttttatctgtccactgctacagatgacagatgcggctgctaaaatgcctggtccccgctgcctaaaaggttgctcccccccttcccaaatgctgttgctttttctctggcggtccccaccccctgcttcttcgttctccttcccta

SEQ ID NO: 637 - skipped

SEQ ID NO: 638 - DNA, 340 bp, Homo sapiens
  misc_feature 1..340: note = chr7:19156303-19156643
  misc_feature 1..340: note = hyper
  source 1..340: mol_type = genomic DNA
ggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagact

SEQ ID NO: 639 - DNA, 43 bp, Homo sapiens
  misc_feature 1..43: note = chr7:19156703-19156746
  misc_feature 1..43: note = hyper
  source 1..43: mol_type = genomic DNA
agcccgcagacttcttgccgcgcttgccctgggccgggctgcc

SEQ ID NO: 640 - DNA, 138 bp, Homo sapiens
  misc_feature 1..138: note = chr7:19157055-19157193
  misc_feature 1..138: note = hyper
  source 1..138: mol_type = genomic DNA
cggaggagagagcaggaggacggacgggagggacctccgcggggagggcgcgcgggggaggcggggagggaggcgggagggggaggggacggtgtggatggccccgaggtccaaaaagaaagcgcccaacggctggac

SEQ ID NO: 641 - DNA, 69 bp, Homo sapiens
  misc_feature 1..69: note = chr7:19157194-19157263
  misc_feature 1..69: note = hyper
  source 1..69: mol_type = genomic DNA
cacaccccgccaggcctcctggaaacggtgccggtgctgcagagcccgcgaggtgtctgggagttgggc

SEQ ID NO: 642 - DNA, 303 bp, Homo sapiens
  misc_feature 1..303: note = chr7:19157264-19157567
  misc_feature 1..303: note = hyper
  source 1..303: mol_type = genomic DNA
agagctgcagacttggaggctcttatacctccgtgcaggcggaaagtttgggggcagcagtgtcattggcctgacgtgaggaggagggacttttcgaagttttataggaaagtttccgctttccagtccccctcccccgtcccacctcccttcctcggggtctaacaattcgtcctcccaaaccattcaaaaacgacctggcccgggcggccggcccctccacccgcctcctagccgccctcccccttccctccccgtcgccttcctccggcgggcgcggggcgatttccttccccgccggag

SEQ ID NO: 643 - DNA, 302 bp, Homo sapiens
  misc_feature 1..302: note = chr7:19157633-19157935
  misc_feature 1..302: note = hyper
  source 1..302: mol_type = genomic DNA
cggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatt

SEQ ID NO: 644 - DNA, 156 bp, Homo sapiens
  misc_feature 1..156: note = chr7:20816291-20816447
  misc_feature 1..156: note = hyper
  source 1..156: mol_type = genomic DNA
ggtgtgggctcacatcgccggctggcttgagggaggagagtggtggcggctccggaggtggacgtgtcaattatatcctggagctccgggaagccagattgcttctaccggcggctgcaggggcttgcaagcgaagataggcggccctccttcctt

SEQ ID NO: 645 - DNA, 70 bp, Homo sapiens
  misc_feature 1..70: note = chr7:20823261-20823331
  misc_feature 1..70: note = hyper
  source 1..70: mol_type = genomic DNA
acaaactctgggtctcgggctgccaaaagtcacccccaccaagccccgacagcctgagtaggacgtccgg

SEQ ID NO: 646 - DNA, 497 bp, Homo sapiens
  misc_feature 1..497: note = chr7:20823382-20823879
  misc_feature 1..497: note = hyper
  source 1..497: mol_type = genomic DNA
cggctctggaaccaagcagccgtctgcccgggcggcgctgttctgcccaggcctccagcctctccctctccaccgctccgctcaggcttgtcagccgagccgctcctgcccgcgcgaggcccgctgtctaccaggcactggattagtccagctctacctccagtggccgttccctctaaaagttacgcccttcacaacctggggggtggaggaggggaggacaaggaagagagaacgagaaataaaggcccgacgaggcgcgggttccggctgcaacgggttcaggcagcgttacccgtggaaagggaaagccagggcccgggacagcgatgcgtgttacttacttgtccatatcccctttacaaagttaagtcacagaaggaagaaggaagaggggcagaaacagaaagagacagagagcgagtcggatgcaatagggaaaggctggagttgaagtccggacagacagggcccaagaggacttggtgggaggaggt

SEQ ID NO: 647 - DNA, 90 bp, Homo sapiens
  misc_feature 1..90: note = chr7:20823919-20824009
  misc_feature 1..90: note = hyper
  source 1..90: mol_type = genomic DNA
cgttgcggtgcccgggctcggggggctgcagcagctctggggagtggcagggcgggctgcccgcggcgctgtgctcgctgtcggtgtcgc

SEQ ID NO: 648 - DNA, 545 bp, Homo sapiens
  misc_feature 1..545: note = chr7:22589325-22589870
  misc_feature 1..545: note = hyper
  source 1..545: mol_type = genomic DNA
tttcccaggtggtgccgtggtggccgtggggtgaggaaaatatgtacggctgtagcccgtccatttctcatcctgggatagcgaggggtttccggaggaggcgtcagcggtgggaagtgggagaaagcgagcaaaaggggcgggggcgaaggagcggactcgcctgctgccgcgggggcgggaatccgcaagccagcctgggagaagggacagaacagcggctgatccttccctgggctagggaaggaaaataaactgtgctggcctcggagtgggggatggagaggggcgatggcgctgcatctgcaggacgttgcaagggctaggagcgggcaagactagtgtcggcaggaaggtagtggtggtgatggcgggggtgtgtggcaaacagagcccgagcgaaagcctgagaaggttctggttgccccccagcctactttagtccctaaccctccagcggggcgaggagggagcgcatcggagaggtacctgtgcgatgggcagcggtgcttggcacctgagcgtaggtacgatactcagcaagg

SEQ ID NO: 649 - DNA, 159 bp, Homo sapiens
  misc_feature 1..159: note = chr7:25896441-25896600
  misc_feature 1..159: note = hyper
  source 1..159: mol_type = genomic DNA
cagtgtgggtgagagcgcagtctgtgaccaccagcgcttctgactcagcggaaaacgccggcaaacaggactacacctcaccgcggcggcaaaagcggcctcagctccagcactcacagccaccactttcaccgtcgccccgccaccaccaccttcgct

SEQ ID NO: 650 - DNA, 278 bp, Homo sapiens
  misc_feature 1..278: note = chr7:25896660-25896938
  misc_feature 1..278: note = hyper
  source 1..278: mol_type = genomic DNA
acgcacgcacgcgcgcgcgcacaaacacctctccctgctgtcaatcatacatgcgcgccatagcgcgcatgcgcactggtggactccagcccccaccgatcctacgccctgtctctgcgtctgggaccagacgcaccaataagagagcggattcgggggcgggccacaaggaagtagccaatgagagcgcggttggaagccagggctagagaggagtaaatccttctgtcgtccccgttctgccgcccccgcgatgatttatgcgtcctttttattat

SEQ ID NO: 651 - DNA, 505 bp, Homo sapiens
  misc_feature 1..505: note = chr7:27135266-27135771
  misc_feature 1..505: note = hyper
  source 1..505: mol_type = genomic DNA
acacccccaggttcccggaagtctggtaggtagccggctgggggtggcgatggtggtggtggtggtggtggtggggcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccgg

SEQ ID NO: 652 - DNA, 445 bp, Homo sapiens
  misc_feature 1..445: note = chr7:27135979-27136424
  misc_feature 1..445: note = hyper
  source 1..445: mol_type = genomic DNA
cgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattc

SEQ ID NO: 653 - DNA, 324 bp, Homo sapiens
  misc_feature 1..324: note = chr7:27136425-27136749
  misc_feature 1..324: note = hyper
  source 1..324: mol_type = genomic DNA
acttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctcca

SEQ ID NO: 654 - DNA, 699 bp, Homo sapiens
  misc_feature 1..699: note = chr7:27190372-27191071
  misc_feature 1..699: note = hyper
  source 1..699: mol_type = genomic DNA
gggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggccacggcgtggcagcagcgagcgccagcacggtcgcaataaataatcggcccgcggcagccgcagtcaggaaggcggcggacctaggatgcaaatgcgccgctttatccgccccgagcgcacgcagagcacgggctaacgtcctaaacatccacagccccttcctatttatcgaatccataccaagatattgtctcaagttggggaaacaacaacccaaacaaaaaacaaacaaaaagaacctcggactcttttcttgtcgctgtccgaggagttctcggggcaaatctggtctgatgtgcacttaggccgagctacagttcgagccaccgcgctacgcaaagccaccgccagcagcacgctctgcgcttcctcccgggcagctccaccatcctctccccgctcgcggaaggtggggagtgcggtcgccagtccgttgcgccaaggtggattggggggtccccctatcgcccagactcggtt

SEQ ID NO: 655 - DNA, 16 bp, Homo sapiens
  misc_feature 1..16: note = chr7:27195586-27195602
  misc_feature 1..16: note = hyper
  source 1..16: mol_type = genomic DNA
atgctatgggctccac

SEQ ID NO: 656 - DNA, 27 bp, Homo sapiens
  misc_feature 1..27: note = chr7:27195866-27195893
  misc_feature 1..27: note = hyper
  source 1..27: mol_type = genomic DNA
cgcctttggcgaggtcactgcagagcc

SEQ ID NO: 657 - skipped

SEQ ID NO: 658 - DNA, 132 bp, Homo sapiens
  misc_feature 1..132: note = chr7:27196154-27196286
  misc_feature 1..132: note = hyper
  source 1..132: mol_type = genomic DNA
aagaactcataattttgacctgtgatttgttgtccggcagctttcagtgtcggttttacgaggtagagtgatatatgataacattacacccccagatttacaccaaaccccattttcttttggacggagctc

SEQ ID NO: 659 - DNA, 351 bp, Homo sapiens
  misc_feature 1..351: note = chr7:27196287-27196638
  misc_feature 1..351: note = hyper
  source 1..351: mol_type = genomic DNA
ccgcagcacgtgaccgcccacatgaccgcctccgccaatctcagcagtcctcacaggtggtctcgctccgcagggcccgcagccgcctagaatggaagggcaagaggctcaaatatgcggccaaagaatccgcccgcgcccggcgggcctggcgcgtcccgcggaaaaagacctggaggctccgcgggagcgcccagctggcggccaacctccgcactggggtctgcggacgccaggcggcccggccccacgcagcaccccccaccccgcccccccgccgactcctgctagtgagccctggaccaagcttgggatcctccccatccctctcctgtccgcctgcccagaccc

SEQ ID NO: 660 - DNA, 324 bp, Homo sapiens
  misc_feature 1..324: note = chr7:27212660-27212984
  misc_feature 1..324: note = hyper
  source 1..324: mol_type = genomic DNA
ggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctcc

SEQ ID NO: 661 - DNA, 796 bp, Homo sapiens
  misc_feature 1..796: note = chr7:27213188-27213984
  misc_feature 1..796: note = hyper
  source 1..796: mol_type = genomic DNA
gggggctgcgcggggaacgggccagccccgagttgctgcgcgccgccgccgccgctgccatagcccttggcggtgccgtaggcctgagaaaggcggaagtagccaggcactggcaccccgctggaggtgcccagggcgcagccgtcgggcggcgggccccgcgggaagggagccagttcggcggcggtggccgagactttggggcatttgtccgccgagtcgtagaggcagtaggagctctcttctttgatgttctgcgcgaaagagcacgaggtggcctgcggcgctggctggggtggttgcggcgggggcggcggctgctgctggggcggcggcggcggcccgtcaggcggctccatccggcaagaccggggcgcgtctagccacaggtctatgggcgagggcccgtagccgtgcgccccgggacctagacccccgccaccgccaccgctgcccggcgacgctgcctcattgcgcttgccgcccagcgtggggaagagcccgcagctctgcagcccgtagggcaggtcggcggcgggcggcaggtagaccccgccgtgggcgtagtaaccgccaccgccgccgccccccgcgccaccaccaccgccgcctgcctcgcctctgcccgagctgatgagcgagtcgaccaaaaaagagttcgcggcggggctctccgagcatgacattgttgtgggataatttggcgaagggagcagatagccctttctggctgacatttcttgtgcaaaacatgctgaatacgattagcaatccccccgcaccgcggcgggcgccc

SEQ ID NO: 662 - DNA, 277 bp, Homo sapiens
  misc_feature 1..277: note = chr7:27213985-27214262
  misc_feature 1..277: note = hyper
  source 1..277: mol_type = genomic DNA
cagccaatcccgagccagagtttccgcgcgaccactcccagtttggtttcgtaggcgcggggccgctctccgagggcgccctcagagcccgcgattgatataaatatgtaatctgtattgatgggccaggagacgcaccccgacaccttggcccgaaggccgggagctgtgggggctgccccaacgtggctggtggggggcctggccattgggctcgccccgcccctacccggacgtgagccccataccggggtcccttagaagggcccttgggccc

SEQ ID NO: 663 - DNA, 378 bp, Homo sapiens
  misc_feature 1..378: note = chr7:27244932-27245310
  misc_feature 1..378: note = hyper
  source 1..378: mol_type = genomic DNA
aggggtctctgtacccgacgctgccactggcccaaaggaattttacccgcgagcgcccaccccaccctagcttgatgcttacgcccgcaacaaaacaggaaaccaggactgggcagtgcattctttaagtcaacaaatacactgaagacttcgagcgtttgaaggaaggagggggtttgcacgtaagcctggccccgccgggctcggctttctcgctgagaaagcggcgcaggcagccaggcggcctgggcccgcgggggtccatctcgccctagactcctaagaactcccacggccctgttcccagctgcgaattcttaatgcacaacgcgacggagggaaggaaattcaccagcgcagcgacgaggaaggggaact

SEQ ID NO: 664 - DNA, 437 bp, Homo sapiens
  misc_feature 1..437: note = chr7:27264875-27265312
  misc_feature 1..437: note = hyper
  source 1..437: mol_type = genomic DNA
taggtgagggggtctcgaaaggaataccaggccggggagtactggcaagtgtcggaggggaagggcaggtcggggagaggatccccaggggctgggtgtctgcagggctccccgtaactcagaggggccggcggccgccgcccgaagcctgagcttttctcagcagatggagaattcatttttaacccccaggaaggaatgggctgagacatcagaccaccgctcctagagggtcaaatttcctccccataaatccaaaacattctctttagggagttccctccgtggcgcgcaaacccgggaagccgcgcgccctggggtttcttggcgggccgtgcgcgcagcctgaaccgccaaagtcgcgtcatcccgcatttgcctgcacccaggagtttgcaacccgcagagcccgcagaggccaccgccaagagtgcgcg

SEQ ID NO: 665 - DNA, 132 bp, Homo sapiens
  misc_feature 1..132: note = chr7:27279237-27279369
  misc_feature 1..132: note = hyper
  source 1..132: mol_type = genomic DNA
gtcgcctccccggggttcccacccacccccctccggcccgggccaggccagcccagccccggcggaagccaagctgggagcttttgaagtccggagaatttcaatccgagaggagccggctggaccggagcc

SEQ ID NO: 666 - DNA, 18 bp, Homo sapiens
  misc_feature 1..18: note = chr7:27279453-27279471
  misc_feature 1..18: note = hyper
  source 1..18: mol_type = genomic DNA
cgccgggcctggagcggc

SEQ ID NO: 667 - DNA, 173 bp, Homo sapiens
  misc_feature 1..173: note = chr7:27290946-27291119
  misc_feature 1..173: note = hyper
  source 1..173: mol_type = genomic DNA
aaagtcatatccttgcgtcttcatcgagattatttatagcgcagtgagcgctgctgaaaggtatacgctgttaacagggacaattacttaaagggaagcgtttgtaaaatggaaaacaaatgccggggttggtaacaaatgggatcaaaagcagccattccaatctggctccc

SEQ ID NO: 668 - DNA, 537 bp, Homo sapiens
  misc_feature 1..537: note = chr7:27291314-27291851
  misc_feature 1..537: note = hyper
  source 1..537: mol_type = genomic DNA
gggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtcc

SEQ ID NO: 669 - DNA, 476 bp, Homo sapiens
  misc_feature 1..476: note = chr7:30721202-30721678
  misc_feature 1..476: note = hyper
  source 1..476: mol_type = genomic DNA
gggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcag

SEQ ID NO: 670 - DNA, 237 bp, Homo sapiens
  misc_feature 1..237: note = chr7:32467419-32467656
  misc_feature 1..237: note = hyper
  source 1..237: mol_type = genomic DNA
gtaaggaaactcacccgctgcgctgcggcttcgtggccagcagggctgggacatactcgcctcacgcttcagcaccggggacagctcctgcctcgccaacttcggcagctcttctcgatgtctcgccgcgggctgtgcctcacaggctacgggaggggagagtgtctccccacgccggggtcccggcctctgggttttagggagcgcgaatgggtctccgacagcaacgggagcagc

SEQ ID NO: 671 - DNA, 69 bp, Homo sapiens
  misc_feature 1..69: note = chr7:32467946-32468015
  misc_feature 1..69: note = hyper
  source 1..69: mol_type = genomic DNA
cgcctaacagtctggggtggatgggacttggggagtcgctatatagaggctgtccggaggctttactgg

SEQ ID NO: 672 - DNA, 266 bp, Homo sapiens
  misc_feature 1..266: note = chr7:33943692-33943958
  misc_feature 1..266: note = hyper
  source 1..266: mol_type = genomic DNA
ttggacagaggaagtcggtagtccaccgtgagctcaaggacagctagctgatcgtcaggtcccaacacttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcg

SEQ ID NO: 673 - DNA, 296 bp, Homo sapiens
  misc_feature 1..296: note = chr7:35293182-35293478
  misc_feature 1..296: note = hyper
  source 1..296: mol_type = genomic DNA
cgttggcccgagaggagagttggggcttgggggacgccgtgaactccatggtccccagcacgcggtcctggccagggacggggtcgtccgaactgccgtccagattccccaagggagacaaagacccgaaacacagctcaaagtttccgagagcagtcacagcggggccagggactccagaagtgtcagctccaacgactccagagctgcacactggcctctattccccaccgcaaagccccagagccgcagagacttcgaaggcagccggagaggagagggcccaccgagcacta

SEQ ID NO: 674 - DNA, 110 bp, Homo sapiens
  misc_feature 1..110: note = chr7:35294031-35294141
  misc_feature 1..110: note = hyper
  source 1..110: mol_type = genomic DNA
cgcccgagatccgggcatggcccagttggggaagctatgaccagaccagtggaagcctcgggagttctcgctttttccattctttttcttacctgcgctcaaagttccaa

SEQ ID NO: 675 - DNA, 53 bp, Homo sapiens
  misc_feature 1..53: note = chr7:35296952-35297005
  misc_feature 1..53: note = hyper
  source 1..53: mol_type = genomic DNA
cttaacgaatgctaacgaatgctcccttagctgggagctgcagggaccggtcc

SEQ ID NO: 676 - DNA, 217 bp, Homo sapiens
  misc_feature 1..217: note = chr7:35297137-35297354
  misc_feature 1..217: note = hyper
  source 1..217: mol_type = genomic DNA
cgcttctcagcacaagggcatctgtctactcccgaacatggccggagattcctgtccacagcctccctccagctctttctggtagacactttaaaagcgacattaacgggcttcggtgcctttggattcctaaattaggtttacggaaaaggaaagacttcccaagaacagtgagaagaggaactgcagcccctccaaggccgctgcggcgcgttcc

SEQ ID NO: 677 - DNA, 547 bp, Homo sapiens
  misc_feature 1..547: note = chr7:35297470-35298017
  misc_feature 1..547: note = hyper
  source 1..547: mol_type = genomic DNA
cgacgaacaccccgcgggttttagtttatcgagccaaagtggtcccggagaagcgctccctcgcagccaagctgcaagaagtggccgggaacctacaggcctcgggccgacccaggaagcctccgcaccagaaagctcgaggagcccttacccaagtcttgctcgaagggcaaagcaaagagccagcacccctgagtgtcactgaagttcctggatggggtgtgagtgcgcgcgttccgtccgagacctcagtctcgcccagctatagagccgataaagggatgtcttgtgggcgtaaggcgcttcgcgcccatctccaaggccgatgtggtcaggaggtgaggggaaatgtccttctggcagaagcccgcggtgctgcgacgttgacccgcctggcctcaggctcagggcggcgggcagcccagggcacatgtagtttcagcagccgcgctacgtgggcgggggaccccaggccaccccacgtgtccgccctgggcctcctccgggtcccaaggcgcggcgcctccaggccttgtagcgtcttccc

SEQ ID NO: 678 - DNA, 500 bp, Homo sapiens
  misc_feature 1..500: note = chr7:35301244-35301744
  misc_feature 1..500: note = hyper
  source 1..500: mol_type = genomic DNA
ctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttccttt

SEQ ID NO: 679 - DNA, 147 bp, Homo sapiens
  misc_feature 1..147: note = chr7:37487113-37487260
  misc_feature 1..147: note = hyper
  source 1..147: mol_type = genomic DNA
ggtcaaggcaggtcccgacccgcctccaacttcaaatggccccctaggcgggagagggtcactgggcggggagttcctggctgtgcggtcacacacacacacaccgactcacacacacacccacaacaccccccccacacacacaca

SEQ ID NO: 680 - DNA, 74 bp, Homo sapiens
  misc_feature 1..74: note = chr7:37487380-37487454
  misc_feature 1..74: note = hyper
  source 1..74: mol_type = genomic DNA
accgacttcccaaccccaaacacacgcgcgcacccccgggacagctgagttctgtatttcctcttcctcaaagc

SEQ ID NO: 681 - DNA, 71 bp, Homo sapiens
  misc_feature 1..71: note = chr7:37487755-37487826
  misc_feature 1..71: note = hyper
  source 1..71: mol_type = genomic DNA
gggggattccctcccatccccgagtgcaggagaagacgccgagtctgagccgcagccgcttctctagctct

SEQ ID NO: 682 - DNA, 268 bp, Homo sapiens
  misc_feature 1..268: note = chr7:38670396-38670664
  misc_feature 1..268: note = hyper
  source 1..268: mol_type = genomic DNA
agccacaaaatcccccgcaagaaggaaggctgctgcaatctcccgccccgatctgcgggccgcgtccccgcgagctgcctgcgggcgcgctgggagccggcccggggagatgcgagcgcagggagatgcgctctgctccgggcgcagcgggcaagctgccgcacctcctacttctgttgcctggcttggggccaggagagcggcaacccggggccggctccggagctggacatatccggcgtctccggggccagggtctgcgggtccc

SEQ ID NO: 683 - DNA, 198 bp, Homo sapiens
  misc_feature 1..198: note = chr7:49812820-49813018
  misc_feature 1..198: note = hyper
  source 1..198: mol_type = genomic DNA
tctgctaaactaacacggccttcgaatcccaatctgaacacagtagctgaaacaagctgtccacaaagaggaaagccagagggggccaattaggaaggaagaaattaaagaaaagagaaaagccaagatgaaaggtccagcgcaaagtgaatgactcgactggagaatggcagccctggcagggtctgcggccggctg

SEQ ID NO: 684 - DNA, 197 bp, Homo sapiens
  misc_feature 1..197: note = chr7:49813809-49814006
  misc_feature 1..197: note = hyper
  source 1..197: mol_type = genomic DNA
ggaggaaccccctcccccgcccaagtttgtgaatatgggcgcttcgcccagtgttgaggtcggcagggaccgggcagggggtcagcagggccgggcacgtccggagccctcagggaggagggctgagggggaggggacagacgcaccggagtgcgcagagtgggggcgttcggggagtgaggcggagagaggctgga

SEQ ID NO: 685 - DNA, 134 bp, Homo sapiens
  misc_feature 1..134: note = chr7:49815116-49815250
  misc_feature 1..134: note = hyper
  source 1..134: mol_type = genomic DNA
cgagcatcccgctggagaagctggcccaggcaccagagcagccgggccaggagaagcgtgagcacgcctctcgggacggcccggggcgggtgaacgagctcgggcgcccggcgagggacgagggcggcagcggc

SEQ ID NO: 686 - DNA, 109 bp, Homo sapiens
  misc_feature 1..109: note = chr7:49815656-49815765
  misc_feature 1..109: note = hyper
  source 1..109: mol_type = genomic DNA
cgcagtgcaaggagaggaagaactactgcgagttccggggcaagacctatcagactttggaggagttcgtggtaagatgcgaacgcccgccgggcgactttgcaccttc

SEQ ID NO: 687 - DNA, 72 bp, Homo sapiens
  misc_feature 1..72: note = chr7:71802451-71802523
  misc_feature 1..72: note = hyper
  source 1..72: mol_type = genomic DNA
gcagacacgcggggggcgagcaggcgcttggcagacggtgctccttccttcccttcccaaagaggctgccca

SEQ ID NO: 688 - DNA, 95 bp, Homo sapiens
  misc_feature 1..95: note = chr7:71802577-71802672
  misc_feature 1..95: note = hyper
  source 1..95: mol_type = genomic DNA
cgccgccttcactacttcatcccaggtgcccacaccctagatccacgattacacctgagcccagggggaaggcggggcgccgaagtggaggggcc

SEQ ID NO: 689 - DNA, 644 bp, Homo sapiens
  misc_feature 1..644: note = chr7:79083190-79083834
  misc_feature 1..644: note = hyper
  source 1..644: mol_type = genomic DNA
cgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaat

SEQ ID NO: 690 - DNA, 335 bp, Homo sapiens
  misc_feature 1..335: note = chr7:87229568-87229903
  misc_feature 1..335: note = hyper
  source 1..335: mol_type = genomic DNA
taacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagc

SEQ ID NO: 691 - DNA, 96 bp, Homo sapiens
  misc_feature 1..96: note = chr7:96621715-96621811
  misc_feature 1..96: note = hyper
  source 1..96: mol_type = genomic DNA
ctgtgattccaggagcgcgtgtgggcgcggtcctcgccgcgacgccgcgcgcgggtcaggctcaactgcgaaccttgccaccgagctttcccgcgg

SEQ ID NO: 692 - DNA, 340 bp, Homo sapiens
  misc_feature 1..340: note = chr7:96636033-96636373
  misc_feature 1..340: note = hyper
  source 1..340: mol_type = genomic DNA
cgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttct

SEQ ID NO: 693 - DNA, 240 bp, Homo sapiens
  misc_feature 1..240: note = chr7:96653580-96653820
  misc_feature 1..240: note = hyper
  source 1..240: mol_type = genomic DNA
ctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagact

SEQ ID NO: 694 - DNA, 131 bp, Homo sapiens
  misc_feature 1..131: note = chr7:96653862-96653993
  misc_feature 1..131: note = hyper
  source 1..131: mol_type = genomic DNA
cggacgtctggaacggagcttggaagtcgccggatcggatgctggggacccttctgtcaaacactcctgtcatcgctcacgggcggcggcagcggctgtccttgctgttgtggcggcggcagctgccctag

SEQ ID NO: 695 - DNA, 223 bp, Homo sapiens
  misc_feature 1..223: note = chr7:98245856-98246079
  misc_feature 1..223: note = hyper
  source 1..223: mol_type = genomic DNA
cgtgactttgtccctaactccgggtgtcccctccttcccatcagcgtccggcgcctggtcctggtcccggtccccgaggcccccgggattcttcccgagcgttttccgagttggcgcggggggtggaggcggggccatggagcgcgtcccggggaccgttgcatccggaggcggccgtcgtgcggctccttcccgcctcgagagtgaggtggccgggccttga

SEQ ID NO: 696 - DNA, 204 bp, Homo sapiens
  misc_feature 1..204: note = chr7:98246304-98246508
  misc_feature 1..204: note = hyper
  source 1..204: mol_type = genomic DNA
cgaggggcgcctgggcacggccagccgaggctctcgagagccccagtgtcgttttccacctcaggcctcctttcctgaggcagagcccgggacctcgcgctctcgcctcaggctccggcccacgctcccgcccggccgccaggcgcgcaacggaaagcgcccccgccccgccccgctccgcccactgcgtgacgcgcacccggc

SEQ ID NO: 697 - DNA, 1085 bp, Homo sapiens
  misc_feature 1..1085: note = chr7:98246533-98247618
  misc_feature 1..1085: note = hyper
  source 1..1085: mol_type = genomic DNA
cgccccacacgccggccccctccgcccctcagcttaagaaagggcgcgcggacccggcaggccagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgaggtagcggcccgcggggagcgcgggggacctggaatggggacgctcccgagtcgggggcggaagactcgggaggatggggaaagggggcctggccctggggagggtgtgatcgtccgtgggggtgagctggacttgagggtgaaaggcggggatctagatcctgctcgggaactcccctgcgtggtatcccttcccacaccgctgctcttgctggaaggaaacgtttaaattccacccccgcgcgtcgggactgccagcgggatccgccgagcacttcccgaggtccgggctagcgaacccagacggccaagccgcgggcgccaaatacccggggacgcggtagcctctatcctcttgcaaatctccaaatctccgcgagccgggatgcgctcccgcaggccgtgcgggttgctgcgagg

SEQ ID NO: 698 - DNA, 302 bp, Homo sapiens
  misc_feature 1..302: note = chr7:108097189-108097491
  misc_feature 1..302: note = hyper
  source 1..302: mol_type = genomic DNA
agggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatc

SEQ ID NO: 699 - DNA, 503 bp, Homo sapiens
  misc_feature 1..503: note = chr7:116962644-116963147
  misc_feature 1..503: note = hyper
  source 1..503: mol_type = genomic DNA
gaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccgg

SEQ ID NO: 700 - DNA, 68 bp, Homo sapiens
  misc_feature 1..68: note = chr7:116963330-116963398
  misc_feature 1..68: note = hyper
  source 1..68: mol_type = genomic DNA
cgtccgctctgctcccctccgggcgcagccgagggagggggtgctgcgcctggcgggggtggggagaa

SEQ ID NO: 701 - DNA, 392 bp, Homo sapiens
  misc_feature 1..392: note = chr7:117119505-117119897
  misc_feature 1..392: note = hyper
  source 1..392: mol_type = genomic DNA
aacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggaga

SEQ ID NO: 702 - DNA, 254 bp, Homo sapiens
  misc_feature 1..254: note = chr7:121939991-121940245
  misc_feature 1..254: note = hyper
  source 1..254: mol_type = genomic DNA
agattcccccaacctcgctccacaacccggaaggagctcaggccggacttggcgtgagggtccctgcggggctgggtcacctacccgtccgcgatcaccccacaggggctgttagtaatctccctgcttcctaggccgttgagaagcactcaggtcacccactctcggtgaccagagcggtcagtctttccccgccatgaaatgtgagttcgggtggcagccgccgcgcccctgcagtgtcccctgcacatctc

SEQ ID NO: 703 - DNA, 25 bp, Homo sapiens
  misc_feature 1..25: note = chr7:121940433-121940458
  misc_feature 1..25: note = hyper
  source 1..25: mol_type = genomic DNA
cggtgtggaccgatggtggattctc

SEQ ID NO: 704 - DNA, 306 bp, Homo sapiens
  misc_feature 1..306: note = chr7:121941881-121942187
  misc_feature 1..306: note = hyper
  source 1..306: mol_type = genomic DNA
ggtgcatgcaagaggcgaaaggccaggggatgcagaggcttctggtcggccctgaagtgtggggcccaacatgccctggggtctgcagacgaactcggaccaggagctctagtctgccgctgcctcagcgtgggggcacggctgaggctgggaggacccttagcctcgatcactggtggccctggtggagcccgggctgcaggggccccggggttggcagcggcggctgcagaggaggcagcgtcatcggcggctgctgcggtagcgggggcggcggttcagtgcctggttcgccagctggcgtgc

SEQ ID NO: 705 - DNA, 15 bp, Homo sapiens
  misc_feature 1..15: note = chr7:121943974-121943989
  misc_feature 1..15: note = hyper
  source 1..15: mol_type = genomic DNA
ccgggtggcatgggc

SEQ ID NO: 706 - DNA, 123 bp, Homo sapiens
  misc_feature 1..123: note = chr7:121944176-121944299
  misc_feature 1..123: note = hyper
  source 1..123: mol_type = genomic DNA
cgccgccggggcctccagactggccttccgcggctcggagcccgtcactcctgccttggggctcgtgtcgtaggccacaggcacgaaggggatcatgcaggggatcgacgagttgagatgcag

SEQ ID NO: 707 - DNA, 488 bp, Homo sapiens
  misc_feature 1..488: note = chr7:121946495-121946983
  misc_feature 1..488: note = hyper
  source 1..488: mol_type = genomic DNA
aaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcc

SEQ ID NO: 708 - DNA, 64 bp, Homo sapiens
  misc_feature 1..64: note = chr7:121947097-121947161
  misc_feature 1..64: note = hyper
  source 1..64: mol_type = genomic DNA
cgcttcgtagttgtccttggaccgggcgcagacactcagtattggtcagcgctggaaattttct

SEQ ID NO: 709 - DNA, 128 bp, Homo sapiens
  misc_feature 1..128: note = chr7:121950137-121950265
  misc_feature 1..128: note = hyper
  source 1..128: mol_type = genomic DNA
acacagagcaaagaacgagcttagtgaaatggagaagcagtagaggtaaataaaaatcctcgagctagaaagctctaagaaccgcttataaattcagttacctcctgaactccggccgatggccactc

SEQ ID NO: 710 - DNA, 125 bp, Homo sapiens
  misc_feature 1..125: note = chr7:121950428-121950553
  misc_feature 1..125: note = hyper
  source 1..125: mol_type = genomic DNA
cgcagagccatttgaatagaagaagcccgaagtgaaacagaaaagctgaaaactccccggctgggctctccacttctcggttcttgctcacgagttccaaacagttaaagtgacgttggcaaggc

SEQ ID NO: 711 - DNA, 148 bp, Homo sapiens
  misc_feature 1..148: note = chr7:121951863-121952011
  misc_feature 1..148: note = hyper
  source 1..148: mol_type = genomic DNA
ggctcctggaaacaacgcgaagctttaagcgccccgcgcgggtgttgacgctggcagctcgcaaacagcgtcccgcggccacggtgacccgaggggccggccggctgacgtcacgaacgcggccagctgcggggacccgggctgcaac

SEQ ID NO: 712 - DNA, 15 bp, Homo sapiens
  misc_feature 1..15: note = chr7:121952043-121952058
  misc_feature 1..15: note = hyper
  source 1..15: mol_type = genomic DNA
cgagggtgggaaggg

SEQ ID NO: 713 - DNA, 124 bp, Homo sapiens
  misc_feature 1..124: note = chr7:121956458-121956582
  misc_feature 1..124: note = hyper
  source 1..124: mol_type = genomic DNA
tccccatcttcaatccgaagctggggtatcccagagaaagtctcgctctgagctcctgctggggcacctgcccagccatgcccctcgagggcgtcgctgctctcaacccctctccgctactgcc

SEQ ID NO: 714 - DNA, 123 bp, Homo sapiens
  misc_feature 1..123: note = chr7:121956954-121957077
  misc_feature 1..123: note = hyper
  source 1..123: mol_type = genomic DNA
cgcgaacatctctccggaacatcgatctatcacctccctttaaggacccggaccgggaaatttccattttctgttttgggaataagaaataaaagcgaccaagctcttgccctaatttccccc

SEQ ID NO: 715 - DNA, 153 bp, Homo sapiens
  misc_feature 1..153: note = chr7:127744057-127744210
  misc_feature 1..153: note = hyper
  source 1..153: mol_type = genomic DNA
atgaagaaactgagccgaggaaaggaagcgacttggccaaggtcggagagctcattctttgcagggcggggtttggaacccggggtctggctctcggcaacgcgccctcggcccgcagcctcctgccccctgtgccccgcttcggcccccagc

SEQ ID NO: 716 - DNA, 459 bp, Homo sapiens
  misc_feature 1..459: note = chr7:127744211-127744670
  misc_feature 1..459: note = hyper
  source 1..459: mol_type = genomic DNA
cagctgcagaggggcccccctcgacgcatacactcaagagcccgaccgcgcggctgaaatcgcggagctcggagccgcggctggctgagcgatcgcggttcctgggctgcgtgcgcgccccttggagctgaaaggagcgccaggatcgggggcgctgcaccgggctgggcccctcaacgctcgcagaccgggccgggctgcagctggagatggcagcaatcccgggaggtctccgggcctcttcagggtgcgtccaggaggcgggttccgtgcgacgcggcgcagcccacccccacgagaccgcttaacttcgcgggggcagcctcgggcgctcggagacgcggaggcccagactgcagcctccggatgctggaagcccagactccctggggtcaccggctctcccgccaccccagctgcaaagagtcccattgcttcaccgtccggagcttagtctcc

SEQ ID NO: 717 - DNA, 100 bp, Homo sapiens
  misc_feature 1..100: note = chr7:128337422-128337522
  misc_feature 1..100: note = hyper
  source 1..100: mol_type = genomic DNA
gccatgtaagcagagcggacaactctgagggcgtggctgggcggggttcttggggcagcccggcgccactgccggcatctacgcaccctgaacgcgcccg

SEQ ID NO: 718 - DNA, 13 bp, Homo sapiens
  misc_feature 1..13: note = chr7:128337582-128337595
  misc_feature 1..13: note = hyper
  source 1..13: mol_type = genomic DNA
cgcctggaaatac

SEQ ID NO: 719 - DNA, 134 bp, Homo sapiens
  misc_feature 1..134: note = chr7:128337787-128337921
  misc_feature 1..134: note = hyper
  source 1..134: mol_type = genomic DNA
cggaagctaagatgtggccgcatttaggaccccaccggcttggctgtgcctctcccagccccctggcggagcggactaaccctagcatttcattgattcacaataacgccaccccaccccgactgactattttg

SEQ ID NO: 720 - skipped

SEQ ID NO: 721 - DNA, 854 bp, Homo sapiens
  misc_feature 1..854: note = chr7:129422115-129422969
  misc_feature 1..854: note = hyper
  source 1..854: mol_type = genomic DNA
ggagctggactcggacggtgagggggcggcccccggggacctgataccctggatcccttacggctcagggctcaggcgggggaagaggtggctcaggacgacctggggtcctcactttgctggcctgtccagcgcatcctaagcccgcgtgtatcctaccccctccttctgcagatccaatgtccgtctggcaattgccccattccctctcgctggagagatcccttccgcctcgccacaggcgtcccacgctgcccggagtcgtgcgccccgggacgggtagttttgggttcctcgacgcttggccaggtttaggaaagacccgctgtcttccttgctgcccccacctaggagactcggcgccttgcgctccgtcctttttaatggtgtcgcggcttgtccctctggcttgctccctcctagtccctaccccacacggctcccttcgccagctccatgacaatcccactcgtgctgaagaccttgggcaaagaagtaaccatcggtcttcccctcccttcccattcctccggcggcaggactagggggaaaggtgcccgggatacaagcccctcacgcagacccactgatgcggccgtggttctgccattggcccctctccgaatggtgaggttctcctgctaaccctggccccatggcataactagtataaccccagtgagaggaacccagagttccagtcctcccctgctccagtccctctgtgatctcgatctcgagggattcacttcacctctctaagcctcagtttcccatttgcaaaatgggcagaatgactcgcacctctggggatgaagaaaatgcacatgtgagcacgtgggtacttggcgacc

SEQ ID NO: 722 - DNA, 299 bp, Homo sapiens
  misc_feature 1..299: note = chr7:129423125-129423424
  misc_feature 1..299: note = hyper
  source 1..299: mol_type = genomic DNA
cgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctcttta

SEQ ID NO: 723 - DNA, 1355 bp, Homo sapiens
  misc_feature 1..1355: note = chr7:129424591-129425946
  misc_feature 1..1355: note = hyper
  source 1..1355: mol_type = genomic DNA
caggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacagttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctc

SEQ ID NO: 724 - DNA, 627 bp, Homo sapiens
  misc_feature 1..627: note = chr7:137531262-137531889
  misc_feature 1..627: note = hyper
  source 1..627: mol_type = genomic DNA
cgtccttctccttctggccggcggccgcgggctcgtccagggcagcggcccccgccgccgcggctgaccctgcgccccgcgggtccgcgccgccctcggcgcccaggcagcagctcccggcgccgcttccgctgctgctgctgccgcccgtcgcccctttctcctctcccgccgaggagctggggttcatggcgcccgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtc

SEQ ID NO: 725 - DNA, 176 bp, Homo sapiens
  misc_feature 1..176: note = chr7:137531908-137532084
  misc_feature 1..176: note = hyper
  source 1..176: mol_type = genomic DNA
cgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcattta

SEQ ID NO: 726 - DNA, 113 bp, Homo sapiens
  misc_feature 1..113: note = chr7:149112136-149112249
  misc_feature 1..113: note = hyper
  source 1..113: mol_type = genomic DNA
gaacgcggatttacccggcatggtctttggaaatcagtgtgctgtggaagcaggtcttgctagagccaagaaacctctaaaagccactattcagggggcacccggatttgaac

SEQ ID NO: 727 - DNA, 2593 bp, Homo sapiens
  misc_feature 1..2593: note = chr7:155164445-155167038
  misc_feature 1..2593: note = hyper
  source 1..2593: mol_type = genomic DNA
ttccctgttgcaaggcgagcggaccgcgctgcacgggtccaggctgggtgcccctctcccctggggtaaagaggcagcacaggttgggacagctagatgggggcaatccaggcgtcctgcccacggtttcctgggagccaacaaaggcgccgagacctcacccgtgtgaggcaaccgccccgtggtcccacagagcttctggaagtctgcgtcccggccttcccgatgcaaggcgccctctccacctgcctcggccgtgagcaggttcaggagggcgagaaaggttaggccgagcggaaccgcgcggccagcgttacgcagggtgccctggacacccctaggcgcccacctggacttgttcccacctcctctcgccccttgccttcttaacccgcattacccgtgtaggcctggggtggaatcggactacttgttcgggatttgctcgagaacattctagggagaaggcacgcccggctttgggcttggccgagagtttagggcaggagcgccggcggggagctccccgggtgctggagaatgcgtgtccggaaagaagtagggcgcgcttcgtggatgcaaccagggccgtctcgcgcactttcttcctaccctgggacagcgcctgaactggagctgggcgcacacactttacggagccagctcgggttcttacgccctggctcacccccgcccgccgccccaggatgcaggtgctgcggcgctccctggtagcctcccgcgctccctgggggcgcgctttcctccatttcagggaagtccccggacaggtgcccacgttttacgctgtccggtagaagcccgcgggctcaggccgacttgcgcggccgcttctccccagggagagaagctggagcttcccccacgcggccctaaggcggggccggctgggccggagtgggcgcggccagggtgtcccagcgcgccccctgccgaccgcgcgctgcggggggcaactccacctcccctggggaggcctcgtccccgctgcagggagactaaagcgtgggtccgcgaccagccggtttaggaacgaaaactctggaactaaaaacaaaaaataaaactggtgagtgcgcagcgtggtcagtgtttccctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaaactcactgcaaaattcgccagcgtctcattcttcacacacggggcaccacacgagaatcaccccctccccagaattttgcaaagcacgtttgctgagttttctcgcctttccttccgacaagctcgaactggaaccagcgctctcccctctagacctgcctccgcgccccacccttcttcccccacacagtccctccgcagggagaattcaggtgctaaaaatgctcgggcctcgcagcttcctccctcctcctcggttcctcgaatgacccaagctgcctctttccgggcccttggaagacggtgcgaattccgcggcggcccgctctcgccagcgccacagccctgactcccacccggaggcctgagttcaaccgctttcgcttccttgcgggccgttcaaccctctgaatacgcagattcatttatttatgttttttaatgtagtaagtgggcagctaaatgaattgcaatttgtcatttttatggttaatttgaaatctcgctcttgttgcctaatcctgttagttggtggcaaaacaaggagaaacgcgtgtttcggcagcagtgattctaacaggcgttttatgttaaattacagcagaacccagaacaaaagcaggcggcggacttgcagtcccagcggcctcggccggtccgcgctgccggtgtgagccccgaaggaaagcaccccaagctggctgaccccgcgcacccccggccacacccgcccatcctggcttcgagattaagaagcccagtttggcaccccaattatgtttggcaatgtccccggtgccccagacccgcactccgctgcctcctggcttctcatgcccgcgaagcacggcctcgccctgggcgcggggcatcaccggcgcggaggcccgagggcgggtcacttcggatccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggggagc

SEQ ID NO: 728 - DNA, 51 bp, Homo sapiens
  misc_feature 1..51: note = chr7:155167039-155167090
  misc_feature 1..51: note = hyper
  source 1..51: mol_type = genomic DNA
ggagcaggggcggcccggcgggcgggccgggacccggcttttccggctacc

SEQ ID NO: 729 - DNA, 487 bp, Homo sapiens
  misc_feature 1..487: note = chr7:155167174-155167661
  misc_feature 1..487: note = hyper
  source 1..487: mol_type = genomic DNA
cgctggcgaggcgtttcttgtccccggcgcccgctcggtgccgtctcagtgagtttgattgaaacgcggctgcgggaaggggtcgacagaggcaagctgcgagcaaggcgggggtgggggcgaggaaggggacccggagagctcccggagggcttggccggccaccgccgcgcggcgctgctcggggactgctactttgcaaggcggcggctgcccctgcggggttcgggttgcagggtcaagtgtcacgtcctccgcaatctccaatattcctgtaatgtatttaaatggacgaattcattacgcggggccgtgtgaatggggcgaggccgcgagcgcggcgcgatcagtagcgcccactaacagttcgttctgcacggcggagcgcgagaccgcggacccacggaagccccctcaatggtgtttgcgtcctcgccgccaccggcttggtagggtcctttagggaaggaggaagagttcaggcacc

SEQ ID NO: 730 - DNA, 61 bp, Homo sapiens
  misc_feature 1..61: note = chr7:155241429-155241490
  misc_feature 1..61: note = hyper
  source 1..61: mol_type = genomic DNA
ccgcccgggtggacccgccctgttcaagcgcggaggggcggaggcctggttgggttgtagc

SEQ ID NO: 731 - DNA, 738 bp, Homo sapiens
  misc_feature 1..738: note = chr7:155241491-155242229
  misc_feature 1..738: note = hyper
  source 1..738: mol_type = genomic DNA
tggtgcggagcaggacgccgcctcgtgccatggtcactggagacgcacgcccatcttccctcccgggcccgtcgatcctgccatcttccgctcccggccgctcgtgggtgttcgtcatttagaccttccccgtgcttcatgggacgcaagccctcccccagagttcggttttgcaaaagaggtctggagccctcgctacagatcccctccctgggccacggaggatgagaagggtcaccgagccgagccgtaatcctgcgtaacccctgacctctctccttccctgcccccacggcaccccatcgtcccctccccgtctccgaggtcctccagaaaacagcgcagaattgtgcagatgtttaggagatgtgaagatgctggagatgcttaggaggcgacggttacgcgaggagaattgcttccaggtgcgcttctggaacgcacggagatcccccggcggggaaggggccggggctcgcgtcacttagtgtctgctcaccgatttccctctgaagagggggcccagggcctctgctgagggagcggggaggcggtgcgggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcc

SEQ ID NO: 732 - DNA, 491 bp, Homo sapiens
  misc_feature 1..491: note = chr7:155246989-155247480
  misc_feature 1..491: note = hyper
  source 1..491: mol_type = genomic DNA
ctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggct

SEQ ID NO: 733 - DNA, 423 bp, Homo sapiens
  misc_feature 1..423: note = chr7:155254901-155255324
  misc_feature 1..423: note = hyper
  source 1..423: mol_type = genomic DNA
agcccatgcccagtccgaagtctagccccacatctggcggttcagcctcgagtggccttgggcgagtcacttccctcttggggccccagaatccttacccggtgcctattgggtggcacacctctgggtaacctgacttctctctgtccaccgtatctacccaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggc

SEQ ID NO: 734 - DNA, 792 bp, Homo sapiens
  misc_feature 1..792: note = chr7:155258072-155258864
  misc_feature 1..792: note = hyper
  source 1..792: mol_type = genomic DNA
tttggggtctttgagcgagtgatctacgcgttgaattgctgtttttccaaactttcatggcttaaaaattttttttcttctccctgtaaaagaaactcagagactggtgatctgttaccgaagacgactttttaggcgttttctgtttccccaggcagctgggccgttggcgttcccaggcggaagcggggcctctgggctgggcctctgccctgccaggaagcggtctgggggctgcccctcgggattttcagaaccctggaaggagagagctggggtctcaccgcggagactcccgagttctcgttgcctgggcccgagctgcgccccagggtcatcgctgatggcgcgagaccacgcattccccgcgaaccccgacttctgaacagttcagaaagttcgtagattaaaaaccaaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagac

SEQ ID NO: 735 - DNA, 164 bp, Homo sapiens
  misc_feature 1..164: note = chr7:155258914-155259078
  misc_feature 1..164: note = hyper
  source 1..164: mol_type = genomic DNA
cgctggttcctctcgggcctcccgggctctgcgtgccgcggatctggacccggactgcagacaccgccccacgactgggcccccggccagactgttaccccacaggaggagggttccctaagtgtgcagaagaggaaagctcatttataaagtccttgctcctt

SEQ ID NO: 736 - DNA, 504 bp, Homo sapiens
  misc_feature 1..504: note = chr7:155259119-155259623
  misc_feature 1..504: note = hyper
  source 1..504: mol_type = genomic DNA
cgccgggcccaggctgagcttactccacactgctccatagccgggcagagactccgcgagggtctgggagtcctggcctcggaggacccgccgccctgcaggcctgcccaagcaggcgcccccgcgagagtgcgggacagagagggcctggcggggctccttggcgctgagagccctccttctccgctgcacccagctctgccaacggggctggatgagtgggggctggagtcagaatcccagggtctacacccgccgacagcagcaatgccgacccgccctgcctttctcctaaggagcggagggaaggagccatgtgaatgaccccagcctgaccaccaagagggcgccagcatttctgttttcctagagtgaaaaggtcaaatcgatgggggctcctacaccgctggacacaggtgcgcccgggcgtccagtgcgcgcaacacacgcccagacactctatatgcaaatatgcctgccgccgcggagccggccgggaggcag

SEQ ID NO: 737 - DNA, 12 bp, Homo sapiens
  misc_feature 1..12: note = chr7:155259833-155259845
  misc_feature 1..12: note = hyper
  source 1..12: mol_type = genomic DNA
cggggattcgcc

SEQ ID NO: 738 - DNA, 112 bp, Homo sapiens
  misc_feature 1..112: note = chr7:155259846-155259958
  misc_feature 1..112: note = hyper
  source 1..112: mol_type = genomic DNA
ggtgaggcagaaatcagcctccggggagatgggtccccccttcccgacgcgcccctgcacacactgctgccccggcgccgggcctccgggcggggacccctcttccgggcat

SEQ ID NO: 739 - DNA, 99 bp, Homo sapiens
  misc_feature 1..99: note = chr7:155260038-155260137
  misc_feature 1..99: note = hyper
  source 1..99: mol_type = genomic DNA
cgccggcgggacggagagtggggtcccccggaccctgggtcgggcaggcctggcgctggcagctctgttgcacagatttgtgagcgatgctggtggccg

SEQ ID NO: 740 - DNA, 197 bp, Homo sapiens
  misc_feature 1..197: note = chr7:155301753-155301950
  misc_feature 1..197: note = hyper
  source 1..197: mol_type = genomic DNA
aagatccgttaggaacgcctccgactgagctagggggatctaagaagaaagacagggcgaggaaacttgtcttaatgttaatgttacttcaaagaccttccggcgagtccacatggaaacgccacactctccctgaatgcaaacgtgtgccacttccctagcacgggcccagaagacggtaccgcagattgttatta

SEQ ID NO: 741 - DNA, 346 bp, Homo sapiens
  misc_feature 1..346: note = chr7:155302372-155302718
  misc_feature 1..346: note = hyper
  source 1..346: mol_type = genomic DNA
ccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggc

SEQ ID NO: 742 - DNA, 188 bp, Homo sapiens
  misc_feature 1..188: note = chr7:155302963-155303151
  misc_feature 1..188: note = hyper
  source 1..188: mol_type = genomic DNA
cggcggcgtccccttgaaagcgcgggcggagggtgcgcttgtgttcttgagacccaggttccattacaaaccacccagcatcgccaccggcgccccccgtttcaataaggaagccactttgtcaaaacattctaaaagaaacttgggaagaggacgcgtcagagaaataccgccgccgattaactatc

SEQ ID NO: 743 - DNA, 21 bp, Homo sapiens
  misc_feature 1..21: note = chr7:156794464-156794485
  misc_feature 1..21: note = hyper
  source 1..21: mol_type = genomic DNA
ccactgcgcccagcctgattt

SEQ ID NO: 744 - DNA, 288 bp, Homo sapiens
  misc_feature 1..288: note = chr7:156795067-156795355
  misc_feature 1..288: note = hyper
  source 1..288: mol_type = genomic DNA
ctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccc

SEQ ID NO: 745 - DNA, 235 bp, Homo sapiens
  misc_feature 1..235: note = chr7:156795401-156795636
  misc_feature 1..235: note = hyper
  source 1..235: mol_type = genomic DNA
cgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccc

SEQ ID NO: 746 - DNA, 114 bp, Homo sapiens
  misc_feature 1..114: note = chr7:156795899-156796013
  misc_feature 1..114: note = hyper
  source 1..114: mol_type = genomic DNA
cggcctgctggaggcgcaggggccggcgcaggtccggggcctggctctgctggaggacgggggaggggcggccctattaacagcgtcttcctttgatgtcgctcttccccgcgt

SEQ ID NO: 747 - DNA, 246 bp, Homo sapiens
  misc_feature 1..246: note = chr7:156796494-156796740
  misc_feature 1..246: note = hyper
  source 1..246: mol_type = genomic DNA
tttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggag

SEQ ID NO: 748 - DNA, 355 bp, Homo sapiens
  misc_feature 1..355: note = chr7:156797005-156797360
  misc_feature 1..355: note = hyper
  source 1..355: mol_type = genomic DNA
cggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggcc

SEQ ID NO: 749 - DNA, 828 bp, Homo sapiens
  misc_feature 1..828: note = chr7:156797607-156798435
  misc_feature 1..828: note = hyper
  source 1..828: mol_type = genomic DNA
aatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcc

SEQ ID NO: 750 - DNA, 621 bp, Homo sapiens
  misc_feature 1..621: note = chr7:156798526-156799147
  misc_feature 1..621: note = hyper
  source 1..621: mol_type = genomic DNA
cgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatg

SEQ ID NO: 751 - DNA, 50 bp, Homo sapiens
  misc_feature 1..50: note = chr7:156799290-156799340
  misc_feature 1..50: note = hyper
  source 1..50: mol_type = genomic DNA
cgcggccggcggcacttccccaggaggttcgactgcgcctgggctgggga

SEQ ID NO: 752 - DNA, 434 bp, Homo sapiens
  misc_feature 1..434: note = chr7:156801438-156801872
  misc_feature 1..434: note = hyper
  source 1..434: mol_type = genomic DNA
ccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctc

SEQ ID NO: 753 - DNA, 31 bp, Homo sapiens
  misc_feature 1..31: note = chr7:156810491-156810522
  misc_feature 1..31: note = hyper
  source 1..31: mol_type = genomic DNA
gggcccctggtgacccgccccggcttcccct

SEQ ID NO: 754 - DNA, 204 bp, Homo sapiens
  misc_feature 1..204: note = chr7:156810597-156810801
  misc_feature 1..204: note = hyper
  source 1..204: mol_type = genomic DNA
cgcgaacccggtgactctgggccccttacattaaaataattacccggcggaacaggtggcccactcccggcgcctgggtgcatctgggcccccggagccgcagcccgggaggaggggagcggcacgcccaggggagggaaggtcaggcccgctgagccgggagccgggagggtagagaggggctttcctagggacagacggtcc

SEQ ID NO: 755 - DNA, 104 bp, Homo sapiens
  misc_feature 1..104: note = chr7:156811302-156811406
  misc_feature 1..104: note = hyper
  source 1..104: mol_type = genomic DNA
cgacattctgtaaatgagataatgatccataaacccggatgatagatgtggcgtgcctgcgatgtcttctctaaatgagctgctcgcatcgactgctaataatg

SEQ ID NO: 756 - DNA, 974 bp, Homo sapiens
  misc_feature 1..974: note = chr7:156812852-156813826
  misc_feature 1..974: note = hyper
  source 1..974: mol_type = genomic DNA
gttgtaatatatctgcgaaccggggactcccgggcagggaggcaggattctcccggctggggcggtctgagtagctgggtctgagcctcgggctgagaagagtaaattctgcagaaagggccgcgtccgatcggcgcaaacgttcggttcgtagcaggagcttctccaggcggccaccgaacccaggtccaggactcggcactcctggagccctcctccccacgcagaccgcgggggctgatttaatagaatgtcgatagaatcattcgatgccttttagcttgtgatctttataaatgtccctctattaaattagaaaatgattctcttctcgtttaattgtattctttcgtttcttatttccaattaattagtcctatcgacgttgcaatattttaagtgacttgagtccgtttccagttagaatatatgggtcagcacatgcaattttatacccgacaggactatataatgtgggttttaactactcgttcctcatctgtcttaaacatctggccaggatgcgccacccggcctcctcgcagatccttcctggggcaggtgggcaccacgcgggaccctcccgggggctcccgcaggcgcctcttgctgcccggggccaagggtcgggcagcccatagcgtccggcctgggcctttacttggaattctttctgttgaagacttggtcccagcccagtggttctgggataagaagaccccgcagaggggcccagcgccgcgttcctacgagacacctgagctgcactgtgtttccacgggctaggagagcggtgactccccagcctccccgtaggcctcgctcgcaccgcagagggatggctggcccgtgccgctccgcggttcccctccccgggcggatccgcgcagggagagcccggcgggcctgggcttgggcctgggcctggttcgggggtgcaggccaagaggggcgccaggccgggctcccctacc

SEQ ID NO: 757 - DNA, 244 bp, Homo sapiens
  misc_feature 1..244: note = chr7:156813986-156814230
  misc_feature 1..244: note = hyper
  source 1..244: mol_type = genomic DNA
cggcgcggacacccgggctgcgctcagcccccacccccacaggcttcccagccgtctgcccgagttcggcttcaacgggagcggggctccacttttccttaattgacgaagtcacggattcctcccgggcggatttatggggctgcgcgttgtgccggcgcccgctgcttcgcatctgcgcgcccgcccggtgccgggccccgccctccgcctcagccccaagctcggcccgcgggcccggcca

SEQ ID NO: 758 - DNA, 16 bp, Homo sapiens
  misc_feature 1..16: note = chr7:157477473-157477489
  misc_feature 1..16: note = hyper
  source 1..16: mol_type = genomic DNA
gggccggggtctcctc

SEQ ID NO: 759 - DNA, 107 bp, Homo sapiens
  misc_feature 1..107: note = chr7:157477710-157477817
  misc_feature 1..107: note = hyper
  source 1..107: mol_type = genomic DNA
ggagccatacctgggcgggagggcttttcccgggggcccggcctgcgcccctcgccgcccctcgcccctcgcctctcgcctcccgcgggtcccgcctggccttggcc

SEQ ID NO: 760 - DNA, 50 bp, Homo sapiens
  misc_feature 1..50: note = chr8:23559552-23559602
  misc_feature 1..50: note = hyper
  source 1..50: mol_type = genomic DNA
ggaggatggtaggcccgctagatcaccatctccattcaccgccgatgccc

SEQ ID NO: 761 - DNA, 972 bp, Homo sapiens
  misc_feature 1..972: note = chr8:23559665-23560637
  misc_feature 1..972: note = hyper
  source 1..972: mol_type = genomic DNA
cgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggc

SEQ ID NO: 762 - DNA, 230 bp, Homo sapiens
  misc_feature 1..230: note = chr8:23564830-23565060
  misc_feature 1..230: note = hyper
  source 1..230: mol_type = genomic DNA
tctcagccccaggaccgaggaatgggtgtgggggctacatgtggggagccctcgacctcttaaagggctccgcgaatggtgggggagactggaaggcaatctctgcggcccgcgcaaagtggtcagaggcgggagtgggggtgggggggggtgggcttccgtcgcccttggcgtccccacgttctttttcttcctctcctttatcctccttaaagcggattgcctggagc

SEQ ID NO: 763 - DNA, 292 bp, Homo sapiens
  misc_feature 1..292: note = chr8:23571681-23571973
  misc_feature 1..292: note = hyper
  source 1..292: mol_type = genomic DNA
ctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctggga

SEQ ID NO: 764 - DNA, 514 bp, Homo sapiens
  misc_feature 1..514: note = chr8:24858647-24859161
  misc_feature 1..514: note = hyper
  source 1..514: mol_type = genomic DNA
gctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcctcatcctttcactgagcgggttcaggccctagttactaccgcaggcaccagccacacccggggagatgtgtgctgttttgtgcaagacgctgcggtcacccagtccggaattctgctggtctacaccgagtgccgcaacaccaccaccacctccgcacacatacgccctccttgaacctcttccccatgaatgctttggcttttaaggaactttgtggcgtttctgctctttcggaggcagctgcccgaggcagcttcccaaggcagaacagggactgactgctgaggttccgcggggtcggggag

SEQ ID NO: 765 - DNA, 193 bp, Homo sapiens
  misc_feature 1..193: note = chr8:37655798-37655991
  misc_feature 1..193: note = hyper
  source 1..193: mol_type = genomic DNA
ttcgcgcaaagattgcgaagaaagaaacgcggctggggaagcggggttccctcaccgcagcccacccgggcctccttccgcgacttccctcttagtcagggcctcagtacgcctttgctttgctggcagcgagcgctgcagcgccgcagcccgaccccaagcctcctacaagggggtcgcaagtcccagcagc

SEQ ID NO: 766 - DNA, 148 bp, Homo sapiens
  misc_feature 1..148: note = chr8:37656049-37656197
  misc_feature 1..148: note = hyper
  source 1..148: mol_type = genomic DNA
cgcagctccacgcacgccgtggatttgagggtcgggcccccgcggccgccgcttcctttcctgtcccaaatccagcctaagagccgcttccctttccctgtcctcctgaccccagtggcaaccgtttctccaccgccccttgcccgca

SEQ ID NO: 767 - DNA, 415 bp, Homo sapiens
  misc_feature 1..415: note = chr8:37822994-37823409
  misc_feature 1..415: note = hyper
  source 1..415: mol_type = genomic DNA
cagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgc

SEQ ID NO: 768 - DNA, 13 bp, Homo sapiens
  misc_feature 1..13: note = chr8:37823410-37823423
  misc_feature 1..13: note = hyper
  source 1..13: mol_type = genomic DNA
ggttggagtggca

SEQ ID NO: 769 - DNA, 389 bp, Homo sapiens
  misc_feature 1..389: note = chr8:38008209-38008598
  misc_feature 1..389: note = hyper
  source 1..389: mol_type = genomic DNA
ggcctgagcctcatccgctgagagctggccaacccctcatcgcctccttcccgcagcgctcacccttcatgttgcgcatgtgtctgtaggagctcccagcgcacagcttgaatgtcgctagcagcattgtttcctggcaaatgtggcagtggtggggtcgctgccgctgctgctgccgccgctgctgctgcctcttctctcaagggtggttcttcgtccttcctgagcccctcaagcttcgcctctgagtcccgcagctgcagcctggacctggtgttctgcgtcttaaatgtcccccgctgaaggctgtgcatcatcatcaggagataaaaacgccatcactcactgtgcaaaggaaggggtcaaggatagagcgattgcctcacact

SEQ ID NO: 770 - DNA, 160 bp, Homo sapiens
  misc_feature 1..160: note = chr8:49468668-49468828
  misc_feature 1..160: note = hyper
  source 1..160: mol_type = genomic DNA
ttaggaacatttccccggtcggtcattagcgcgcgctctccccgcgcccagggtgcccccgtgcccagggtgcccccgcccggcgcctccgcggtcccctcccgcgcgcacctttccgagtgccagtggggcggccccgagaccgcaattgctctggccc

SEQ ID NO: 771 - DNA, 362 bp, Homo sapiens
  misc_feature 1..362: note = chr8:49468829-49469191
  misc_feature 1..362: note = hyper
  source 1..362: mol_type = genomic DNA
gattgacgagcctccgatgcccatttactgcgcgcggcagccactctggagccgcggcacatctggatggagtcagctgcctagcgccaggggccagcacggcccagccagcggagcgcggcggtgagcgctagggaggccggcgcccgggccgcctccgcggccgaccccctgtccccacccgagcaggatttcctgatgtaaacacagcggctctgcgagaacagagctgctctcctgaatgtgtcatttagtgttctttatctgcttggggtcagcatagcgacttagaaaaacagcagtcttgctttgaatttaaacagcgaagaagccagagggtcctgttccgtatggggggaggg

SEQ ID NO: 772 - DNA, 193 bp, Homo sapiens
  misc_feature 1..193: note = chr8:54789613-54789806
  misc_feature 1..193: note = hyper
  source 1..193: mol_type = genomic DNA
aacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacc

SEQ ID NO: 773 - DNA, 588 bp, Homo sapiens
  misc_feature 1..588: note = chr8:54790022-54790610
  misc_feature 1..588: note = hyper
  source 1..588: mol_type = genomic DNA
ggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaac

SEQ ID NO: 774 - DNA, 49 bp, Homo sapiens
  misc_feature 1..49: note = chr8:54791897-54791946
  misc_feature 1..49: note = hyper
  source 1..49: mol_type = genomic DNA
cgcaaggttcttctctcaccttctccggcgaccccctcccgaggctccc

SEQ ID NO: 775 - DNA, 487 bp, Homo sapiens
  misc_feature 1..487: note = chr8:54792184-54792671
  misc_feature 1..487: note = hyper
  source 1..487: mol_type = genomic DNA
cgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcc

SEQ ID NO: 776 - DNA, 427 bp, Homo sapiens
  misc_feature 1..427: note = chr8:54792701-54793128
  misc_feature 1..427: note = hyper
  source 1..427: mol_type = genomic DNA
cggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattca

SEQ ID NO: 777 - DNA, 223 bp, Homo sapiens
  misc_feature 1..223: note = chr8:55370113-55370336
  misc_feature 1..223: note = hyper
  source 1..223: mol_type = genomic DNA
ccactgaaacaccctcggcttctgcaaaaagatgtgctttaaagagaatagaatggacgctcggtatgttcatctaaacgaccttgggcaagtacgtcgattccaaggtacaatcagccctcccagacggcttttcgagtctccctaaccccggtgggagaggacgcggcgccagagcccagctccggctagttttcccgggggcaggtgtagccttgggcgc

SEQ ID NO: 778 - DNA, 86 bp, Homo sapiens
  misc_feature 1..86: note = chr8:55370337-55370423
  misc_feature 1..86: note = hyper
  source 1..86: mol_type = genomic DNA
gggccgggggaggggcaaggggcgggcgtggggttggactgggacgtgggactcggaccacggcctgggcgtgggcctaacgacgc

SEQ ID NO: 779 - skipped

SEQ ID NO: 780 - DNA, 109 bp, Homo sapiens
  misc_feature 1..109: note = chr8:55370567-55370676
  misc_feature 1..109: note = hyper
  source 1..109: mol_type = genomic DNA
cggcttcgggccgggagacccgcgcagccctcggggcatctcagtgcctcactccccaccccctcccccgggtcgggggaggcggcgcgtccggcggagggttgagggg

SEQ ID NO: 781 - DNA, 204 bp, Homo sapiens
  misc_feature 1..204: note = chr8:55371172-55371376
  misc_feature 1..204: note = hyper
  source 1..204: mol_type = genomic DNA
cgaccctccaaagcagctttccgccttgctctccggctcccggattccccaggtggccgggggcgcgggtccaacggctctgggaaggcgacttcccggcacctccgggcggcgcgagagcacccttggccctgaactgggccggttgtgtccatccctcgaccccttccctagttaggtgtccttttctgtttttcgaacgac

SEQ ID NO: 782 - DNA, 286 bp, Homo sapiens
  misc_feature 1..286: note = chr8:55371439-55371725
  misc_feature 1..286: note = hyper
  source 1..286: mol_type = genomic DNA
cgggtgttccccaagggctcggactcaggagtcccagatctccctctttaacttcaccccggttgcgcaattcaaagtctgaggggggaggtgcgtccaggtggggccaggtggggcctggagcgggagcgcagccgataagccctgcgcccctctcccccttccttccactgtgcaggcaagtcgtggaaggcgctgacgctggcggagaagcggcccttcgtggaggaggcagagcggctgcgcgtgcagcacatgcaggaccaccccaactacaagtaccggc

SEQ ID NO: 783 - DNA, 75 bp, Homo sapiens
  misc_feature 1..75: note = chr8:55371993-55372068
  misc_feature 1..75: note = hyper
  source 1..75: mol_type = genomic DNA
cggcgtggaccccgacccggctttcttcgccgccccgatgcccggggactgcccggcggccggcacctacagcta

SEQ ID NO: 784 - DNA, 60 bp, Homo sapiens
  misc_feature 1..60: note = chr8:55372416-55372476
  misc_feature 1..60: note = hyper
  source 1..60: mol_type = genomic DNA
cgtgtgcaagcctgagatgggcctcccctaccaggggcatgactccggtgtgaatctccc

SEQ ID NO: 785 - DNA, 19 bp, Homo sapiens
  misc_feature 1..19: note = chr8:56015034-56015053
  misc_feature 1..19: note = hyper
  source 1..19: mol_type = genomic DNA
ggtgtggaggcatcatggc

SEQ ID NO: 786 - DNA, 161 bp, Homo sapiens
  misc_feature 1..161: note = chr8:56015185-56015346
  misc_feature 1..161: note = hyper
  source 1..161: mol_type = genomic DNA
cgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcc

SEQ ID NO: 787 - DNA, 67 bp, Homo sapiens
  misc_feature 1..67: note = chr8:56015565-56015632
  misc_feature 1..67: note = hyper
  source 1..67: mol_type = genomic DNA
ccgaggacagcgccacggccgctgctgcctccagctgcccgcagcctggagccgattgcaagacggt

SEQ ID NO: 788 - DNA, 148 bp, Homo sapiens
  misc_feature 1..148: note = chr8:57069590-57069738
  misc_feature 1..148: note = hyper
  source 1..148: mol_type = genomic DNA
gcatttcctagaagtcggcagccaaacttggtaattcttgcgtgtgataaaggcagccgtctgttctgctcagaaggggtttcctaacaggaggggccgaatgcaggcgtcacatccacgccgccccaggtcgtacacctaggccgtc

SEQ ID NO: 789 - DNA, 163 bp, Homo sapiens
  misc_feature 1..163: note = chr8:57069850-57070013
  misc_feature 1..163: note = hyper
  source 1..163: mol_type = genomic DNA
cgcgggagaaggctggtgggtacaggttgcctccgggccggagcgcccatgcagggcgagctgcgctccgcacaaaattgcggtgggggcgccagaccgccttgctccgcccctgagcggggcgccccggcccaaccccctgagggaggagggtccaggtgcc

SEQ ID NO: 790 - DNA, 143 bp, Homo sapiens
  misc_feature 1..143: note = chr8:57070014-57070157
  misc_feature 1..143: note = hyper
  source 1..143: mol_type = genomic DNA
cagactcttagcccctggcccggcgtccgcccggcaggttctggcactcctcgttggtaagccccgttatttcgtgcgcagtgtttacagaatataaagttcttcaggaaacgatgttataggagaaacgcctggattttccc

SEQ ID NO: 791 - DNA, 286 bp, Homo sapiens
  misc_feature 1..286: note = chr8:57358806-57359092
  misc_feature 1..286: note = hyper
  source 1..286: mol_type = genomic DNA
gccgcagaccaggggcgagagagcgggagccgggggaggcaggacattgactggggtcacaaagaagaaccagggaacgctgttggggaacccatgcaatgaaatgtgaagggaaagagggcgggcagacgtccccaaacccgctcagcaaagacaagcttcgggcaaattcactcacgttgacgctgttcggatggagcaggccaattggaaaagccgggttcagacacgactctagagggaagagaagaaggcaagtgtgaggagggcgggcgtcggggagaag

SEQ ID NO: 792 - DNA, 400 bp, Homo sapiens
  misc_feature 1..400: note = chr8:57359259-57359659
  misc_feature 1..400: note = hyper
  source 1..400: mol_type = genomic DNA
cgccccaatcgccggcgggctgcagctgacgcaggccctacgccagccccgcgccgacgccttcgcgggaggggtcggtcccccagcacccgcgcgccgctccccccgccgagctcgggtgggggccacagggggcgctcggtggctccccacacggccaggtgacaaacccaaggcagttaggaagtttggggagagtgagataggatcaagtttctccgcataaagtcactgaaattgcaccgtgggatgcgggctccagggagggaagcgaggtgggggcgtttggaaggatagatggactggcttagacttctggaatgtgctggagacccagcgggccggtgaacctgcccctttcccgcctcctccctgggccccctcgcgggtccccgtgggc

SEQ ID NO: 793 - DNA, 86 bp, Homo sapiens
  misc_feature 1..86: note = chr8:57360540-57360626
  misc_feature 1..86: note = hyper
  source 1..86: mol_type = genomic DNA
tttccaggccctctgcgccctctgcaaagggctgatttctacagtcgctaggacctgcagcggcgctgctcccgcggggctccggc

SEQ ID NO: 794 - DNA, 37 bp, Homo sapiens
  misc_feature 1..37: note = chr8:57360769-57360806
  misc_feature 1..37: note = hyper
  source 1..37: mol_type = genomic DNA
cgagcaccgcctgcctcccggccggggcatcacggta

SEQ ID NO: 795 - DNA, 95 bp, Homo sapiens
  misc_feature 1..95: note = chr8:67873327-67873422
  misc_feature 1..95: note = hyper
  source 1..95: mol_type = genomic DNA
ggcacaaaaatccttcggaggcatcctgtaagaggcttgcgagactcttaccaagccaccccggctttaaacgcctctccagccacctgtgaacc

SEQ ID NO: 796 - skipped

SEQ ID NO: 797 - DNA, 251 bp, Homo sapiens
  misc_feature 1..251: note = chr8:67873800-67874051
  misc_feature 1..251: note = hyper
  source 1..251: mol_type = genomic DNA
tgccgcagggtctgcacccggctgcgctcccgcgccgcattcgccgccgccggccgcccgctcccggaacgcgagccgcccccagggcccgccggccccggcccggtccgcccgggacgcgagtcgcggatggcggcggccaggggcgcgggctcggcgctggcgctgagggggctgcccgctgggcggccgcggtccatggcagcttcccgcgccgcgcgcgctgcaaaggaccgaaggtgcggtgaggc

SEQ ID NO: 798 - DNA, 509 bp, Homo sapiens
  misc_feature 1..509: note = chr8:67874164-67874673
  misc_feature 1..509: note = hyper
  source 1..509: mol_type = genomic DNA
cgcgatttgcttccggacgtctggggagagttgcggaactccggagttcttgggcttcctagaaggataagaagaggcgcagtgccggctttgcttttcaggggcaaattaagcaaaaggtctactctacccgggaagaaagatctcggaagcacagctcaggatcagcactcgttcgcgcttgggtgactttatccaacccggcacgcacgagaggtggcgcggctccttctcgccgacgccgcggaaaaccacggctcaccagccgccctcggcctttcacgccaggggggatttctgcccgaggagcgggggacccttagcctcacctcggggtacggcacccgccaccgttccgagcccgagagctgcgcagtacgcgtctgacgggcccctcacctttcctggagcggctgagtggagctccgctccgtcgtgagggcgggcgaggggcgtggagcagggcctgtgtggccagggccgcgctggtcactccatcctcgtccggc

SEQ ID NO: 799 - DNA, 103 bp, Homo sapiens
  misc_feature 1..103: note = chr8:67874755-67874858
  misc_feature 1..103: note = hyper
  source 1..103: mol_type = genomic DNA
cgaccggctaaggcaggtcgggcggaggacctggcccaccggagaggctacgccgggggctgaggcggcttagagggtcattaatcaaaccctccggcggggc

SEQ ID NO: 800 - DNA, 402 bp, Homo sapiens
  misc_feature 1..402: note = chr8:67874859-67875261
  misc_feature 1..402: note = hyper
  source 1..402: mol_type = genomic DNA
ggctcgggggcggggcgtcctcctggccccgcccctcggctcactgcctcacgctgctttccccgaggcgcctcgctgagggcggcgtgtggagagtttggggtgtctgccgccggctgcggtggggccgggctggaggccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagacccc

SEQ ID NO: 801 - DNA, 179 bp, Homo sapiens
  misc_feature 1..179: note = chr8:67875262-67875441
  misc_feature 1..179: note = hyper
  source 1..179: mol_type = genomic DNA
aatgctctcagtgtctgtaattctttaagaagttcctagagcagacagcccttggatcgtgggcacttctccccggggacggggaccctgctgaccgcctccgctgcccccgcgggggccaccgctctttaattatttgggcgaaacattcttttctggttttgcacttgtggactcac

SEQ ID NO: 802 - DNA, 240 bp, Homo sapiens
  misc_feature 1..240: note = chr8:67875442-67875682
  misc_feature 1..240: note = hyper
  source 1..240: mol_type = genomic DNA
ggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcgtaggtgaaatctaagtacttttcagcaacataattagaacacactcgaaacaatgcctgcagttctccgagtaggacatttt

SEQ ID NO: 803 - DNA, 23 bp, Homo sapiens
  misc_feature 1..23: note = chr8:70982262-70982285
  misc_feature 1..23: note = hyper
  source 1..23: mol_type = genomic DNA
cgctcccacaattaagacaaaac

SEQ ID NO: 804 - DNA, 281 bp, Homo sapiens
  misc_feature 1..281: note = chr8:70982286-70982567
  misc_feature 1..281: note = hyper
  source 1..281: mol_type = genomic DNA
aaaaaacagcaatagaagcaaacacaaaaaagccccaaacggaaatctgccgggatcctgccctactctaaattccgggttagtgttgccttccccttccctctccaagcaccccttccctaagcccggccgccttcccacacccgctctccgctttcggcccccaacccggttcctgcaaaacccattgaagttccctttccttccttcttctcagtcctacaaaactcgttggtagggtctgtgggagccgcggggccctgccaacctcggggctgggc

SEQ ID NO: 805 - DNA, 397 bp, Homo sapiens
  misc_feature 1..397: note = chr8:70982850-70983247
  misc_feature 1..397: note = hyper
  source 1..397: mol_type = genomic DNA
cgtccgccacattccccgggttcctcggaaactccaatcattctaccaggactattggggcctggggtagcccctcgggagccgcgtggacgagccctggccaggtgggagcgaagagcctcggcgactgccagtcctcccgcccccgcaccgccgggaaaggatggcgttttaatagacaggcagcaagttcaccgaggctgaagaatgaagccccttcagggccggcgggtcttgagatcaatgagcccaataagaaaaccaagcagggtcatgactcagaaattaaagaacacggggtcaggagaagaggtcagccacgacacaggcagcggcccgtctcctcccgatcctccaaaggcgcccttctcctagcctcctccgacctcagggatct

SEQ ID NO: 806 - DNA, 302 bp, Homo sapiens
  misc_feature 1..302: note = chr8:70983568-70983870
  misc_feature 1..302: note = hyper
  source 1..302: mol_type = genomic DNA
gcccacgcagatccccgcgtcgtcttctccccgcccaccgcagccattggccgactctcgactcgccctctgtcccctggggtcgctcacttaactcatcagttttccaaaccctccctgggaccctagtggcgagcactcgccgctggccttctagggcaggcagtattgccgctccaggcgtgcggagtcggggagaaaaaaaccgaacacgtgtgctacccagggcccccagataagcccctccgcgcgcacacacaccctgaaccggagtccagaaggccggactcgcgtcccggggt

SEQ ID NO: 807 - DNA, 277 bp, Homo sapiens
  misc_feature 1..277: note = chr8:70984016-70984293
  misc_feature 1..277: note = hyper
  source 1..277: mol_type = genomic DNA
cgagtccccggcagtgacacgtgggagcgttgggcccggcacccccgacgcttccgaggtttcgggtggtcgttttgctctctcgggggcttttattccttaagtggctttaaacgaccgaggatgggcctcccgcgccgccgcagctgtcacttccttcgggaaaggctagcgaccttggacgcgcaggctctgaaaaccaaggtccagacccataccgagcgcccaaagaccgcatttgaattctcctcgccggccattgagggagagaaaggaa

SEQ ID NO: 808 - DNA, 319 bp, Homo sapiens
  misc_feature 1..319: note = chr8:70984343-70984662
  misc_feature 1..319: note = hyper
  source 1..319: mol_type = genomic DNA
cgcagtcttgccgggtgagccgggacaggttcctcgcctgccccccggccgctgcttcctcttagctgaatggggagcgacccgccccgggcgcggccttcggggctgaagactgaggtgcagcctcacccccggcctggcagcggcttggaagagagagggaaaggaggaacatctacccggctaagagacgccgccagagtccctaaagctggcgggggacggaggccggggtcccggatcttcagagcgcccgcagccgggcttctgggctcctcggtgcggggaacctgaccctgtagccttcgccagggcgcgg

SEQ ID NO: 809 - DNA, 250 bp, Homo sapiens
  misc_feature 1..250: note = chr8:70984744-70984994
  misc_feature 1..250: note = hyper
  source 1..250: mol_type = genomic DNA
cgccctgccgcctgcttgccccctttgctgcaccgggtggccctggtccccgcgcccgcccgcccccgacgccttcgcgtggttccgcgctgcccgcggccagccccgtttcgcttcgcaaggagcgtgttgttttctcaatcgaaatgggatcaagatcccagggtttcctcgtctccttgttttgaggtgataggatcttagccaatagatcgaaaacgtgaaaagtacccgtcgcctcttgtcccaa

SEQ ID NO: 810 - DNA, 78 bp, Homo sapiens
  misc_feature 1..78: note = chr8:72460433-72460511
  misc_feature 1..78: note = hyper
  source 1..78: mol_type = genomic DNA
cgcccctccgctctgcagccggagcctgggcctggtgcccactgccccgcggggtgtctcggacgcctggcccctgca

SEQ ID NO: 811 - DNA, 345 bp, Homo sapiens
  misc_feature 1..345: note = chr8:72755470-72755815
  misc_feature 1..345: note = hyper
  source 1..345: mol_type = genomic DNA
ctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccgg

SEQ ID NO: 812 - DNA, 157 bp, Homo sapiens
  misc_feature 1..157: note = chr8:72756655-72756812
  misc_feature 1..157: note = hyper
  source 1..157: mol_type = genomic DNA
cggtaagctgcgccttttgaaaaggctatctgtactccttggaacaaaccaccccgggcaaagaagagggggttgtaaagggggccaagaggtggggcaggggcgtggaaggggtggggaccgcttttctgcatgccgaagagcggttggtggaggc

SEQ ID NO: 813 - DNA, 83 bp, Homo sapiens
  misc_feature 1..83: note = chr8:72756813-72756896
  misc_feature 1..83: note = hyper
  source 1..83: mol_type = genomic DNA
ggggaaggggacgtctctgcagagccgagatttgggctctgaagcccgacggcccttcaacatgtctgcgcaggataagtgag

SEQ ID NO: 814 - DNA, 448 bp, Homo sapiens
  misc_feature 1..448: note = chr8:91997061-91997509
  misc_feature 1..448: note = hyper
  source 1..448: mol_type = genomic DNA
cgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcgggggg

SEQ ID NO: 815 - DNA, 479 bp, Homo sapiens
  misc_feature 1..479: note = chr8:91997527-91998006
  misc_feature 1..479: note = hyper
  source 1..479: mol_type = genomic DNA
cgaggggcacgaggcgggcccagggcgggcgcggggcgtggcctcgggcgctgagcctcgagagcagccgcacccctgccggggtagaaccgttaaaagggtggcgcgcgctttcccgggcgagctgggcgcgtggggttggagcggcgccacccagagccggtcgtctagggtaggaggccgcgagtgaggcgctgacaggctagccctcgacggggcgcgcccgcgtgaacggccttgggggccccagaccgtggccctgcttgtgcgaagactgggaggcgccaggcgggccgcctgctgggggcttggcggcgggttccaggcagcgtctgtgagggaggccgcctctgtgagggaggccgccgtcgtgctgacgactgagtccaccctactcctgtcccccgtcagagctgctggcaggcgctgctttccccttggtgcatttagtgggtgtcgggattcgggttggcagggag

SEQ ID NO: 816 - DNA, 202 bp, Homo sapiens
  misc_feature 1..202: note = chr8:97157008-97157210
  misc_feature 1..202: note = hyper
  source 1..202: mol_type = genomic DNA
cgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccga

SEQ ID NO: 817 - DNA, 232 bp, Homo sapiens
  misc_feature 1..232: note = chr8:97157666-97157898
  misc_feature 1..232: note = hyper
  source 1..232: mol_type = genomic DNA
cgcgcccaccagctcttctttgtctgagagcatggacacatcaaacaaatacttctgtctccggagaggagtgtgcgagagatcgtctgcgagataaaaaataattacagtcagtttcacttaagggggagatcagcccggtgctcttcggccgccccgggaggaaaagggcggggagtgggggcaggtcggccgggcagtccagcttgcccggcccagggcctgaccaccc

SEQ ID NO: 818 - DNA, 122 bp, Homo sapiens
  misc_feature 1..122: note = chr8:97158021-97158143
  misc_feature 1..122: note = hyper
  source 1..122: mol_type = genomic DNA
ggcctaccgggttttccccccaaaaggcttcgtaaccactaatgtgccctttgtggtctcaagcctgggccgcgtttcccctagacctcctctgggctgggctggctcgttctcgttgacgt

SEQ ID NO: 819 - DNA, 204 bp, Homo sapiens
  misc_feature 1..204: note = chr8:97169716-97169920
  misc_feature 1..204: note = hyper
  source 1..204: mol_type = genomic DNA
cccttgggggacccccggctccaccgagccaggccagccccactcgacggcgatttaaacatcccttaggcaaggcgccaagttagcgctgctggcccagctctaggcgggccgctgctctttcctcctcgccaggccgtccacgcgttgggggaggggaccctaggggggttggcgcggttaagagccccacgtgagaggggc

SEQ ID NO: 820 - DNA, 13 bp, Homo sapiens
  misc_feature 1..13: note = chr8:97169921-97169934
  misc_feature 1..13: note = hyper
  source 1..13: mol_type = genomic DNA
gaagtccttgcca

SEQ ID NO: 821 - DNA, 180 bp, Homo sapiens
  misc_feature 1..180: note = chr8:97170158-97170338
  misc_feature 1..180: note = hyper
  source 1..180: mol_type = genomic DNA
ggctgcagccagcaacgcaccccctcctctgcgcacccctcccgcccgtggctccgcactccttcacccccgcgcggcgtgcgacaagccgcaccgccttcccagtcaacgaactgcctttcttcgcattttctgagaacccggagacgcggaggagacagcgcctttgaagatgctgtc

SEQ ID NO: 822 - DNA, 291 bp, Homo sapiens
  misc_feature 1..291: note = chr8:97170377-97170668
  misc_feature 1..291: note = hyper
  source 1..291: mol_type = genomic DNA
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccga

SEQ ID NO: 823 - DNA, 361 bp, Homo sapiens
  misc_feature 1..361: note = chr8:97171598-97171959
  misc_feature 1..361: note = hyper
  source 1..361: mol_type = genomic DNA
cacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccag

SEQ ID NO: 824 - DNA, 722 bp, Homo sapiens
  misc_feature 1..722: note = chr8:97172018-97172740
  misc_feature 1..722: note = hyper
  source 1..722: mol_type = genomic DNA
cgcggactagttcctcagactgtgggactccctagtgccggctttgcccagggctttccaaggctgtctcatgccctagatctgccccagcagctcaggccttggactgcgaacccagtatcccgagacaccgattccatcagtccccatcccgacccctctccagccgggttcatccgcctgctgcctcccgtcctccacgtttcccccaccagccaccaacaagcggcaaccacgctgccttctgcaaaagaggaagaaggaaagaagggagagagaaagaaagggggggaaaggaagggaggtttagagactggaatagaatccgcagccacattcagaaacttactcgagcttgagaaaaacaatttaagaaaagtaaaaaggaagtgtccagagcaggaagggaattcacaaatgtagcctccagcgggaacagctccctggctgccgagctccagcgggaggggagtcgagcgttttctttgccacttacctagtcccctgtctacaaagctggtgatcgtattagccgacttggaagactggaaaaagctggcattgatgcccagcttctcagcgatggagtaagtcctgtagattgacagcatgtactcgtggggcaccacgcgcggacccctgcctggcggctcctgcgcccggggctgctgagcccggggttcgtcctgaggccgcggctgtggttcctggccctcccggcc

SEQ ID NO: 825 - DNA, 50 bp, Homo sapiens
  misc_feature 1..50: note = chr8:97172821-97172871
  misc_feature 1..50: note = hyper
  source 1..50: mol_type = genomic DNA
cgacgaggaggatgagatggaagcctgctggaaaccgggcaaatcccaca

SEQ ID NO: 826 - DNA, 388 bp, Homo sapiens
  misc_feature 1..388: note = chr8:97173138-97173526
  misc_feature 1..388: note = hyper
  source 1..388: mol_type = genomic DNA
gggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggc

SEQ ID NO: 827 - DNA, 13 bp, Homo sapiens
  misc_feature 1..13: note = chr8:97173527-97173540
  misc_feature 1..13: note = hyper
  source 1..13: mol_type = genomic DNA
gtggtaccctccc

SEQ ID NO: 828 - DNA, 50 bp, Homo sapiens
  misc_feature 1..50: note = chr8:98289818-98289868
  misc_feature 1..50: note = hyper
  source 1..50: mol_type = genomic DNA
cagtccagggggagccggcaggcggcctcctccccgagccggaggagctg

SEQ ID NO: 829 - DNA, 425 bp, Homo sapiens
  misc_feature 1..425: note = chr8:98289922-98290347
  misc_feature 1..425: note = hyper
  source 1..425: mol_type = genomic DNA
cgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccat

SEQ ID NO: 830 - DNA, 660 bp, Homo sapiens
  misc_feature 1..660: note = chr8:99439694-99440354
  misc_feature 1..660: note = hyper
  source 1..660: mol_type = genomic DNA
ggacccaggggaggccgggccgcccccctcattcccgcggcccgggtttccagactccagcgcatcccccccaccccaccaaagctacgcgccccccgtgtcggcccggccctgcccgtgcgtatctcagctccggtcccgcctgtctgcggcgagcgggcgggggcgtctcccgggcctgcccatggacaaggtcagcatgcagccccctgggcgctcagagccgcggggacgcgaccccgcacgcgcaaagcgcccaccgagacccctggggtggagctgtgctaatagaaacatacccacccccagcctttcctgggaggggatcagacccctcaaactcttgccccagcccagcccttcagcacccaagacccaccaggaggcctgggcccgccagtaatgggtagggagagggggccccgccagggcgcacggcgctctcgccgacgctgttccctccgcttccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgc

SEQ ID NO: 831 - DNA, 298 bp, Homo sapiens
  misc_feature 1..298: note = chr8:99951846-99952144
  misc_feature 1..298: note = hyper
  source 1..298: mol_type = genomic DNA
actgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactg

SEQ ID NO: 832 - DNA, 106 bp, Homo sapiens
  misc_feature 1..106: note = chr8:99952198-99952304
  misc_feature 1..106: note = hyper
  source 1..106: mol_type = genomic DNA
cgaaaagcaccatgaattcgaagcagccttggacgcgggatcatgggcgttagcctggctctctccgacgaggcaaactgcaggagatccccttccctggagtcac

SEQ ID NO: 833 - DNA, 319 bp, Homo sapiens
  misc_feature 1..319: note = chr8:99952532-99952851
  misc_feature 1..319: note = hyper
  source 1..319: mol_type = genomic DNA
gccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggag

SEQ ID NO: 834 - DNA, 178 bp, Homo sapiens
  misc_feature 1..178: note = chr8:99985866-99986044
  misc_feature 1..178: note = hyper
  source 1..178: mol_type = genomic DNA
catgaagcctctccacgtggccgacttcccttagagaagtcccacaagccctcagccctcacagcctcgcccgcgacgccgtgcccacccctcccctggcagccccgagactctgggcgtgtgcttcccgctccccgagggccttaggcccagcggacgcccggccggagcctgatgc

SEQ ID NO: 835 - DNA, 302 bp, Homo sapiens
  misc_feature 1..302: note = chr8:99986225-99986527
  misc_feature 1..302: note = hyper
  source 1..302: mol_type = genomic DNA
gggagttgcttctccagtcggtgaacgctccgttgagccacgtctatgcgcttgctcatggataagcgcactgggggactatactgcagtgtgaccgccagtgtccccagggaggctgcggaaaagtagaggcaatgagacccgagcagaaatagggacttctcgcggcagtccgcacggaagcagctggggagcatccagctcgaccctccccacaggcccagggtcgggacaccgagggaaggcgcggcgcgcgcggcaaggccaggggcgcggggctgggctcggccggcacaagtgct

SEQ ID NO: 836 - DNA, 165 bp, Homo sapiens
  misc_feature 1..165: note = chr8:99986791-99986956
  misc_feature 1..165: note = hyper
  source 1..165: mol_type = genomic DNA
cgagcaacccaggggccctgcgggaggaggagagggtcccgggagtccgcccttccctgcgccttcgggaccggcaggaggcgctgcgcgggcgaattaaaagaaaaggaaaagctcgtagtggaggtgttaccgcatcctgcctttggacgctactcttagttg

SEQ ID NO: 837 - DNA, 408 bp, Homo sapiens
  misc_feature 1..408: note = chr8:114444784-114445192
  misc_feature 1..408: note = hyper
  source 1..408: mol_type = genomic DNA
ttgcagcacttgagccgggggctgccctcctgctggcctttccgtcgtcgttgaacggatctgggggacggggacgttgcagaggagccacaatccccactcgttgtttccccaatgtgctttccgaactccccgagtgcgtcttagataagttatttgagtgaggacagcgctgcggtccgcctggagaaagggagcttcctccgcacttctacttcatcgtgacagcagtggtcgcagcgccactggccatctggagtcctgggaacattaaagcgctgttacccgccaggcgtttccgcctaggacacactcacacccaccctcggagactcctaaaggtttctccgtgtcaattcatgtgtcctcctcccagcagcacacacgcacacacgcacatcaacagcc

SEQ ID NO: 838 - DNA, 777 bp, Homo sapiens
  misc_feature 1..777: note = chr8:132053807-132054584
  misc_feature 1..777: note = hyper
  source 1..777: mol_type = genomic DNA
gagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaa

SEQ ID NO: 839 - DNA, 164 bp, Homo sapiens
  misc_feature 1..164: note = chr8:132054593-132054757
  misc_feature 1..164: note = hyper
  source 1..164: mol_type = genomic DNA
cgcagtcccgcagccggatgcaggtggaggagcggtggtggtcaccacctcctccaccaagactgcggctgcagccagtggagcccgggcccagagcacagtcagctgatggccaatgacgtcaggccctgggcgcgttcgcggctccccgtggcgtcccatga

SEQ ID NO: 840 - DNA, 293 bp, Homo sapiens
  misc_feature 1..293: note = chr8:140714570-140714863
  misc_feature 1..293: note = hyper
  source 1..293: mol_type = genomic DNA
taaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgac

SEQ ID NO: 841 - DNA, 84 bp, Homo sapiens
  misc_feature 1..84: note = chr9:117876-117960
  misc_feature 1..84: note = hyper
  source 1..84: mol_type = genomic DNA
ctctgaggggtcgctcgggccgccgccgccctcgatgtgctctcggggaagcgcaaccccgccccaccgggccacctgcagccc

SEQ ID NO: 842 - DNA, 30 bp, Homo sapiens
  misc_feature 1..30: note = chr9:970195-970225
  misc_feature 1..30: note = hyper
  source 1..30: mol_type = genomic DNA
gacctgcgctggccacgcagggtctcaagc

SEQ ID NO: 843 - DNA, 414 bp, Homo sapiens
  misc_feature 1..414: note = chr9:972345-972759
  misc_feature 1..414: note = hyper
  source 1..414: mol_type = genomic DNA
cagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccaggg

SEQ ID NO: 844 - DNA, 274 bp, Homo sapiens
  misc_feature 1..274: note = chr9:1052044-1052318
  misc_feature 1..274: note = hyper
  source 1..274: mol_type = genomic DNA
gcgcgactgccagtgcgccaactgcctgctggtggtggagcggcagcgcgtcatggccgcccaggtggcgctccggaggcagcaggccaccgaggtgcgtacccgcccggcccgggcgtctcaggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 845 - DNA, 268 bp, Homo sapiens
  misc_feature 1..268: note = chr9:6645065-6645333
  misc_feature 1..268: note = hyper
  source 1..268: mol_type = genomic DNA
agaagtaagaaggcacgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaa

SEQ ID NO: 846 - DNA, 153 bp, Homo sapiens
  misc_feature 1..153: note = chr9:19789107-19789260
  misc_feature 1..153: note = hyper
  source 1..153: mol_type = genomic DNA
gctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagag

SEQ ID NO: 847 - DNA, 93 bp, Homo sapiens
  misc_feature 1..93: note = chr9:29214993-29215086
  misc_feature 1..93: note = hyper
  source 1..93: mol_type = genomic DNA
tcacagctctgaaatcgatccagagcattccacagtgagcgttgcggctcccaggggctccggaccggtaacttcaggcgcaagtctgaattt

SEQ ID NO: 848 - DNA, 874 bp, Homo sapiens
  misc_feature 1..874: note = chr9:37029893-37030767
  misc_feature 1..874: note = hyper
  source 1..874: mol_type = genomic DNA
gtagaagaaaggctgcgggctggaaacctttctcaaaagcgcctctccagagccgctctcgggatggtgggggaggggcgatgctgccaaatcgaagaactcggctggaatatgcccgcacacgcaggttttccttcggatacccgtgaggcttgcatagaatccccggggcacggcccgagcaggagtagcgccgattctccctttcacacagtaggtgttcggcttcgggacagtgttctgctgcgtggcacacacaggacccgtcttacctgtgcacccagagcagccccttcccgcaactctcggcgttcttgggggaaggagtttccctctggataggggtgattcatcaccgcccgagcgggcggcctctgggaagttccaaccccaaaaggcgcgaccggacctcataccgtgaccacctagcccagccttacaggtcaccaaacgacagcccagagaggttacgtgactagctcgaggctgcacagcaagtccatggtggagccgggctactgcgcctcagtcctgtctctgaacgcccacgagccgcagcctgggtccaggagagcgagactagcagctctcaccgcggctctcaacgcagtcgggcctcactctgatctacagtgatgcgctttctttctcccagtaacagggctttgggccgggccctgtgctaggcgctgggggcaggagaccgcgaaaggaaactatccaggaagaaactcaatttatgtgaaccgaattgcctttgaaagttttagtactgaaagacagcccattgagaataatgtgtgagaagccagagacctcgtttcactggggacacaccccctcccggcttccctttccacgcctcccagcgcac

SEQ ID NO: 849 - DNA, 812 bp, Homo sapiens
  misc_feature 1..812: note = chr9:37037453-37038265
  misc_feature 1..812: note = hyper
  source 1..812: mol_type = genomic DNA
gggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggctgggccatcgccgtccgccactgggcctccctctgtgcgagccctgggagaagcctcagggaacgactctggcactggggctcggccccggagctagcgcagagcgtgggtgggagtcgacatccaggcaggaggcaaagaagaggccccgccctaaagccgagggcccagttcttcgaaagcctgtggccggagctggactcacaggattcggggtccgtacagcgcgcacgtggtaccgcatcttcggcaggcggcgcccctaatgcccagccccgccctgcttcgtttgccgggcctgaactgtgtcagcattgagggtggacgccgagtcgcggcgagttggtcccttgcggtataaacttggggcttccctaggggcggtgccgggatggatgggggcgcctctccacctgcaactcccccagcgcagagcgcaaaaagtgcacatcgcgggccagccgtcgcctcggggtttcaggcggcgcccggggcaaaaaggagctgaggattggtttgggtcaaaacacccatttcagttggcagtggggtcctctgcgcctacagggcttcgagctccgggtgcgggctcac

SEQ ID NO: 850 - DNA, 522 bp, Homo sapiens
  misc_feature 1..522: note = chr9:79626876-79627398
  misc_feature 1..522: note = hyper
  source 1..522: mol_type = genomic DNA
catttctagaagtgccgctaccccaggaaactcacatctctccacctccatcgctgtgcggagaaaacccgcaccgaaggcggcttcctctctaaggcggcgaccaggggagacagcgccccctgctgactaaaatcacgcaggcctcgttgccaaagtgcagcgggcgcagcgggcgcagcggtctcccggcttccctcccggcgcccgcagcctgcctaaagcctttctggaaactcgtgttttcagcctcagcctggcagactgcggagggcgggccaggaagagtcaaggagccgggggtctcagactttgctcaccccttggaaatcaccttctcgacccgctagcctaggccgagacacagtctgtattctgaaagccgccagtcccaccaggggaggagaaacccaaaacagaaggagcagggccccacggctgggctcgtgacgaagcatttaatgacctttttaaggaaacgagggaggaggtgaggaggccaacagccgcttaggagagccc

SEQ ID NO: 851 - DNA, 199 bp, Homo sapiens
  misc_feature 1..199: note = chr9:79629207-79629406
  misc_feature 1..199: note = hyper
  source 1..199: mol_type = genomic DNA
cggctcagacaacccagccagtctcgcccgcgagcggaggtgctagaaactttgggggacgaaagctgggctgtctttcttggccggtggcactgcgagagaaagccgtgtgcaccccgcggctgaccactccaacgccagatacatccacccgctcatgtaccgccgtcgggcttcattttgtcgagctcttcttagg

SEQ ID NO: 852 - DNA, 131 bp, Homo sapiens
  misc_feature 1..131: note = chr9:79635834-79635965
  misc_feature 1..131: note = hyper
  source 1..131: mol_type = genomic DNA
gcggctccttgcactcggtgctagtgcactcctaggggacccggcgggcgtggggagaccagcggggtgagagacgccgggcccggaaccgcccaaaccacccgacggggagagggcgccctggtcaggcc

SEQ ID NO: 853 - DNA, 295 bp, Homo sapiens
  misc_feature 1..295: note = chr9:79636258-79636553
  misc_feature 1..295: note = hyper
  source 1..295: mol_type = genomic DNA
cagagctaaacctcccgcgaagaatccaacagagagtgacgctgaaacggatctcagccaccacgtttctctctgctggtcgcatcctcggcggtcgcctctcgtgaacattcaagacaaaactgccgtccactaaggaaatttcgttttatttaagaaggaaaagaggaagcgtttgataccgttattttcctagtcagctaaatgggcaaggaaacggtgtcatgaataaagtcgctttggagggggaaggggaggagaggaggcagcgggaaccccacgaaatatctttggg

SEQ ID NO: 854 - DNA, 230 bp, Homo sapiens
  misc_feature 1..230: note = chr9:79637659-79637889
  misc_feature 1..230: note = hyper
  source 1..230: mol_type = genomic DNA
tttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgc

SEQ ID NO: 855 - DNA, 46 bp, Homo sapiens
  misc_feature 1..46: note = chr9:79638136-79638182
  misc_feature 1..46: note = hyper
  source 1..46: mol_type = genomic DNA
gctggggcctgggaagccgcgtcccggcctccgccctccacccttt

SEQ ID NO: 856 - skipped

SEQ ID NO: 857 - DNA, 366 bp, Homo sapiens
  misc_feature 1..366: note = chr9:96721102-96721468
  misc_feature 1..366: note = hyper
  source 1..366: mol_type = genomic DNA
gggacagggaggggaccacctcattcccacaaccgaatcccctaagcattcaggtgtaggttccagaaccacctcccctccacccacacccttctcctactccagcgcctcccagacgggattgtgaaatggctccgcgtgcgaacgggtccaggagccgttcgttgtacagaggaggaagctaagtctggaaggagcactcgagcaggctcagcggccagcagccagcggcagggggatcgtgcatcgcttggagggcgctgggctctcctccatccgcctcagccgtgggcagtttgtttccgctcccacttgcagcgggtctgcatcttaattggcaaaacgaagttggggccgcggtggagc

SEQ ID NO: 858 - DNA, 114 bp, Homo sapiens
  misc_feature 1..114: note = chr9:96721688-96721802
  misc_feature 1..114: note = hyper
  source 1..114: mol_type = genomic DNA
gggaatggagctcgtttcctcttttcttttttcttcttcttcttttttttttttaaacctttggttctgattgtccttggcccagcaggctgttggtggcgttggtggtgctgc

SEQ ID NO: 859 - DNA, 212 bp, Homo sapiens
  misc_feature 1..212: note = chr9:98111349-98111561
  misc_feature 1..212: note = hyper
  source 1..212: mol_type = genomic DNA
ctaccaggacacatgcgtaacggcctgtttgcgctccctgcggttacagccgacacacgctcgcagacgcacgcacggacaccccgctttccaccagcgcacgaagacgggacgcgcgctcacagccccagggctcggccctgcaccacgagctaacgcgcggtccccagggaggtggcgcagaaggcatggcgcctctgcccacggcgtcc

SEQ ID NO: 860 - DNA, 264 bp, Homo sapiens
  misc_feature 1..264: note = chr9:98111894-98112158
  misc_feature 1..264: note = hyper
  source 1..264: mol_type = genomic DNA
cgctgggcgcagtggctcccggtcagggcgcagtcggcctgggcgctagagcccctctcagctcccggcctagggcggggaagcgccagctcccgcagcccctgtgaaaggtcccctgtgcctcctgcctaggtgcgcgctgtggcatctctggccagaagcacctttggcggcctgttgggcccctcgcagcctctggctgagactctgccgccggcgctaacgggctgcgcccgcgctcccgctctgtccccgcccgggtcc

SEQ ID NO: 861 - DNA, 52 bp, Homo sapiens
  misc_feature 1..52: note = chr9:98112343-98112395
  misc_feature 1..52: note = hyper
  source 1..52: mol_type = genomic DNA
cgcgccccggctcccagcgccctgtttttggaaaatacgattttgtagggtg

SEQ ID NO: 862 - DNA, 432 bp, Homo sapiens
  misc_feature 1..432: note = chr9:99639601-99640033
  misc_feature 1..432: note = hyper
  source 1..432: mol_type = genomic DNA
aacacccccagatgccgctgcgcagggacaggggacgcgcccagacgtagaggccctgacctctgaatcttggcggggcacccaggagcccggcttcggggtgcttagcggggcgaagccgcccccggacccgcgtggctccagcctcctgggggtacctggcagagggggctgcagcgagcgccctgccgcgccgcttcctccgcgcgtctcccgcctggctccgccaagactgggggcttccccataggcccgcgtccgagcgcgtcctcaggcttcgctccgcgagatctgggggccccgtgggctggggttcgggcggggtccgttccttgcggtccgcggtcttgaagcaatttcccggcaaagtcccgggacagcgggaaagaaactggtctccctgcctggggtcgttcccggtggatgtgcctc

SEQ ID NO: 863 - DNA, 92 bp, Homo sapiens
  misc_feature 1..92: note = chr9:100610725-100610817
  misc_feature 1..92: note = hyper
  source 1..92: mol_type = genomic DNA
atcctggactctagacgttgcctgggggccgatcctgcgcccagggtcccagaatctaactgaaatgcgcctgcgggccgccaccttcgccc

SEQ ID NO: 864 - DNA, 516 bp, Homo sapiens
  misc_feature 1..516: note = chr9:100611124-100611640
  misc_feature 1..516: note = hyper
  source 1..516: mol_type = genomic DNA
gggcccgcgcagactgggttgggagagggctctgtgggagggcttgcggggagcggggtaagaaaggctaggtgcttcttacctacgtaagaaacgttggtggcgggatctaagcaaacggggaggtgggaagcagaaggttccccttcctgggccccagttcctccatcctgtcccctgggtgacagtgattcgctgttcatagtgtttaagtggaccaacttaaagggagagagcgcttgccgagctctgggaaaccgaaagggtccacgcccgcgggagcctcggagactcaaaatcccccgctagaccgcagaaaatgttacactttaatcaaccgctacttcttccgtggagaggggcggtgggtgggggtgtgcgcatctcatcgcggcctgtgagtggaacaggctagaattatccccagcgtcttttttccatgtccaagtttcgccttaaaacaatttaaaagaggaagaagaggaccgcgcgtctgtaaggcgctccactttatca

SEQ ID NO: 865 - DNA, 108 bp, Homo sapiens
  misc_feature 1..108: note = chr9:127212898-127213006
  misc_feature 1..108: note = hyper
  source 1..108: mol_type = genomic DNA
ttcgcatctccctctcgggcctcaacgagtgtttggagagcaagaaaagtgggcgccagggggcttgagggcgcgaatccaggcagacgtgaacgagggagtgctttt

SEQ ID NO: 866 - DNA, 742 bp, Homo sapiens
  misc_feature 1..742: note = chr9:133541665-133542407
  misc_feature 1..742: note = hyper
  source 1..742: mol_type = genomic DNA
attcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccgaccctccttcccc

SEQ ID NO: 867 - DNA, 275 bp, Homo sapiens
  misc_feature 1..275: note = chr9:135462647-135462922
  misc_feature 1..275: note = hyper
  source 1..275: mol_type = genomic DNA
cgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacct

SEQ ID NO: 868 - DNA, 545 bp, Homo sapiens
  misc_feature 1..545: note = chr9:140772756-140773301
  misc_feature 1..545: note = hyper
  source 1..545: mol_type = genomic DNA
cgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcgg

SEQ ID NO: 869 - DNA, 121 bp, Homo sapiens
  misc_feature 1..121: note = chr10:7450069-7450190
  misc_feature 1..121: note = hyper
  source 1..121: mol_type = genomic DNA
gcttgtcagcggcgacgtcaggaggacaaggggaggggttcgcggctgaaactgcagcttcgcagcacagagccattttaggctgctccccacctcgcggggcccatgggaaagccggccc

SEQ ID NO: 870 - DNA, 1772 bp, Homo sapiens
  misc_feature 1..1772: note = chr10:7450490-7452262
  misc_feature 1..1772: note = hyper
  source 1..1772: mol_type = genomic DNA
cgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacga

SEQ ID NO: 871 - DNA, 376 bp, Homo sapiens
  misc_feature 1..376: note = chr10:8085599-8085975
  misc_feature 1..376: note = hyper
  source 1..376: mol_type = genomic DNA
ttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtgg

SEQ ID NO: 872 - DNA, 858 bp, Homo sapiens
  misc_feature 1..858: note = chr10:15760996-15761854
  misc_feature 1..858: note = hyper
  source 1..858: mol_type = genomic DNA
cgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 873 - DNA, 111 bp, Homo sapiens
  misc_feature 1..111: note = chr10:15761855-15761966
  misc_feature 1..111: note = hyper
  source 1..111: mol_type = genomic DNA
gtccccagctgcccgtgtcccgggtcggtgcgctcggcgcacccgtggtgacagtgcccggcgtctgctcccacccgcccgcccgcccagccggctcggggggctggccca

SEQ ID NO: 874 - DNA, 615 bp, Homo sapiens
  misc_feature 1..615: note = chr10:22541236-22541851
  misc_feature 1..615: note = hyper
  source 1..615: mol_type = genomic DNA
ctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcct

SEQ ID NO: 875 - DNA, 226 bp, Homo sapiens
  misc_feature 1..226: note = chr10:22542024-22542250
  misc_feature 1..226: note = hyper
  source 1..226: mol_type = genomic DNA
gaatccccacctcggtcctcgggtagaggcgcaagcgcgccccaagaccattctcttcgcgcccacccccgttattcttcactttcacttgacatcgttcttcactcaaggttaggtcctcgctagtgccagagaagcccctgggtccccagtgccctcagccccgcagcgtagggagcagccggcccgggagataaggaggccacagccatggaggccccaggcc

SEQ ID NO: 876 - DNA, 560 bp, Homo sapiens
  misc_feature 1..560: note = chr10:22624561-22625121
  misc_feature 1..560: note = hyper
  source 1..560: mol_type = genomic DNA
cggcgctccgggtggacggctccggggcgcggctcgtccctcgggtggtgcagcccccgcggcccgagacccggggagggccgggggtactttctgcgaggcgccttccccgcggcttctgcccgcgccaaagcctggtggaatccagcgcagacctaaagcacgcttgacaccccgatttttcgagactaggacgactctctgagccagcagctttcctctccctctcggggagaatctcatttccttggggtggtgagggtgacgggcactgtcttttggccccgcgtgtccgttccccggtctcccgcctcacccctctgcgaggtgaggaggggaaacggcgagcttaggcctggcgggaaggagcctacccgacgagagggctccgcggggagggtcggttggaatcccgccctagcgcctcctgctctgcccggtccccaccggggacggggaatgccagtcatttctgttgagtgctagcagggccggtgtcaccacctcgggtggccgaggcttcgaggttttcatgaaaagcccccgaagcgtgaggcgcc

SEQ ID NO: 877 - DNA, 401 bp, Homo sapiens
  misc_feature 1..401: note = chr10:22625382-22625783
  misc_feature 1..401: note = hyper
  source 1..401: mol_type = genomic DNA
cgtctttgccgcacagctgcagtcaaggcccggagggactgcgggacgcgggcgggagcgagagccctgtgggctgccaagccggcgcggccgcgccgcggcagccgcttcccttgccaccttcgttccaggggctgcggggctgcgcgctcggcagaggctcggttgccagtagcaaccacacgacggcgatttgcagccagggccgccgccgcagccgctggtacctctgcctcctcctacacctcgggctcgagcatttgaaaccctgggggttgccttcggtgacatctcccgcccccacctccagtcctcagtctccaaaatcctcagctctgctcaaaagccagcgcccccggctgggccctgcccccaccgcagacaataggagcggctgggag

SEQ ID NO: 878 - DNA, 292 bp, Homo sapiens
  misc_feature 1..292: note = chr10:22625811-22626103
  misc_feature 1..292: note = hyper
  source 1..292: mol_type = genomic DNA
cgggcacctgagcccccaaatccgggcgcgtcgctgagtctcagccccaggtgccctcttcgcggagttgatcagcaattctttttcagtggccaattagaaagcttttcttgacatcagaaataagggtggtgccaaagaaagaagtcaaacgcccactccctttctaataacatcgacacaaagaagagctcatggttgcgtctgcgcttggtaacagtggctttcctctgggttagagccacaggcacaagcacccgctgctatctttcttcttcgcctaccatgaata

SEQ ID NO: 879 - DNA, 190 bp, Homo sapiens
  misc_feature 1..190: note = chr10:22633985-22634175
  misc_feature 1..190: note = hyper
  source 1..190: mol_type = genomic DNA
cattcatgtgttgatcggattgtacaatgtgacgtgtgagatttctcgggaccgtcgaagctcagacaactccagggctgcaatttactcgtctggctgccctcgaaccaggctcccttggcgcgtggggctctcccggcgcttggtcccgacccgcgccgcagtcaggataccacggcaatctggggtc

SEQ ID NO: 880 - DNA, 108 bp, Homo sapiens
  misc_feature 1..108: note = chr10:22634324-22634432
  misc_feature 1..108: note = hyper
  source 1..108: mol_type = genomic DNA
gcccaggcaccgcggccgtgacgtcacgcccgggactggccgttgcagcaagacggccgcgttccggttccggtaggttgcccgggagacgcgggtacacagagaagc

SEQ ID NO: 881 - skipped

SEQ ID NO: 882 - DNA, 215 bp, Homo sapiens
  misc_feature 1..215: note = chr10:22634440-22634655
  misc_feature 1..215: note = hyper
  source 1..215: mol_type = genomic DNA
tcggaggccgagtcgtcgccacgatcgcccccttggtggactcgcaggccgagcggcttccccgcagagctcgaggagggcagacggcggcgggggcgccatgagtcagaggcaggtgctgcaaggtagggccgaggcgggcaggtgccctaactagctggcgccgaggagacccgggtgcggtgggctccaccgactctctctcccgcagtgtt

SEQ ID NO: 883 - DNA, 897 bp, Homo sapiens
  misc_feature 1..897: note = chr10:22764693-22765590
  misc_feature 1..897: note = hyper
  source 1..897: mol_type = genomic DNA
ctcctcatttatgggcgtcggcgctaagcagctctggaaacgggcagacccagctgtgcagcgatgtccagtgtcgccgcatctgccccgcggggtgcagcatgagtcttcctttgtggcgtgcggctccatcggaacgcgcgttgcgacgacaaattccttttttcccccccgcagttaacagttctggggcagaggctggtggagaggtccagagcccactcagaccgagatgaagatgaggaaaagcatgagcaggaagaggctggcggctgcggcggccacagggaagagctcggtgcgcggcgcagcctcccgcgaccgcgactcctgggctgcgtcgaggagccgcgttgccataggaaccgtagcggcgccccagtgaaaccctgcgttcggacaggagaagctaaccgcggccgcccactcccacccgcgcttcctccccgcccccaccggccgtgcgcgaaaagcagagatccgagaaccgcgtgcggtacaaacggcaaaagcttcgcgcgcattttccgggagttgagcgcgcggccgcaggccgggaacctaccgctctcaggctcccagcccgggcgctacgaccctgtgggcgccgcctgtgcagcccctccttccagcccgctcgggcgcatcccccaggccgggccagcgacgcgggcaccgggagcccctcccgccggtccgggctttggcccacacccggggaccgcggagtgggaaaggaaccaaagcgcggcgcctggccgaccgcggacgaaattcgaggccggagggcgttttcttttttgcaaaattgccccaaagccagggccgcatgtacctactgtctcctttgccccacatgctccaagaaaataagacacattctaccccgagtcctaa

SEQ ID NO: 884 - DNA, 734 bp, Homo sapiens
  misc_feature 1..734: note = chr10:23483777-23484511
  misc_feature 1..734: note = hyper
  source 1..734: mol_type = genomic DNA
aaggtaggaagaagccgcccgctacccctgccaccttcgcaacaggcttacttccaaaactgagttcgttttgccttcatcagaacttggccctcctcggccagcaacctggggagaaggcgagcctgaggcggggggcgtagggtagccccctagcgaaggggagaagagcgagggcgcggccgaggtcgcttagccagaaagcctgggagtccaggcttgggtttgtctcctttgtggccaagagcgcctcccgggctctcggggcgtcctcccctgcccgccagagccggggcgccggcactgggccctgaggcctggcgcgcgcgcagatggcgttggcgcgagcgcggactggagacgcgctcattgacgtggcaccgtagccccgtgcggcgcaggcctggcccaggcggggtgtggttccgtgggccgcagcggcctggtgggcgaaggtacaattgcggatagcctctaatactcacggccctgccgcaggacaatatgttggcagcatgctaattgctttaacctagtttcagacccaccgaggggttccccgcgcgccgcgggtgccatggacctcgtccaagagcaattaaagcgaggccgcgagcccgaccccgcagcgcggcctggccagacacgcggagattctgggtcgcaaggctcccgggagccccttggccgtggaccctctcaccccttttaagccttcgcgccctctccctcca

SEQ ID NO: 885 - DNA, 1097 bp, Homo sapiens
  misc_feature 1..1097: note = chr10:23488393-23489490
  misc_feature 1..1097: note = hyper
  source 1..1097: mol_type = genomic DNA
ggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggc

SEQ ID NO: 886 - DNA, 886 bp, Homo sapiens
  misc_feature 1..886: note = chr10:23982394-23983280
  misc_feature 1..886: note = hyper
  source 1..886: mol_type = genomic DNA
aaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaag

SEQ ID NO: 887 - DNA, 279 bp, Homo sapiens
  misc_feature 1..279: note = chr10:26500592-26500871
  misc_feature 1..279: note = hyper
  source 1..279: mol_type = genomic DNA
cctgttgagaattatcgcagatacgtttggccattatccagtcgtttcgattgtgcctttcctaaatgtccgcggttggcagaacgtgggaggaagaggacccgcctaactcggggtaggtggggacgcgctgctcactgtggtgaggttgacacttgggccctgggtttcacttgcaggtgctgggcggcggagagccccgagaaggaggaggagagagagccagcagccaacccctacgacttcaggaggctcctgcgcaaaacctcccagcgccgg

SEQ ID NO: 888 - DNA, 246 bp, Homo sapiens
  misc_feature 1..246: note = chr10:26506373-26506619
  misc_feature 1..246: note = hyper
  source 1..246: mol_type = genomic DNA
gccttctgcacctgccggcctcaccgagtcctgagcggcccccaggaggaaggcggcccctcctaggaccccggactgattgattttcacatagaacgaaatttcacacgtccgtctgttgttctctttctgcctcgctgtctgcctgcctattcttccttgcagcgcgagcctggtgccaagtggctcagaagttcacgggcggcatcggaaacaaactgtgcggtgagtgcccagggaccgggg

SEQ ID NO: 889 - DNA, 518 bp, Homo sapiens
  misc_feature 1..518: note = chr10:26506902-26507420
  misc_feature 1..518: note = hyper
  source 1..518: mol_type = genomic DNA
cgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcc

SEQ ID NO: 890 - DNA, 200 bp, Homo sapiens
  misc_feature 1..200: note = chr10:26727617-26727817
  misc_feature 1..200: note = hyper
  source 1..200: mol_type = genomic DNA
agcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgaggtaagtggcgctcccagtcccgggagccctgggag

SEQ ID NO: 891 - DNA, 183 bp, Homo sapiens
  misc_feature 1..183: note = chr10:26727867-26728050
  misc_feature 1..183: note = hyper
  source 1..183: mol_type = genomic DNA
cgggtccgacgccgggggcagctccaggatctggcctcgtgaacgcgtgcccccaggcgtggccctcgagcgcagcgggtccccagggtcccctccgctgatctccactctggacccggctcgcgagggtgggggtgtgagggtttggggttcgggtttgctttttcccgagctattgcaaca

SEQ ID NO: 892 - DNA, 92 bp, Homo sapiens
  misc_feature 1..92: note = chr10:43429066-43429158
  misc_feature 1..92: note = hyper
  source 1..92: mol_type = genomic DNA
cgccggccttcccaggccccgggagccaggaaggtctgaatggagtgatgcgcctggacttttgttcggaaatcccgcgtggagggcggcct

SEQ ID NO: 893 - DNA, 1458 bp, Homo sapiens
  misc_feature 1..1458: note = chr10:50605213-50606671
  misc_feature 1..1458: note = hyper
  source 1..1458: mol_type = genomic DNA
ccttgatcttaaagacgcagcgctttggaaacaaaaggcctggcaggcccgccgctggacaccagcgctgggcaaggagcatcgagctgcaggacagagcgctgggtcccggccgccgttgacgcccctccgaaaacagccgggaggaagaccagtcccgctccggtcgaggcaagtcaggatctattccagtgaagcggcccttcctgggctcagtcgctccagagcagagtctgctctgcctcggggaaagaatcacaggaaacttccgctcgtttcagagcggagagagctcggggcgccatttccgccagggccaccgactccgagagtccaggcagccggcccgggaggagcggctagcaggtcccgaaggcgggtgaggtggcaggcaggggccggcagggcagccgagggcctttcctacgtcatgccaagagggctgggagcccctagagctgatcctcccttagcccaggtcaagagactggctcgcgcgcgctgtctctctccctgtctccctcagagggcccctgctctctggagctcttgacaagagcccgaggctcctcttgccgcctaggtctgccgaaagtcccctcgggttccctcctgccctaggcagcagttccctgcctgtgcgctttgggaacccggtggccgtgaagtgaggtgcggacagcttctgggccgcctcggccaagatgctcaggcgcacctgggggtgtgtgcgggaaccctcagcggcagcagcccagcccggggtgcagtgttggccccagaaaccaatgaggtccaaacgccagtctcagttccccatccctgacatcgaccgaggcaagttcctattaaggcccagagatgaccccgggacgagacaggctcatccggcgcggatgagacaggctcagacctgcgcggtctgaggacggcgcgctcgccgagcaacccggcaggtcagaaccctggacagcggcgccggtttccgcacccccacccacccccggctgctgcggagaaagaagccgtaccgggggcccagccggggcccctcgctgctcaggggtgggatccgcccggccggaccccaggcgtccggggaccgaccccaatcctctcccagtccaaacctgcgaaagttactccggacatgcgctcagcgctggcaacagagacaaaactcccttctccgcagtaccacgcgccgctcctacccggccgctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcacca

SEQ ID NO: 894 - DNA, 462 bp, Homo sapiens
  misc_feature 1..462: note = chr10:71331980-71332442
  misc_feature 1..462: note = hyper
  source 1..462: mol_type = genomic DNA
atgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggt

SEQ ID NO: 895 - DNA, 15 bp, Homo sapiens
  misc_feature 1..15: note = chr10:72200050-72200065
  misc_feature 1..15: note = hyper
  source 1..15: mol_type = genomic DNA
gccccctcccatccc

SEQ ID NO: 896 - DNA, 655 bp, Homo sapiens
  misc_feature 1..655: note = chr10:72200117-72200772
  misc_feature 1..655: note = hyper
  source 1..655: mol_type = genomic DNA
cgcccccgagggtgtcccctggtctggctggtccccagatgacccttccggagagggtcaccggctgtctgaccccaggcgcgggagcgaagggcccccggcaccaggtcacaaggggcgggcaggcggcaggtcggatcagattagcgtttgtggattgcgccccggccccagggagggccgtctggcccccgcaggcggagggaggcgtgggcggccgcggctgcccaggcggcagaatgtggattgaggcgcggaaggggctccctctccgcagcacccacctgctcgccgcgctgggtgcccagaacgcgctgccaggtcctcgagggcgataccctcagatccctgccgtccttgacacccactcccctgcaaatcatggccccgaacccggggttaagcgagacacttgacacttccccggcgcggctggaggacccaaggctgccacagttcgcgacttcgggacagcccatccctgatctccgggccgtgagcccgaatccccgatgttaccagctcagctgccgatactcccgacgtcacaccccgggacccattcaccctcactcgcagaaagaaaaaaaaatcgccaagaccaaaccattacagtaataccaacgaccgttgactgtggctgtgccgggtactg

SEQ ID NO: 897 - DNA, 557 bp, Homo sapiens
  misc_feature 1..557: note = chr10:72200824-72201381
  misc_feature 1..557: note = hyper
  source 1..557: mol_type = genomic DNA
cgaggtgttatttattacacctatcctacagatgcgcagacccaggctccgggataagcaacttcacaagactggagattagaagctcccacccttccgcgctgcgctccgcgcaatcccaaaccaaaacccagagacaatggtccccgtcgaggacacaccctgaacgctagaatcccttcccgactcggccgtggatacgcccccagccaccaacgctgcaccccgagcctgctgacgcggagacacccgcagagctaggccctgggctcgggacgcccgggcggctgcaaacccggctcggagccgcagcccccaacccacagcacttcccgagtccgctggctggacgcggcggaggcgccccgggggtgcccagcagggcgcggcacgcggcactgcctaccttctgcctgtaggctgcggatgatgtctgccctcggcagcgggtcgcggtagaggctcagcatgtacgccagaggggatggcgacgagggctgcccccgcgtacgcaggagcgcagtggccaccgtcgcagcacccgcctggagtagggc

SEQ ID NO: 898 - DNA, 159 bp, Homo sapiens
  misc_feature 1..159: note = chr10:94828735-94828894
  misc_feature 1..159: note = hyper
  source 1..159: mol_type = genomic DNA
atagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaa

SEQ ID NO: 899 - DNA, 937 bp, Homo sapiens
  misc_feature 1..937: note = chr10:94834033-94834970
  misc_feature 1..937: note = hyper
  source 1..937: mol_type = genomic DNA
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccaggttagctttcccagctcggagagtgccatgtgtctggcaggactgggggtgtctggaaggggacggcggtagacgagaggggcggatggaggcttttaacgctgtcccctcctcgggactcaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccgggtaagggcggcaaacgggctgcggactaggggcgcgggacctgggcgtctgctcaccgccgcgcgctctctgcgctcagggcatgaaggcgcggaacctcattcacgcgcgcatcgagcagaacattcgcgccaagatctgcgg

SEQ ID NO: 900 - DNA, 119 bp, Homo sapiens
  misc_feature 1..119: note = chr10:99789175-99789294
  misc_feature 1..119: note = hyper
  source 1..119: mol_type = genomic DNA
gtcctgtcaggagaacggaagcatctcctgggatgtgcagaagccacactgggtgcacccaccagcagcagcagcggcggcggcggcggcggcggcggcggcggcggcggcagcagcag

SEQ ID NO: 901 - DNA, 32 bp, Homo sapiens
  misc_feature 1..32: note = chr10:99790308-99790340
  misc_feature 1..32: note = hyper
  source 1..32: mol_type = genomic DNA
gcttgctcccagccccggtcccgggctggcct

SEQ ID NO: 902 - DNA, 323 bp, Homo sapiens
  misc_feature 1..323: note = chr10:99790437-99790760
  misc_feature 1..323: note = hyper
  source 1..323: mol_type = genomic DNA
cgcggcagctggagccgggggcccggggtggggggcgccggcgcggccaatcgcggccccgagagcccggagagccgggcgtggggagggagcgcctccccgcgctgatttaggagccgggattgcggtggcagcagccggcagccaggctggcccggcgcggcgcggcggccactggggtgggcggcggcgaaggcggcggcgagggcgggcgccccccgcgccccgccactgcgtcgcgtaaccttcaggcggcagcgaggcctggcgaggaggggagagggcgcctggctgggcgctgggggccccaggccggagggaag

SEQ ID NO: 903 - DNA, 260 bp, Homo sapiens
  misc_feature 1..260: note = chr10:99790917-99791177
  misc_feature 1..260: note = hyper
  source 1..260: mol_type = genomic DNA
cgtcgccgggccgggccaaagcggccgagcgagccgcgctgatggcgagatttcgactacggagctagagccgagccgatctttatccagcctggggacgtgtccgagcacctcccggggactgctcagtatggagagcagggctccgcgacggcccccgcaggcggggagcgggcgagcgcagctcggagatcaggcgcgcagaggcccaggcggctgcgggcagcgccgcttctaccccaccccgtccccaccagcag

SEQ ID NO: 904 - DNA, 74 bp, Homo sapiens
  misc_feature 1..74: note = chr10:100992117-100992191
  misc_feature 1..74: note = hyper
  source 1..74: mol_type = genomic DNA
tttgagatagtaatccgggcccgggcccccgcggcttttcgccgggttcctcaggttctggaactgcaggaagt

SEQ ID NO: 905 - skipped

SEQ ID NO: 906 - DNA, 451 bp, Homo sapiens
  misc_feature 1..451: note = chr10:100993487-100993938
  misc_feature 1..451: note = hyper
  source 1..451: mol_type = genomic DNA
tgtaaccagaatggtcgtttggcagaagtctccgggaccgcactccaggacaggcacagtcagggcgtcgcgtgggcctactgtggcaaaggagacgtccgcgcgaatccggtcctggggaaagggcagttccaacaacctttcatccagaagcctgcacagccaatgcgaatgcgccccgccaggacttcttccccgaaaatctgccttccagactcttttctgaggcaggaaagcattaggcgaacaggcagattttttaaaaaaagaaagaaagctggtgggggaaagggggtctgcgcagctgaaggagttcaatgaaagtgggacaagcgttgcggaaaactccgttgcaccctacattcggacgagctcatagacgcgctctgctgcacgaaagagctttcgaagaggaagctgggccgcgcggagctggctgttccgccctcgc

SEQ ID NO: 907 - DNA, 456 bp, Homo sapiens
  misc_feature 1..456: note = chr10:100993939-100994395
  misc_feature 1..456: note = hyper
  source 1..456: mol_type = genomic DNA
gcaaccgcaccaacaggaaccgaaacggcctcggcaagggcagctacagcctctcagtcctccggctacctttcctccacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgag

SEQ ID NO: 908 - DNA, 427 bp, Homo sapiens
  misc_feature 1..427: note = chr10:100995797-100996224
  misc_feature 1..427: note = hyper
  source 1..427: mol_type = genomic DNA
ttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggtacagagcaaagggtctcgtttttacgtccttccctgagaggctctggagggcggttcaagctccgactccgacccgaaagccccagcgccaacccgggacgcgctgggatagagttcccaccgacagcacgcttgtttctcctgacagcgtcaggcacttcgtccgctcagggcccttt

SEQ ID NO: 909 - DNA, 327 bp, Homo sapiens
  misc_feature 1..327: note = chr10:101290372-101290699
  misc_feature 1..327: note = hyper
  source 1..327: mol_type = genomic DNA
tgaaaggcctaggagcgaagcgagatgggaagcaagggaatgtaacaaggagaaatgcaggcttcggttggaaactggggagagagagattgtttcgatagcctttctccttttctttttccagaatcatgaaatcaccgaggagaagaaaactggggactagaagagagcagaaacatttcccctgagacagttttgccccggaggtggggtggggaagtggcgctggagctcagcttcctgcttttatgctcggcggccaccgtgatgcacacacactcgaggtccgccaccccgcagtgccgtgcacccctctgcccccacctc

SEQ ID NO: 910 - DNA, 443 bp, Homo sapiens
  misc_feature 1..443: note = chr10:101290700-101291143
  misc_feature 1..443: note = hyper
  source 1..443: mol_type = genomic DNA
gaatttttgtgcccgagcgctcgggatccacggcaaaaccaggcacattcctccctctgcagactcaccgcctggtttgtagacactggtctccgcctggggcgtcaatagtttcaggatttaaagcagaaagacaccgggcgcccctgtggctgaggaatggcggttccagcacaagaccctgcccacagagggtctctccctactgcctgcgggccgccgctaccctaagtactccggggcgcacgtggcccgcgcggcatcccagctccccgggcggacccaggggctgcctctccacaacagttccgctcccttctgcagagccccgcctctcccacctcccgacaggctgttctttctcccttcaaccttgggcacccactcctgtcgccgttgcgggacccgcgtggcagccctccaccctcgtacccactcccagc

SEQ ID NO: 911 - DNA, 403 bp, Homo sapiens
  misc_feature 1..403: note = chr10:101292461-101292864
  misc_feature 1..403: note = hyper
  source 1..403: mol_type = genomic DNA
caatggttcaggaaccggatctgtgcagcctcgcccgcagcgtctcggacttcaggactctatactagtccttgtctatttctggtagagccgcaacatcccactcgcagagagcagggggcgtggcccacatgagccagaacctatagggagggaggttggggcgccagccccgcccccccaacgtgacgcaaatctcccggacagaggcttaggagcccgggccccagtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattattt

SEQ ID NO: 912 - DNA, 241 bp, Homo sapiens
  misc_feature 1..241: note = chr10:102497525-102497766
  misc_feature 1..241: note = hyper
  source 1..241: mol_type = genomic DNA
cttttggacctcatccggctagtttaaaatgacaatgacagaggcgcgtgaccgaacgtgcctgccggacgtcctggcgcaactgccgcagccgggtttgcgaaggatgcgggttttacttagtctcgctgagcctgttccggagcagcgaaaaccatcaggaaagggcgagagaaggaggaaggggattgaatcagcaactagggcaattgtggtcttcagctatcgctgcctatacccc

SEQ ID NO: 913 - DNA, 69 bp, Homo sapiens
  misc_feature 1..69: note = chr10:102507467-102507536
  misc_feature 1..69: note = hyper
  source 1..69: mol_type = genomic DNA
taagtaatttccaagcgcaggaaagccgcgccgagggcatcaggcctccgcgggtctcggcgagcgggc

SEQ ID NO: 914 - DNA, 1165 bp, Homo sapiens
  misc_feature 1..1165: note = chr10:102589250-102590415
  misc_feature 1..1165: note = hyper
  source 1..1165: mol_type = genomic DNA
gccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcctcccaactacactcccgctgccacctccaactcctttgccgagacccccttggcggcagctgaaccacggcgaaggccgagactagcctgccctttagtagccaccctcccccacgcaccccggccctggggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccgaagtctgcaatgaaacgcgaagaccgcagacgcttgccgcaagtttcctcgctctgcgtttacttctgggcccgaagaatgccccgcagaggccctaggagctggttcatgggacttcacgcgcctccagtgtcttgcggagccccagccccagcaagcagcggctgaaattggtgcgccttgtgctgtggtctgggtgtgtcccggagagggcgcgcaggcgcctatgtctgtcgcggggcggtcggcgggttcctgcatag

SEQ ID NO: 915 - DNA, 369 bp, Homo sapiens
  misc_feature 1..369: note = chr10:102893583-102893952
  misc_feature 1..369: note = hyper
  source 1..369: mol_type = genomic DNA
ctgaggggaggggagcgtgaccattagctcgccttagactgcccctggaggagaggcggcagggaggtggttgggctcgcgggagcccggggccagggaggcctccgtggtagcggcgacggcggcgtcggactggcgggcaggaggaggccgtttcccgccgtgggcttgtcgctgagggctaacgggaggatctcggccctgctcgtgggggttcagctgctgcgctcgctgactcgcggggtgttgggcctgggacgcttcctgacgctctgctgcttgcctctgccgtctgtctgtctcccgctccagtggccctctcacccttcactgtaacacgccgtataggtcacccctatcagaaccgga

SEQ ID NO: 916 - DNA, 1155 bp, Homo sapiens
  misc_feature 1..1155: note = chr10:102894090-102895245
  misc_feature 1..1155: note = hyper
  source 1..1155: mol_type = genomic DNA
cgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagc

SEQ ID NO: 917 - DNA, 683 bp, Homo sapiens
  misc_feature 1..683: note = chr10:102899173-102899856
  misc_feature 1..683: note = hyper
  source 1..683: mol_type = genomic DNA
tttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcctcccaattccccaagaccgcctctagaggctgctgtgtccggagaactccgagcattttctggacacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacagggctcacactcactaaccgcggagagcacatgcaggccggagccctcagcc

SEQ ID NO: 918 - DNA, 372 bp, Homo sapiens
  misc_feature 1..372: note = chr10:102900262-102900634
  misc_feature 1..372: note = hyper
  source 1..372: mol_type = genomic DNA
ggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacac

SEQ ID NO: 919 - DNA, 135 bp, Homo sapiens
  misc_feature 1..135: note = chr10:102983245-102983380
  misc_feature 1..135: note = hyper
  source 1..135: mol_type = genomic DNA
tggatcccagatcctcgcctccgcctacagccaagcccctcagcttttgcccagagctgctgacttcctcgccgcctccctgcgcaatgggacctagagataagccccaagcccgggtgctagtccaggcagagt

SEQ ID NO: 920 - DNA, 315 bp, Homo sapiens
  misc_feature 1..315: note = chr10:102983434-102983749
  misc_feature 1..315: note = hyper
  source 1..315: mol_type = genomic DNA
cggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggt

SEQ ID NO: 921 - DNA, 455 bp, Homo sapiens
  misc_feature 1..455: note = chr10:102996026-102996481
  misc_feature 1..455: note = hyper
  source 1..455: mol_type = genomic DNA
actactgtcggggggcgccgggcgcaggccgggcatggggcctgagcttaggccaggtggaaaggtggaaggacctagtggggacagacgaagagaccgaggagccgcccgcccggctaaatggacacaggaaaggcctgagtcaggcttctcataataaataaactgcacgtgaataattcagcagtcgcgcgggggccggttgcatcagcgccgccgccgccgcgcggcgcccaattccccgcggaggggagtagccaattaaggcacttgaaaagggagtcgggtggaagatcccccgcccaccagtatcctggatttacccaggtcgagttcagagagcctccccggtcccaaccccctcgggccccatgggtcagggggccgcctgctgggaagtgctacctcagctaagccgctcaggtgtcccgagactccgggcaagggaagacagg

SEQ ID NO: 922 - DNA, 123 bp, Homo sapiens
  misc_feature 1..123: note = chr10:102996596-102996719
  misc_feature 1..123: note = hyper
  source 1..123: mol_type = genomic DNA
cgccaggctcggatctgtgctcagagccgggatccctccgggctgcttcgtcctggccaggactttccttgccctgaagtgaggcgccagggaagctgcagggccctccgccctctctgaact

SEQ ID NO: 923 - DNA, 503 bp, Homo sapiens
  misc_feature 1..503: note = chr10:102998356-102998859
  misc_feature 1..503: note = hyper
  source 1..503: mol_type = genomic DNA
ggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtgaagcatttaataaaacgctgtttccacacagccagggatattagtgtgagctatccttaagttaatgctcctggactgagggcgccgctgccacagcgcctgctgccggcgggtcgcgggaagcgtaggccctggccgccgcgctccccgcgcgggtccaacgccctgggtgcccttctcgcctgcgccttgaagcccccacgcccatcctagcgcgtctctctgtgacctctcggccgccagcctgggaggaggggtttggaagagccgaattcaagcaccc

SEQ ID NO: 924 - DNA, 304 bp, Homo sapiens
  misc_feature 1..304: note = chr10:103043924-103044228
  misc_feature 1..304: note = hyper
  source 1..304: mol_type = genomic DNA
cggatggagctgttaatgtaagtggagtttctgcaatggtaattaggagggccctcattaccctggcggagccggctgagagccgataaagccgagggggagaagggccgacatcagggtaatgggggagcagggccattgaggagctggagccgagccggggaccgctccgcgcgcagctggagcccggcgagagggccgcggaaggggggtgcgaaccggggccggaccccggggaggagccgggaggcgagcggcgaggggcactgcgcggctgggtctgccccggggtttcgcactgcgc

SEQ ID NO: 925 - DNA, 99 bp, Homo sapiens
  misc_feature 1..99: note = chr10:103044300-103044399
  misc_feature 1..99: note = hyper
  source 1..99: mol_type = genomic DNA
cgtgcctgcctcgcctccagcccggggtaaggagatccacggaggcctctgcgcctaaactcaggtggccagacagagttggggcgggaggcgggtata

SEQ ID NO: 926 - DNA, 79 bp, Homo sapiens
  misc_feature 1..79: note = chr10:115804976-115805055
  misc_feature 1..79: note = hyper
  source 1..79: mol_type = genomic DNA
caactggctgggctacgccaactcggccttcaaccccatcatctactgccgcagccccgacttccgcaaggccttccag

SEQ ID NO: 927 - DNA, 95 bp, Homo sapiens
  misc_feature 1..95: note = chr10:118033068-118033163
  misc_feature 1..95: note = hyper
  source 1..95: mol_type = genomic DNA
gcttgcggtgggacccgcggccggacccgtactcgcgcacaggacacgcagtgttctgcagccggccgcgggtgctgccagacacacacactctc

SEQ ID NO: 928 - DNA, 454 bp, Homo sapiens
  misc_feature 1..454: note = chr10:118033223-118033677
  misc_feature 1..454: note = hyper
  source 1..454: mol_type = genomic DNA
acacacacacacatacacgggcacaagggctctttcttcttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcacccc

SEQ ID NO: 929 - DNA, 145 bp, Homo sapiens
  misc_feature 1..145: note = chr10:118891517-118891662
  misc_feature 1..145: note = hyper
  source 1..145: mol_type = genomic DNA
ataaactaagaattacgcagtgggaaattaaggaggagggtctgaggggccgacctcagagggacagatagagaaatcgagagcgaaacactcaaggaagtggaacaaatcgtcgtagccaggcgtctctgcctctccggaaacc

SEQ ID NO: 930 - DNA, 59 bp, Homo sapiens
  misc_feature 1..59: note = chr10:118891715-118891774
  misc_feature 1..59: note = hyper
  source 1..59: mol_type = genomic DNA
cgcactataggggctgccaccctctgcccccggagtccccacgccgagactcatcattt

SEQ ID NO: 931 - DNA, 444 bp, Homo sapiens
  misc_feature 1..444: note = chr10:118892013-118892457
  misc_feature 1..444: note = hyper
  source 1..444: mol_type = genomic DNA
gagggggagagtttccgacgtaaataatttacaataaaattactattttaaaaaagtgtttttcgcttgcttcagatggatgaatacattctagacactgcggcacctcgcagtctgggtctgtgattttggttaaaatgtgggtggccgtggctgtagggacgatcgccgctgcgcagggtaaggaaagagggtgtcgcggttcgtgttctgatttgggaccactgaaaccctaagactggggaggcgaggggagtgtctttcctatcaatcacacaagacgctatctggactccgagactactgctagaggaggcccgaccacccagcggcgtccctgcctccccttccgcaaagaactgctcagaaatccagacgtttcctgcgtgcaggaagggttttgtgaatccgggtgtttgggagaggaggcaatgagtgctgact

SEQ ID NO: 932 - DNA, 44 bp, Homo sapiens
  misc_feature 1..44: note = chr10:118892517-118892561
  misc_feature 1..44: note = hyper
  source 1..44: mol_type = genomic DNA
cgccggctgcgcaggctaccgccggcagccgctttgctctttcc

SEQ ID NO: 933 - DNA, 283 bp, Homo sapiens
  misc_feature 1..283: note = chr10:118892955-118893238
  misc_feature 1..283: note = hyper
  source 1..283: mol_type = genomic DNA
agctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatc

SEQ ID NO: 934 - DNA, 72 bp, Homo sapiens
  misc_feature 1..72: note = chr10:118893679-118893751
  misc_feature 1..72: note = hyper
  source 1..72: mol_type = genomic DNA
cgagcagcgagggcaccggcaggctgaagaggctgtggcccgcggccggggcgcctgcgtgcaatccccccg

SEQ ID NO: 935 - DNA, 353 bp, Homo sapiens
  misc_feature 1..353: note = chr10:118899892-118900245
  misc_feature 1..353: note = hyper
  source 1..353: mol_type = genomic DNA
gccgggtcttgactcccactaccgcgtcgcgggtgcgggtccctgggattcgggtcctcctgatgggggtccctgcagcagatggggcattcacttccctgcagagctcggcccgagggagctcctgggcctccttgggcagggaggggtgcgaccgaattccctggcacaccggcccttccttgccccctaccctggaggggttggaggggtcggaccctcggactacgcgagatcgggtgcgcaggaggattctaggccttcctcagccctttaggagccctgcaggcggcggaagtcccaaaccgcagccttggcccaaatgggacccagatggctctgggtccccggcc

SEQ ID NO: 936 - DNA, 113 bp, Homo sapiens
  misc_feature 1..113: note = chr10:118900323-118900436
  misc_feature 1..113: note = hyper
  source 1..113: mol_type = genomic DNA
cgcccggtcaaagacctggaagaaagctttttaaaaaataaaaatggcccaacccattacattttcttttaggtagatgggggagctggggggcggggcgggggcagtcaggg

SEQ ID NO: 937 - DNA, 537 bp, Homo sapiens
  misc_feature 1..537: note = chr10:118927026-118927563
  misc_feature 1..537: note = hyper
  source 1..537: mol_type = genomic DNA
ttcggtttccattcacgctaccctctctgagccgcaattctctctcctgcgttggcactggcagaagttgagacacgctcccaggaatcgcgggccgtggcgcgtacttccacgcaccccagctagttccagagactcagcttgttctgagatcctcttgtcgagcccccttggtcccggcgcccggcctgtgtggtgctcagatcagacttatccacccgagcaccacgcagaccagcgcctggaccaaggtcccgggaaggaagccctcctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggc

SEQ ID NO: 938 - DNA, 176 bp, Homo sapiens
  misc_feature 1..176: note = chr10:122708495-122708671
  misc_feature 1..176: note = hyper
  source 1..176: mol_type = genomic DNA
atgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcg

SEQ ID NO: 939 - DNA, 38 bp, Homo sapiens
  misc_feature 1..38: note = chr10:123922645-123922683
  misc_feature 1..38: note = hyper
  source 1..38: mol_type = genomic DNA
gctgcctccaggacccggggcctgaaggaggcagaagc

SEQ ID NO: 940 - DNA, 535 bp, Homo sapiens
  misc_feature 1..535: note = chr10:124895161-124895696
  misc_feature 1..535: note = hyper
  source 1..535: mol_type = genomic DNA
ccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggc

SEQ ID NO: 941 - DNA, 624 bp, Homo sapiens
  misc_feature 1..624: note = chr10:124895832-124896456
  misc_feature 1..624: note = hyper
  source 1..624: mol_type = genomic DNA
cgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggc

SEQ ID NO: 942 - DNA, 113 bp, Homo sapiens
  misc_feature 1..113: note = chr10:124901934-124902047
  misc_feature 1..113: note = hyper
  source 1..113: mol_type = genomic DNA
ccctcaacaggctcccggcaccgcagagccagaggccacgcggtgagaaccccagtgcgtgcgctcttcttgtgtgagaggccggaggtagagttgggagaaagaggagccgg

SEQ ID NO: 943 - DNA, 431 bp, Homo sapiens
  misc_feature 1..431: note = chr10:124902138-124902569
  misc_feature 1..431: note = hyper
  source 1..431: mol_type = genomic DNA
cgggagggcggtgctgccggctgcttcctgcaagcggtttgaagaggcatcgcgttgtccggccgcctgcgcaagggccacgcgctgctgctttcacccccttgcgcccgcggggcacctggactccccttaagagtccccgtggggcctgagcttctgctgggcgctacgctgccctccacgattccattttgccccatttactcgggtcgtccacttcccgcggctcagtgacccagccagggggcgtcttccgctagcggtccaaatgtagactccgcaaagaggctaagaagacctgtctacccgggtgcgcgcgatggggtcagggtgtaagaaccaggagcctcatagaaacctctgcttggggtccaaagcccagccgggcactcccagaggacaacatccgcccccgcatgtacacgtggccc

SEQ ID NO: 944 - DNA, 214 bp, Homo sapiens
  misc_feature 1..214: note = chr10:124902607-124902821
  misc_feature 1..214: note = hyper
  source 1..214: mol_type = genomic DNA
cgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttg

SEQ ID NO: 945 - DNA, 267 bp, Homo sapiens
  misc_feature 1..267: note = chr10:124903040-124903307
  misc_feature 1..267: note = hyper
  source 1..267: mol_type = genomic DNA
agggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgagg

SEQ ID NO: 946 - DNA, 146 bp, Homo sapiens
  misc_feature 1..146: note = chr10:130085053-130085199
  misc_feature 1..146: note = hyper
  source 1..146: mol_type = genomic DNA
agggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtc

SEQ ID NO: 947 - DNA, 76 bp, Homo sapiens
  misc_feature 1..76: note = chr10:130085200-130085276
  misc_feature 1..76: note = hyper
  source 1..76: mol_type = genomic DNA
gaggagcccccgcccgccggcggccagcgcacagcccggccaggggcgccctccctgccgccgccggccctttgat

SEQ ID NO: 948 - DNA, 54 bp, Homo sapiens
  misc_feature 1..54: note = chr10:130085355-130085409
  misc_feature 1..54: note = hyper
  source 1..54: mol_type = genomic DNA
cgcacgggtccccgggccgcggcgcgctccccgccacgccgcacatcaaggccc

SEQ ID NO: 949 - DNA, 84 bp, Homo sapiens
  misc_feature 1..84: note = chr11:17741806-17741890
  misc_feature 1..84: note = hyper
  source 1..84: mol_type = genomic DNA
ctgcaggctctgctgcgcgaccaggacgccgcgccccctggcgccgcagccgccttctatgcgccgggcccgctgcccccgggc

SEQ ID NO: 950 - DNA, 135 bp, Homo sapiens
  misc_feature 1..135: note = chr11:17741952-17742087
  misc_feature 1..135: note = hyper
  source 1..135: mol_type = genomic DNA
cggcatggtaaggccgggaccccaggaagtgaggaagttagggcggcgctcgggatatcagggacgcgtttccgagggcggggagctggccttgcgggaggtttgggccaggatccttcccgagagagaggaccc

SEQ ID NO: 951 - DNA, 344 bp, Homo sapiens
  misc_feature 1..344: note = chr11:20229223-20229567
  misc_feature 1..344: note = hyper
  source 1..344: mol_type = genomic DNA
gcctcccaaagtgctaggattacaggcgtgagccccggggccctgccagaaaggaggctttttaccaacaaattttaaaaagaaacaacaaaccaaagaattttgccatggacagtggcaaagtatctgctgtgctgtttctgaccctccataaaaatcatgttcagaaatggtaaaaaggctaacgaagatcaaacaagaagagacagaatcacgggcgaagggggcgcattcagggttttctggacgtcaggaagggaccgcggtggggtgctttagaagtggccggagcccgcacctgcatgcagctcgcgcagaaagcgcctggacgctcccttaggacc

SEQ ID NO: 952 - DNA, 30 bp, Homo sapiens
  misc_feature 1..30: note = chr11:20618363-20618393
  misc_feature 1..30: note = hyper
  source 1..30: mol_type = genomic DNA
tgttttttaatactgcggttccatcctctg

SEQ ID NO: 953 - DNA, 503 bp, Homo sapiens
  misc_feature 1..503: note = chr11:20618422-20618925
  misc_feature 1..503: note = hyper
  source 1..503: mol_type = genomic DNA
cgcacgacctgctgccccagggcctggcttcctgcctccgcatgctctctcccgcccctgaagcccaaccttcaagccctgctgatgcccgcccctccgtcccagcgttggcctcatagcgaaccctcttaggcctctccgttccagaccctccctccattctccacgtagcccctcccttctagaatcttgcggctgaaagtgggggcaggcggggagcccgaatagcgcctcagccaaaccccgcagccgttcctgcgcgtcacccgcctctgcagagcctgacgcgcggcagtctccacgccggaacccaagtgctcactgggccggggagggccagcgggcgaaatatcaggcctgggggctgagcgggggcgctgggcgtcactcaggcccagggccgcagctgggggaagtgagaaggccggcaggattctgcccactctgcgcagttctcccttcctcccggggcagccaagtctgtgcgccctggaacgtccggg

SEQ ID NO: 954 - DNA, 101 bp, Homo sapiens
  misc_feature 1..101: note = chr11:20623258-20623359
  misc_feature 1..101: note = hyper
  source 1..101: mol_type = genomic DNA
cgcgagagaggccagccgggccgtggcgggtgcacgtatgctgatggggaaaccggttggcagtgccaggtgatggatgcgggaggcggctttggggcttc

SEQ ID NO: 955 - DNA, 26 bp, Homo sapiens
  misc_feature 1..26: note = chr11:20691060-20691086
  misc_feature 1..26: note = hyper
  source 1..26: mol_type = genomic DNA
gccagcggtggggggcgggctggggg

SEQ ID NO: 956 - DNA, 40 bp, Homo sapiens
  misc_feature 1..40: note = chr11:20691121-20691161
  misc_feature 1..40: note = hyper
  source 1..40: mol_type = genomic DNA
cgagcgcagcacccggcgctgccgagccacctcccccgcc

SEQ ID NO: 957 - DNA, 218 bp, Homo sapiens
  misc_feature 1..218: note = chr11:20691162-20691380
  misc_feature 1..218: note = hyper
  source 1..218: mol_type = genomic DNA
cccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagacca

SEQ ID NO: 958 - DNA, 185 bp, Homo sapiens
  misc_feature 1..185: note = chr11:20691431-20691616
  misc_feature 1..185: note = hyper
  source 1..185: mol_type = genomic DNA
cggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttc

SEQ ID NO: 959 - DNA, 90 bp, Homo sapiens
  misc_feature 1..90: note = chr11:20691747-20691837
  misc_feature 1..90: note = hyper
  source 1..90: mol_type = genomic DNA
cgcagagggagcgcttccggctggcgggcgcggccggggcccgggagggcgcggtgcggcgagggcagagagctgcgggagaaccctggg

SEQ ID NO: 960 - DNA, 197 bp, Homo sapiens
  misc_feature 1..197: note = chr11:27743436-27743633
  misc_feature 1..197: note = hyper
  source 1..197: mol_type = genomic DNA
ctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggg

SEQ ID NO: 961 - DNA, 1042 bp, Homo sapiens
  misc_feature 1..1042: note = chr11:31819319-31820361
  misc_feature 1..1042: note = hyper
  source 1..1042: mol_type = genomic DNA
actcccccacccccacgataaacctaagtggtggacaattaagatatcttcttcaaaaggcgccccctcggagccgcgcaaagcaggggccttcagtgggtgccgttcaccttccagcctaatccgtgagaaagcgagtgaaagcgcctcccattatcccagccccaggaccatctgacgatgggaataggatttgtttcctggaaggaggtgagagagagagagagagagagagacagagagagagttgctgggaaataaaatcattccttagtttcttagtgtcttaatcagtgaggcggaaaacaagcaagaaaagatagcaacccggttgcggcaccttttcagctctggagcgcggatcaaaacattgtagcatctgttgaaagagaggctgactaaatcctatagagggcttgggtattatggggggtgggggtggggtgaggggaggagataagaaaaagtgtctccgtgatccctaaaaccaccaaatcgccggagaattggggctggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaaagtctgaggattccccgggaacgtgaagcgaagctcaccaccggtgcccgctacccccacgccggcaactctgtgcttcgtttggcccacgtgtcctccccacgcaactaggggcgacggtcctgtgcctgaggtgacaatcaccccccaaaaacctcacttgcgggtgggggggtggtgattgccagttgacccagaattttctagcaactaggcgcgttaaagtgaaaagcccctggactagctccacctccggccccaaccatcacaggcggaccctagctgatttgactctcacttcccgccctcagactgc

SEQ ID NO: 962 - DNA, 565 bp, Homo sapiens
  misc_feature 1..565: note = chr11:31820460-31821025
  misc_feature 1..565: note = hyper
  source 1..565: mol_type = genomic DNA
cgccccaagctcatgggagcccacgcaccggggagagcccggagtggaggctctgggctcagccctcccaggcctaggccaccgtgccctgagtccctccccaagacttctcggactaagtgggccagactcttgtcaggggagggatcaccaggacctcagattgctgggggcggaggggtggacgctcgtgagtgcgaagttcgggtgtcacttgggtgtgtccagtgtctacaagtgggaatcctacggtttcaaaagtcaggcagggatggggttgcctacactcggtggggtcaatcgctagtctcaccagaggcgggagcgggcctgggggccctctgagctcgcggaggcggcgggttcggggcccgtgcgggcggggtcgcccaggggagcccgggccccgcgcgtcaggaggcctccgccggccgagcggccgcgctgggaaacaagaagcgagcgctttgctccctatcttcccagtgtccgtcctatattgttttctgctcttaaaactgacatgtctaattggcaattggtgccgaatcgtgtccagaggtct

SEQ ID NO: 963 - DNA, 29 bp, Homo sapiens
  misc_feature 1..29: note = chr11:31826042-31826071
  misc_feature 1..29: note = hyper
  source 1..29: mol_type = genomic DNA
acaggcgtttgggggatctgggctccggc

SEQ ID NO: 964 - DNA, 198 bp, Homo sapiens
  misc_feature 1..198: note = chr11:31826106-31826304
  misc_feature 1..198: note = hyper
  source 1..198: mol_type = genomic DNA
cgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagcca

SEQ ID NO: 965 - DNA, 325 bp, Homo sapiens
  misc_feature 1..325: note = chr11:31826408-31826733
  misc_feature 1..325: note = hyper
  source 1..325: mol_type = genomic DNA
cgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggc

SEQ ID NO: 966 - DNA, 117 bp, Homo sapiens
  misc_feature 1..117: note = chr11:31827113-31827230
  misc_feature 1..117: note = hyper
  source 1..117: mol_type = genomic DNA
gggcctggtttcgctgggcctccaggctcccaggtcggagctctagactagccctgccgcgtaccagcacccaccacgaacaggaaggtgggtgggaccccacggggtctgggcaga

SEQ ID NO: 967 - DNA, 457 bp, Homo sapiens
  misc_feature 1..457: note = chr11:31827597-31828054
  misc_feature 1..457: note = hyper
  source 1..457: mol_type = genomic DNA
cgccctgatcagcccagcccctctctccggggtcagagcccgggcaggggcgagagggggtgtgagttacaggatttgggggggatggggtttctctaccgcagcttcgaaaactcgggcgggctgttcttaagggcccagcccctgcttctccagtatcgagaagagccaagcaaacgccctcccctcccgggctgccgggcgcggagcggggagcagccgccgcaggtccccgggcctcagtcggtcggcggccgggccagcgcgggcgtcgcgagtccctgtgtcctcccctgaccctcgggtccgcgcaccccgagcccgaagtcccagaaagaccagaggcacttactgttctgcatgctggctctggctgggggccgcgggattccacggggctcgaatatggggctctgttagcaagaaaataggagttaatcctcgggcagctgcatca

SEQ ID NO: 968 - DNA, 438 bp, Homo sapiens
  misc_feature 1..438: note = chr11:31836032-31836470
  misc_feature 1..438: note = hyper
  source 1..438: mol_type = genomic DNA
aactctctctttccccggtcaagcagaggcgcagcgccggcgcgctggaaagggtgaagactggcattttttggagaaggaaagtcttggcagacacctgcgtcactttgtagtgccccaaacgtctctctttttgcagaccctgggaaggtgggatcccttgtccgcggagctggcaaacgggtccagtgagccctaaaggcaaaggctcccatcccggccgcccagtccctggtgcctcccccacttccaggcctttgtccctctcctttctccagcaacctgccggttcccgctaacccggcagcctcgccgagcccagagcctagaaaagccaagaagatcccagagccgccccgtggcaccttcaggctgtggccactgctcggcttggggggaagccgcggtgccctcgcccttcctcgcctcctgccaaat

SEQ ID NO: 969 - DNA, 159 bp, Homo sapiens
  misc_feature 1..159: note = chr11:31837354-31837513
  misc_feature 1..159: note = hyper
  source 1..159: mol_type = genomic DNA
aattcggcgcttttcgtcacttcctaacccagtctcacagagggtgacttccaaacctggctagcggggaaaaccgctgcccgggggacagaggggctgacaggaactgcgggttggctcagccgaatgcggccggggagaatttaagaattctcagcc

SEQ ID NO: 970 - DNA, 735 bp, Homo sapiens
  misc_feature 1..735: note = chr11:31837541-31838276
  misc_feature 1..735: note = hyper
  source 1..735: mol_type = genomic DNA
cgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggag

SEQ ID NO: 971 - DNA, 315 bp, Homo sapiens
  misc_feature 1..315: note = chr11:31841774-31842089
  misc_feature 1..315: note = hyper
  source 1..315: mol_type = genomic DNA
ctctggagaccctaccagaaatctagtgctgggggctcctctccgcgcctgccaccagccttggaggaagctgggcagggccccgtgtggtgcccagcctacgaggtcccacctcgcctctccctggcagaggcatcctctctaggccacactggctcgcattgcgggaagaagggcaccgcgggcggcccgggggcatcatcgacgactcgtagagccccaaatgccgagtgctacctgaggcaggctgtagctggggtgaaaaggaccggaagcgggaaagaaacctcttttctttcaggcctcccttcagcc

SEQ ID NO: 972 - DNA, 110 bp, Homo sapiens
  misc_feature 1..110: note = chr11:32455906-32456016
  misc_feature 1..110: note = hyper
  source 1..110: mol_type = genomic DNA
cagagccagacactgcgccggtctcctggttccactcccgtggggactagcagtcccggaatctctcggactctaaggggccccagacgccctcccggctcttgcgaaca

SEQ ID NO: 973 - DNA, 454 bp, Homo sapiens
  misc_feature 1..454: note = chr11:43602393-43602847
  misc_feature 1..454: note = hyper
  source 1..454: mol_type = genomic DNA
ctgattggtgggtgacgattttagtccgcaccaatgagctggcggcctcgtctgtatttatttagtgctctgggggagtttttctctttacgcagcgcctgtagtcacggctggaaccttggctgggggactctgagggataagaggggattcggggggaatccgaactgtacctgttcagagatccgcgaccttgcagccggggctggcggaactctgatagggagatagagggataggacaggcaggcggggaggctccgggtgctggggcgacaggaaaggggtggaggctgggctccgggatccgggtgcccctctgcggtccccttctcgccctccacacacttctctcggggctgagttgggggatcgcggacggtctggagaaatggagacacgagtccaggggcgcggaggggcgggcagcgcgcggagtggtgagactgagccgc

SEQ ID NO: 974 - DNA, 189 bp, Homo sapiens
  misc_feature 1..189: note = chr11:43602848-43603037
  misc_feature 1..189: note = hyper
  source 1..189: mol_type = genomic DNA
atggaacgcgctggggagacccagcctgttcggctccagggttcggagacatcctgggctgaaggcggcggcgaaccgaagaagccggcatattctgcccttcgcgaatctttttgcggtctgggcttgctgtacataactcaatagccggaagcccttaccccaaaaagcatttgcggagggcgcact

SEQ ID NO: 975 - DNA, 112 bp, Homo sapiens
  misc_feature 1..112: note = chr11:43603076-43603188
  misc_feature 1..112: note = hyper
  source 1..112: mol_type = genomic DNA
cgcaccttcccgaagctgctccatccgagccttacccggccctttccccgttttccacggaagattcggccctttcccccgtcctttccgcggtgcccgaggctttggtcac

SEQ ID NO: 976 - DNA, 81 bp, Homo sapiens
  misc_feature 1..81: note = chr11:44330877-44330958
  misc_feature 1..81: note = hyper
  source 1..81: mol_type = genomic DNA
cggtttggggaaatgccgaagggaccgggaaaaacaaactccaagtcgagtttaacagccgaaacgctccgtgcctaggcc

SEQ ID NO: 977 - DNA, 481 bp, Homo sapiens
  misc_feature 1..481: note = chr11:44330959-44331440
  misc_feature 1..481: note = hyper
  source 1..481: mol_type = genomic DNA
gcggacaagaaggagacagaacagatcccttggctccctcgcagcgatcgatcccgtttaccgaccagagtcaccaccccgcccccagcccgccaactcatacctcccgcaagccaccagtttcaagggatgcggaagccaagcaccccgtggtccccagcaccaggtgacccgcacgtgcactcaccgtagcagggaacctgcaaggccgcgctgtggccgctgctgccttcctggagtttgaggctgccgtccgggggcgtcttgcaggcgcctcgctgcaagtaaagatgcggttgcgcgggcggctggggctgcggctgctgctgctgcggctgcggctgcggcggcggctggggctgcggggtcgacggctggggctggaacttgttaaaggagccccgcgccccagctccactctccaggggtgtcgccaggtcctgctgcccagcgccgtaacgggcccggctcttggcgtccc

SEQ ID NO: 978 - DNA, 229 bp, Homo sapiens
  misc_feature 1..229: note = chr11:44331482-44331711
  misc_feature 1..229: note = hyper
  source 1..229: mol_type = genomic DNA
cgaacttgtcgcctccgggaaatgccctaaaaggcgacgagccctcccgactctgcgacaccgggctgtagtaggcgtccatggcagcggccggcgactcgcagtaagagacgcaagtctcagcattcatgcctggcttgcgcaggcggcgggcggggacgcgagcgagggcgcgaggacgccaccgcgcgccttggctgggagtttggggaggcgaggaggctgtggc

SEQ ID NO: 979 - DNA, 15 bp, Homo sapiens
  misc_feature 1..15: note = chr11:46316818-46316833
  misc_feature 1..15: note = hyper
  source 1..15: mol_type = genomic DNA
gtaccattactgccc

SEQ ID NO: 980 - DNA, 461 bp, Homo sapiens
  misc_feature 1..461: note = chr11:46316895-46317356
  misc_feature 1..461: note = hyper
  source 1..461: mol_type = genomic DNA
cgagatggagctgcaaggggatttaaggcccggctcgccctttgagtcggggtcgtcggggagaccctcggtctccacttctccctgcgggggtgggggcggggccgcgctactgatgaggggtttaggacaccgtgagacggccaggccatttctgcctcggccccagacgcagaaggggtcccatgcaggcccgagccagtgcaccctgcgctccctcagccgcgggccgtcggcgcaggccgggaccctcctccgcgcgagccctgcactcctccggtgccctccacgccgccaccggctgctgctcgcagcctcccgccattggccaggagctctgcggctcccaccagtgagcaggccggattccggtgaggggcggccccgggtgttcccgggttaaccctttgtgggccgctccaggacggcggcacccggatccttctctaaaatttaaaggg

SEQ ID NO: 981 - DNA, 290 bp, Homo sapiens
  misc_feature 1..290: note = chr11:46317407-46317697
  misc_feature 1..290: note = hyper
  source 1..290: mol_type = genomic DNA
cgcaggtctgcaagcaggagagctcgggaacctctcctccaagggagggaagccggcgccggctgcgcgtgacagccgagaaggagcttatattggcacgactataggaaaaagtctttaacgaggagggaaacaaatcataatatgtccttctccggcttcccacccccgttgcctggaaaggcacccctgtaggacgctcaccccctgcagaaccctgtcgccctcagagcgttgacacatggctcccctgaagttcgtgaactcctggccgccgaccccttgctctt

SEQ ID NO: 982 - DNA, 153 bp, Homo sapiens
  misc_feature 1..153: note = chr11:60718701-60718854
  misc_feature 1..153: note = hyper
  source 1..153: mol_type = genomic DNA
ggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagca

SEQ ID NO: 983 - DNA, 145 bp, Homo sapiens
  misc_feature 1..145: note = chr11:60718976-60719121
  misc_feature 1..145: note = hyper
  source 1..145: mol_type = genomic DNA
cgctccccgggcacgcggggctgctcccgggcgcgcggcgcgggcatcctggctccgggctgggccccccgcggctcttctctcctctcctctccccgcctcagagccctgcactcctgcccccgggcctcggccctctccccca

SEQ ID NO: 984 - DNA, 762 bp, Homo sapiens
  misc_feature 1..762: note = chr11:65600895-65601657
  misc_feature 1..762: note = hyper
  source 1..762: mol_type = genomic DNA
cctcccgtccaagagcggaaacctaaacagaccccccttctccacagacattgtcccctgccctcgcccctggtccaccacccacatccccaccactgcttcccattccctgtccccaccctgccaccctcaccctcttccccttccccttccccttccccactgcctggtgggcgccaaactgggcgagtgcgcacgcgcaggccgcacgtggccgttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtgtgtgtgt

SEQ ID NO: 985 - DNA, 73 bp, Homo sapiens
  misc_feature 1..73: note = chr11:65816447-65816520
  misc_feature 1..73: note = hyper
  source 1..73: mol_type = genomic DNA
cctccaaccccatgccggccactgcagtactcacaccgcacgcctgggctctgcctctggcccgggttggggg

SEQ ID NO: 986 - skipped

SEQ ID NO: 987 - DNA, 75 bp, Homo sapiens
  misc_feature 1..75: note = chr11:66188095-66188170
  misc_feature 1..75: note = hyper
  source 1..75: mol_type = genomic DNA
aattagtgtcagtgccggcccctctctgccctctgcggactcctgccgcgggcttcaggccgccctaaacctggc

SEQ ID NO: 988 - DNA, 38 bp, Homo sapiens
  misc_feature 1..38: note = chr11:88241938-88241976
  misc_feature 1..38: note = hyper
  source 1..38: mol_type = genomic DNA
tggcggccgcagcctcgggaccggccgcggggctctcc

SEQ ID NO: 989 - DNA, 145 bp, Homo sapiens
  misc_feature 1..145: note = chr11:88242130-88242275
  misc_feature 1..145: note = hyper
  source 1..145: mol_type = genomic DNA
cgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcag

SEQ ID NO: 990 - DNA, 42 bp, Homo sapiens
  misc_feature 1..42: note = chr11:88242358-88242400
  misc_feature 1..42: note = hyper
  source 1..42: mol_type = genomic DNA
cgggcgccgggaagtgctcctcagcctcggccacatcataca

SEQ ID NO: 991 - DNA, 286 bp, Homo sapiens
  misc_feature 1..286: note = chr11:111411296-111411582
  misc_feature 1..286: note = hyper
  source 1..286: mol_type = genomic DNA
ccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaac

SEQ ID NO: 992 - DNA, 391 bp, Homo sapiens
  misc_feature 1..391: note = chr11:111411821-111412212
  misc_feature 1..391: note = hyper
  source 1..391: mol_type = genomic DNA
cgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactcca

SEQ ID NO: 993 - DNA, 38 bp, Homo sapiens
  misc_feature 1..38: note = chr11:115530058-115530096
  misc_feature 1..38: note = hyper
  source 1..38: mol_type = genomic DNA
aaagacaccagagaccgggagggtgcagctgggctctt

SEQ ID NO: 994 - DNA, 201 bp, Homo sapiens
  misc_feature 1..201: note = chr11:115530221-115530422
  misc_feature 1..201: note = hyper
  source 1..201: mol_type = genomic DNA
cgtcccttagccgtgtgggctgtagcacagagggggcaaacacctccaggggcttgtgccaagtaattaccaagcaaattcccggcgatttcctctcctccccccgcccccccgggcagtgcccgctgcgtgttccctgattcggcccccggctgtgcaatcagctccaggtaacctgcggggacccgtaattgctctgga

SEQ ID NO: 995 - DNA, 323 bp, Homo sapiens
  misc_feature 1..323: note = chr11:122849801-122850124
  misc_feature 1..323: note = hyper
  source 1..323: mol_type = genomic DNA
gcgcccggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctc

SEQ ID NO: 996 - DNA, 232 bp, Homo sapiens
  misc_feature 1..232: note = chr11:122850148-122850380
  misc_feature 1..232: note = hyper
  source 1..232: mol_type = genomic DNA
cgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatcttt

SEQ ID NO: 997 - DNA, 308 bp, Homo sapiens
  misc_feature 1..308: note = chr11:122850901-122851209
  misc_feature 1..308: note = hyper
  source 1..308: mol_type = genomic DNA
gggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctc

SEQ ID NO: 998 - DNA, 15 bp, Homo sapiens
  misc_feature 1..15: note = chr11:123228701-123228716
  misc_feature 1..15: note = hyper
  source 1..15: mol_type = genomic DNA
ctttccataccttcc

SEQ ID NO: 999 - DNA, 392 bp, Homo sapiens
  misc_feature 1..392: note = chr11:123228788-123229180
  misc_feature 1..392: note = hyper
  source 1..392: mol_type = genomic DNA
cgttggtttccgcactaaacttgatggtctgattttaaaggttgattttaaagaaactgtctggttgtatgtccccgagttacactgcagtgctaaatgttggagcgaggcaataccgggagaatccaggctgcaggcttcacccagagagggagggtgaggggaggagagagacggagagaggagagagggggaatgaaaggggagagagagggaccaagaccggcgagcgggagacaggagcggaaaccacagaggtagagtcagggccgacactgaagaaacgtagatgcacagggaggggccaatattagtgtacagagagaaagagggaacacggtgcggtgacacctagcctcggagacagtgggagctccgagcccacggagagc

SEQ ID NO: 1000 - DNA, 226 bp, Homo sapiens
  misc_feature 1..226: note = chr11:123229181-123229407
  misc_feature 1..226: note = hyper
  source 1..226: mol_type = genomic DNA
ggggagttccgcttcctcccgccccagcggctcccgccccgcctgggcgcagccggccgtcccggctccgagggtgcagcgcgcccgggcgcagcgcgagtgcgtggagccgggctccagcacgaccccgccgctcgggtttgggtgtcctcaggctccgcgctcctcctcccctcctccagatgggactggctctcctctttgcaaagccaggctcgcggggaga

SEQ ID NO: 1001 - DNA, 15 bp, Homo sapiens
  misc_feature 1..15: note = chr11:123301014-123301029
  misc_feature 1..15: note = hyper
  source 1..15: mol_type = genomic DNA
actgcctcttcctcc

SEQ ID NO: 1002 - DNA, 944 bp, Homo sapiens
  misc_feature 1..944: note = chr11:123301082-123302026
  misc_feature 1..944: note = hyper
  source 1..944: mol_type = genomic DNA
cgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccaggg

SEQ ID NO: 1003 - DNA, 181 bp, Homo sapiens
  misc_feature 1..181: note = chr11:125773880-125774061
  misc_feature 1..181: note = hyper
  source 1..181: mol_type = genomic DNA
gttctgcttcctttccgcaactgtggcattcgaggtcattcgtcatatcaaattcatcagattttgtctccactttgctaaccaattcgctaacctttctgacatcttgtgatgtggaggcggaaatttccagggaaaccgacacggggcgtaaagcgcggcggggagtccggggggctcc

SEQ ID NO: 1004 - DNA, 312 bp, Homo sapiens
  misc_feature 1..312: note = chr11:125774122-125774434
  misc_feature 1..312: note = hyper
  source 1..312: mol_type = genomic DNA
cggaagctgccccctctgccctccggtccgcgccctttcgccccgctctctgccctccgccccgctctctgccctccgccccgctctctgccccccgccccgctctctgccctccgccccttccgcgcgccacccagccttccagcgcctgcgcgccgcaccgcggtggtcgcgggcgcggacgcggacgcctgccccctaaggaagcccattggccagcggatggggccagcaccgcctcgcgccggtggtggaagcacgtgctgggggcgggagcagcaatcgcagccatggcgtcgttactgtggggag

SEQ ID NO: 1005 - DNA, 189 bp, Homo sapiens
  misc_feature 1..189: note = chr11:128564685-128564874
  misc_feature 1..189: note = hyper
  source 1..189: mol_type = genomic DNA
tgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagccccc

SEQ ID NO: 1006 - skipped

SEQ ID NO: 1007 - DNA, 308 bp, Homo sapiens
  misc_feature 1..308: note = chr11:128564991-128565299
  misc_feature 1..308: note = hyper
  source 1..308: mol_type = genomic DNA
cgcctccgttgcaggggccggctgtgagcccgcgccccgcgcccgcccggccattcccaccccagccgccgccgccaagcctgggtctaggttgcaaagtgcaacccaggcggaaaggtgagggtttgggttcgcgtctcacttcagaaaagttgactgctgtctctgaaagggttcgccaagtagggccaggagcagagaggagggacaccccctaacgtgacgggccttagaggacctaggggaatgaatgggaccaggggttagcttcgaggctgccgcgcaacaccaagcgggagtctgtctgg

SEQ ID NO: 1008 - DNA, 459 bp, Homo sapiens
  misc_feature 1..459: note = chr11:129242783-129243242
  misc_feature 1..459: note = hyper
  source 1..459: mol_type = genomic DNA
gagagaaaacagaagcgggaaattcgacagaggaggagaggcccaaagggcggggagcaatgcggggaagggagaagtgggagggaagaagaggagaggagtcagtggcggtggaaggaaggggaagaaccagagagaagaaaagaggttaaggaaaagaagagcaatgcaaagtcggggccccgaatagtgccgcattctgtgggcacacgccgggcagatagaaagtatagacgcgacgcgctcggcccctcgtcgggcgtcgggtcctggtgctgtcgctcaggtgctggtccccagctccaagcccgcctcgtagtcggcgctgcgggtgagatcgcccgcaagcactcagtttactggcggctgcctaccagcggctcactttcctcggggcgcctaaagctccccgcccggcattgccccgggagcgaacgctgagcccctgggacccagccc

SEQ ID NO: 1009 - DNA, 350 bp, Homo sapiens
  misc_feature 1..350: note = chr11:129243304-129243654
  misc_feature 1..350: note = hyper
  source 1..350: mol_type = genomic DNA
cggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaacatctattttctc

SEQ ID NO: 1010 - DNA, 347 bp, Homo sapiens
  misc_feature 1..347: note = chr11:129243954-129244301
  misc_feature 1..347: note = hyper
  source 1..347: mol_type = genomic DNA
atgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccggg

SEQ ID NO: 1011 - DNA, 204 bp, Homo sapiens
  misc_feature 1..204: note = chr11:129244440-129244644
  misc_feature 1..204: note = hyper
  source 1..204: mol_type = genomic DNA
cgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaa

SEQ ID NO: 1012 - DNA, 203 bp, Homo sapiens
  misc_feature 1..203: note = chr11:131780876-131781079
  misc_feature 1..203: note = hyper
  source 1..203: mol_type = genomic DNA
ggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgc

SEQ ID NO: 1013 - DNA, 449 bp, Homo sapiens
  misc_feature 1..449: note = chr11:132952552-132953001
  misc_feature 1..449: note = hyper
  source 1..449: mol_type = genomic DNA
gccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgacctcgtcccaggcagacgcgctgcccggagaccgccgcaagggggcgccaggggccggggcggacgtcgcgccagtgcctcgccgggaccgcacctcgtccgcgcggccgccagagggcgcccgtcagcgccggagcccgcggcggacgccccagccgagcccagccactgcctggtggagccacagggcacccgcccggaaacaccgcctgcgccccgacggcacccgtgtgc

SEQ ID NO: 1014 - DNA, 774 bp, Homo sapiens
  misc_feature 1..774: note = chr11:134145653-134146427
  misc_feature 1..774: note = hyper
  source 1..774: mol_type = genomic DNA
tcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccc

SEQ ID NO: 1015 - DNA, 232 bp, Homo sapiens
  misc_feature 1..232: note = chr11:134146444-134146676
  misc_feature 1..232: note = hyper
  source 1..232: mol_type = genomic DNA
cgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcaggtgacggatcgccgctgcc

SEQ ID NO: 1016 - DNA, 217 bp, Homo sapiens
  misc_feature 1..217: note = chr11:134146677-134146894
  misc_feature 1..217: note = hyper
  source 1..217: mol_type = genomic DNA
tcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggct

SEQ ID NO: 1017 - DNA, 335 bp, Homo sapiens
  misc_feature 1..335: note = chr12:4274054-4274389
  misc_feature 1..335: note = hyper
  source 1..335: mol_type = genomic DNA
agctcattccagccccggccaagcaaagcctggccctactcgctccacatgcatttcagtctcctctcgcctttcatgcgcggaggagccgggagggagaggatgtgacctcatctgcgcggcatctgagcccaggggtgccccagctcttccacccaggccgctccccgagcccagctccccgcgcccctctctctatccaggagagacgcattggacagccaggagggctcgacgtggaaggaaaggaagctgcaattctgggacaggggcagacgggagaggaagtgaacgtggctaaacgctcactttatgtaaaacgtcccccagactag

SEQ ID NO: 1018 - DNA, 808 bp, Homo sapiens
  misc_feature 1..808: note = chr12:5017990-5018798
  misc_feature 1..808: note = hyper
  source 1..808: mol_type = genomic DNA
gtaggcgggaggcaacggtggtgagaagggtggtcccaaggccgcgggaggagccaatcagcggcgactctgggctcttgcagcctccttagagactccgcagccctggaggtaccaagctgcctgctgccttttctcgcgctgcaggcgcggagatgcagcgcctctgggggcgcagctccagccgcactcgcagggcaaggcacacgcccccggctcctgctgccatgcgcctctgcgggggaccctttccaaataaattgcaagctttgaaagtggccctgtggaggcactaggctggggaaaaaggctgcgggaggagggacatagggtgggaggtgagtaggcgacttgcttctcagattattcccaattagcaccaagttggcagacaaccccacaaacccacgaagccttcggtcccccacaagtcacattccctgtatttcagaataatcggatcgtaagaaaacttcaagtcccatcgtaggttaaagagggacaggctcttagtaccgccgccgcccagtaaaactacatggaacaaacccagggatcctcatctgcacagctctgcccaaagtctgcagctctgcgagtccagccggcgggggaagctgggtgggccccgcagagagcaagggccttcttgggggaggagcgggatggggcgcagagcagtgcgatcgaagagggttactgtgggactgcacaaaagcaaacccgtcggaggagttttgccagaaacaccaccgcctgcattgcgtcggacctgaccatttccaatgtgaaattcccggggaaggtc

SEQ ID NO: 1019 - skipped

SEQ ID NO: 1020 - DNA, 229 bp, Homo sapiens
  misc_feature 1..229: note = chr12:5018806-5019035
  misc_feature 1..229: note = hyper
  source 1..229: mol_type = genomic DNA
ctaggggccgttcgtgggcggggcggcgggccacaggggaagtagagttagcggtcggcttttctggtaggagaggaaaaagctgtgctggcaagggtgggaactgaatgacaaccccgctctcttccaaaccaccccctcatattttccatccacctcctcgctcctgccctcccccgccctccccaacccacgcccgggtgggccaatcgctgctcggtattccagg

SEQ ID NO: 1021 - DNA, 659 bp, Homo sapiens
  misc_feature 1..659: note = chr12:5019084-5019743
  misc_feature 1..659: note = hyper
  source 1..659: mol_type = genomic DNA
cggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtctcggatgctgctgcggcggccgccgcggctcccgccagggcactgcaaagacgacctgccgcattcccactcgggctctccgctgactcagcaccgcccctgcgccaagccagccggccaggtagggggttccccagctcggggatgcagaagcgggggttggggggaccgggtgggggaggccgggggtgcggggatgctgtccgggaccctgagcttcccccgg

SEQ ID NO: 1022 - DNA, 397 bp, Homo sapiens
  misc_feature 1..397: note = chr12:5019793-5020190
  misc_feature 1..397: note = hyper
  source 1..397: mol_type = genomic DNA
cggctgttgggcattggggaaagtgggatggaagagccccaaacttggatttccgggtgtctgcgtgtcgtctgtccgtgtgtgtgtgatagccctagcaaacgtccagtgctttctcaagctagaggtctgtgttcttcggtgtctgtaggtccgtcccatctgaatgcttctgattttctacccccgtatcactttctatttctctgcagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggccca

SEQ ID NO: 1023 - DNA, 68 bp, Homo sapiens
  misc_feature 1..68: note = chr12:14133813-14133881
  misc_feature 1..68: note = hyper
  source 1..68: mol_type = genomic DNA
gaaggggcacactgacgcgcgcacacacgcccccgacgcgcacgcgccccgcgcgcactcacactcac

SEQ ID NO: 1024 - DNA, 71 bp, Homo sapiens
  misc_feature 1..71: note = chr12:22093889-22093960
  misc_feature 1..71: note = hyper
  source 1..71: mol_type = genomic DNA
gatttgagtaggagacggcagttttgaagtaaaactggaaacctgatccccaccccttcacttctcgagcc

SEQ ID NO: 1025 - DNA, 308 bp, Homo sapiens
  misc_feature 1..308: note = chr12:22093961-22094269
  misc_feature 1..308: note = hyper
  source 1..308: mol_type = genomic DNA
ggcctcgtcccttaattctagaaatagcgatcgcgaaagctaagtgccgagaagtgcgagagagtgcgagggcgtttttggatagcagaaatgttagctcaaaatcgacaacttacagttattcctaaaaatgtttaaatggcattcatgtaaaagacacggattcacttactccgatgacagttttcctcccctaggcgaagcacgcagtgcgccggaacggattatttttagggtggtgggagaccagctgctgcctcctatcgagtttctaaattgcacagactgctctgggccggggcagacac

SEQ ID NO: 1026 - DNA, 471 bp, Homo sapiens
  misc_feature 1..471: note = chr12:22094577-22095048
  misc_feature 1..471: note = hyper
  source 1..471: mol_type = genomic DNA
cgctgtttccccctgaacggatccgggaaatgaagggctcattctaggtagaggcacccactgctgggttatgagtgcacgaatgtctcacaggagcaaggctggctcaagtctaattttccgcttttccccggcgacctagaaaacttggtttctctggtggaccagccgccgcgctatcgaagggcgacccttgcccaccgtcccctaaagtgagacgctgattcccatggactgcgtaaacagtcaccctcttctcctgtttccaaccagagacataattaactctcgagataacgtgtttatattaagatcaccccacaaccactcccccgcgaaacacaagccgtgaattttgtccccgacaaccctctttaattaacaccggattttctcaagagccagttttgagtcagcttgagataagcattgttttcaggaactgtcgtattttaataaaggatggtcagc

SEQ ID NO: 1027 - DNA, 83 bp, Homo sapiens
  misc_feature 1..83: note = chr12:22486799-22486882
  misc_feature 1..83: note = hyper
  source 1..83: mol_type = genomic DNA
aaggacatggaagagcggatgaaagggatgcctctgcgagacggtgcaaggcggtcctcgccggtgaccctgtcctctgcact

SEQ ID NO: 1028 - DNA, 300 bp, Homo sapiens
  misc_feature 1..300: note = chr12:22487133-22487433
  misc_feature 1..300: note = hyper
  source 1..300: mol_type = genomic DNA
cgtttgtcgccgggcccgcccgcaggggctcatcgcagccccggcgtcccaggggcgggggccggggcctcagcacaaagctaggcgaagtggcagcggagggtcccccaccgccagccccccatgcacacacacctttggttctcttacttgcaaacgcacgcacgcttcttcggccccgtcggccccaaaggtcagcgcaaggattttttcaaatgcaacttttccaaggatttctttctaggggaagtggctgggggtgaagtcacgatctatggccatggtcgcttcccctgcaga

SEQ ID NO: 1029 - DNA, 1227 bp, Homo sapiens
  misc_feature 1..1227: note = chr12:48397123-48398350
  misc_feature 1..1227: note = hyper
  source 1..1227: mol_type = genomic DNA
acaccacgcagcctggctcggtgagttccagaatttagaaaagtaactcattgtagtacctcggggcggcggggaatggggtaagaccgcggggaagggggcgctattttcgggggcatttgaaaagcacggtctggttggaatgttatcgtctttcagatggcctctcctactggaagtttctgtaccctttatcagaagagaggcgcaggcggacggagggaagtcgagatgagcgctagggctgcaccttgctccagggccagctgggagggggagggtaccctaaagaggcgctgaggtctcagagggcctatcggaagccgttctttgtggcctgggatttcagcccaccagtgtcagagtgttagtcccctttgtctaactctgctttgagcccaccagccaccaagccttggacaggctgtgaagtcaaccctttggcgtttgcttgctccctcgctcgcgctctctctttcctacttcacctaagttcgatgagttgagatctgtttttgctgaactcgaagtgcttcgaagaggcgagctgtgtgcatgtgcgcctaattatcaaagctggtggaaaagagcccatttatatctgtgcgcaaacttctccgagccaacactttgcaagttcagtattctagcgcaacgtagggacctgcaaatacttgcaactgcgatgggcaccgaggaccctgggacagagtccttgattggcagaactcttcttggtgaacttctgcgtgtcctgtgcctaagtcggcgcgctacgaccccgggagccgttttagcccggagccgcgggctccagagctggagcgggccggggagaaggatgctgagggacgcatggaaagcaggcaggcaggcaggggcgggggaagacttacggacatcctggccctgacaccgaaggacagcggcgacgagcagcgtcagcagcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgcccccc

SEQ ID NO: 1030 - DNA, 90 bp, Homo sapiens
  misc_feature 1..90: note = chr12:49374937-49375027
  misc_feature 1..90: note = hyper
  source 1..90: mol_type = genomic DNA
gtattctccgagatgcgccaggagtgcaagtgccacgggatgtccggctcatgcacggtgcgcacgtgctggatgcggctgcccacgctg

SEQ ID NO: 1031 - DNA, 57 bp, Homo sapiens
  misc_feature 1..57: note = chr12:49375115-49375172
  misc_feature 1..57: note = hyper
  source 1..57: mol_type = genomic DNA
cggagctgctgcgcctggagccggaagacccggcccacaaaccgccctccccccacg

SEQ ID NO: 1032 - DNA, 255 bp, Homo sapiens
  misc_feature 1..255: note = chr12:49390850-49391105
  misc_feature 1..255: note = hyper
  source 1..255: mol_type = genomic DNA
gtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaagg

SEQ ID NO: 1033 - DNA, 788 bp, Homo sapiens
  misc_feature 1..788: note = chr12:49391146-49391934
  misc_feature 1..788: note = hyper
  source 1..788: mol_type = genomic DNA
cgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttag

SEQ ID NO: 1034 - DNA, 634 bp, Homo sapiens
  misc_feature 1..634: note = chr12:49729728-49730362
  misc_feature 1..634: note = hyper
  source 1..634: mol_type = genomic DNA
cgttcttcatgaggtcggcccacatgctggtgccgtcgccgccgcgcatgagcacgtggtaagcgaagaagtagacgcctggcatggggcaagtaaacttgccgctggctgcctcgtaggcgttgcccacgttggtcaccacgtcgtcgaagcgcagcacctcgtaaccctcgtggggccgccgcaggcccgcgtagaaagcaatgcgaggcacgtagccggcagcgggcgccaccccgcccggacctggaccgggagggcccggggggcctggcctgccgggttctcctgggggccctcttggacctggtggtccagggggcccccgcaggcctgctttcccgcgccggcccacctctcccttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccgg

SEQ ID NO: 1035 - DNA, 94 bp, Homo sapiens
  misc_feature 1..94: note = chr12:50297461-50297555
  misc_feature 1..94: note = hyper
  source 1..94: mol_type = genomic DNA
aggggaggatgctttcgtggtccagagggcttgctgaggatgacagggagccgggagccggaggatggaggatggtgcaggctggggagatgcc

SEQ ID NO: 1036 - DNA, 115 bp, Homo sapiens
  misc_feature 1..115: note = chr12:50297973-50298088
  misc_feature 1..115: note = hyper
  source 1..115: mol_type = genomic DNA
gtgaaaccagagccgggcatcagggcctcatctccactgtctctgcacctctctgcagctccagctgcgcctctgccttttcctcctccctctttggatgcggccctgatttctg

SEQ ID NO: 1037 - DNA, 79 bp, Homo sapiens
  misc_feature 1..79: note = chr12:52652141-52652220
  misc_feature 1..79: note = hyper
  source 1..79: mol_type = genomic DNA
gtccgcaggagccggcgcggaagcccccgcacacgctgtggctgccgaagcctccggtgaggccgcggtagcaggagac

SEQ ID NO: 1038 - DNA, 14 bp, Homo sapiens
  misc_feature 1..14: note = chr12:52652599-52652613
  misc_feature 1..14: note = hyper
  source 1..14: mol_type = genomic DNA
gagtggaacccctc

SEQ ID NO: 1039 - DNA, 378 bp, Homo sapiens
  misc_feature 1..378: note = chr12:54321250-54321628
  misc_feature 1..378: note = hyper
  source 1..378: mol_type = genomic DNA
aaatttctgccctgtcgttccaatgccatgatggagaaggacccctaaaatcgcctttggcgtgtgcagctcgagcgttacaacgatgcaaagtgcggtctttggaggatgcgggagtcggtaacccctcaattcactctcgccgttccttctctccagtctgcgcgaaagccaggtccgagggcttcgaagatctgggggacccgagctgcgcacagtggcgggaaacgagcgggctcagctggccgggccgcgtcccctagccaccgcccgcccgcccgctgctttggcctccggagaagcctggagaggggcctgcgcctcttgaaaaatggcttttgggggcggtaggtctcgggagggcgactggggaaagtg

SEQ ID NO: 1040 - DNA, 48 bp, Homo sapiens
  misc_feature 1..48: note = chr12:54345611-54345659
  misc_feature 1..48: note = hyper
  source 1..48: mol_type = genomic DNA
ccacctatagttttgcgcatggtcagcgaagtgccggcgggttaagcc

SEQ ID NO: 1041 - DNA, 14 bp, Homo sapiens
  misc_feature 1..14: note = chr12:54345965-54345979
  misc_feature 1..14: note = hyper
  source 1..14: mol_type = genomic DNA
ggtgggtctcaggg

SEQ ID NO: 1042 - DNA, 180 bp, Homo sapiens
  misc_feature 1..180: note = chr12:54354514-54354694
  misc_feature 1..180: note = hyper
  source 1..180: mol_type = genomic DNA
ttaaagccactaagccgctatcgagccggcaggtgatgggtccggccgtctgggttctgtgggtgctaatgtagccggaaatccggcgcgatcgatggctgagacccagagcagagcagggaccgctggccccggtccgcgaacaaagcaaactccggggacttggggttccggccaggc

SEQ ID NO: 1043 - DNA, 38 bp, Homo sapiens
  misc_feature 1..38: note = chr12:54354814-54354852
  misc_feature 1..38: note = hyper
  source 1..38: mol_type = genomic DNA
cggaaggttccggtgtaattcagcgggaggtggaaggc

SEQ ID NO: 1044 - DNA, 43 bp, Homo sapiens
  misc_feature 1..43: note = chr12:54379888-54379931
  misc_feature 1..43: note = hyper
  source 1..43: mol_type = genomic DNA
ggccccagaccatttcgggaatgcgaccctggctttcgactag

SEQ ID NO: 1045 - DNA, 406 bp, Homo sapiens
  misc_feature 1..406: note = chr12:54379958-54380364
  misc_feature 1..406: note = hyper
  source 1..406: mol_type = genomic DNA
cgtcacttagctggggaaggtaagcggcgacgtggaggtgtcggccctgccccggccatgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggca

SEQ ID NO: 1046 - DNA, 88 bp, Homo sapiens
  misc_feature 1..88: note = chr12:58025646-58025734
  misc_feature 1..88: note = hyper
  source 1..88: mol_type = genomic DNA
ccagaccacccccagcgagcgctgcgctgcgccgccgcggtcggcactcaccccactacttgctccttgatcctgaccgggatgtgtg

SEQ ID NO: 1047 - DNA, 190 bp, Homo sapiens
  misc_feature 1..190: note = chr12:62584823-62585013
  misc_feature 1..190: note = hyper
  source 1..190: mol_type = genomic DNA
cgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccgg

SEQ ID NO: 1048 - DNA, 963 bp, Homo sapiens
  misc_feature 1..963: note = chr12:62585030-62585993
  misc_feature 1..963: note = hyper
  source 1..963: mol_type = genomic DNA
cgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggc

SEQ ID NO: 1049 - DNA, 88 bp, Homo sapiens
  misc_feature 1..88: note = chr12:63544512-63544600
  misc_feature 1..88: note = hyper
  source 1..88: mol_type = genomic DNA
agggcttcggcctcccggcttgtgttgccagcgccggtggccagaggccaccatgggctggagttgcccgagggccccgcgtcgggac

SEQ ID NO: 1050 - DNA, 146 bp, Homo sapiens
  misc_feature 1..146: note = chr12:63544728-63544874
  misc_feature 1..146: note = hyper
  source 1..146: mol_type = genomic DNA
cgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggt

SEQ ID NO: 1051 - DNA, 232 bp, Homo sapiens
  misc_feature 1..232: note = chr12:65218319-65218551
  misc_feature 1..232: note = hyper
  source 1..232: mol_type = genomic DNA
tgcgcacggcggtgccgggattgggggcgggcacgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggc

SEQ ID NO: 1052 - DNA, 281 bp, Homo sapiens
  misc_feature 1..281: note = chr12:65218900-65219181
  misc_feature 1..281: note = hyper
  source 1..281: mol_type = genomic DNA
ggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagac

SEQ ID NO: 1053 - DNA, 179 bp, Homo sapiens
  misc_feature 1..179: note = chr12:65219605-65219784
  misc_feature 1..179: note = hyper
  source 1..179: mol_type = genomic DNA
cgctcacctgttccctggagtggcaccggctgcgttccaggcgggttcacggtccccggcccccgccccccagcgccagcgccttggggacctgctgtagagccgcaggagaatcgagctgcagagtcccaaagggtgggatgcggcactgcctttcccaacctcgtggtttctttgtt

SEQ ID NO: 1054 - DNA, 20 bp, Homo sapiens
  misc_feature 1..20: note = chr12:75601480-75601500
  misc_feature 1..20: note = hyper
  source 1..20: mol_type = genomic DNA
ggtcgctggccctgccgccg

SEQ ID NO: 1055 - DNA, 247 bp, Homo sapiens
  misc_feature 1..247: note = chr12:75601695-75601942
  misc_feature 1..247: note = hyper
  source 1..247: mol_type = genomic DNA
cggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtcc

SEQ ID NO: 1056 - DNA, 14 bp, Homo sapiens
  misc_feature 1..14: note = chr12:95942964-95942978
  misc_feature 1..14: note = hyper
  source 1..14: mol_type = genomic DNA
gcgtggcaaactcc

SEQ ID NO: 1057 - DNA, 485 bp, Homo sapiens
  misc_feature 1..485: note = chr12:103351501-103351986
  misc_feature 1..485: note = hyper
  source 1..485: mol_type = genomic DNA
tccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggat

SEQ ID NO: 1058 - DNA, 104 bp, Homo sapiens
  misc_feature 1..104: note = chr12:103352051-103352155
  misc_feature 1..104: note = hyper
  source 1..104: mol_type = genomic DNA
cggcgccggccagcagccccagccgcagccccagcagcccttcctgccgcccgcagcctgtttctttgccacggccgcagccgcggcggccgcagccgccgcag

SEQ ID NO: 1059 - DNA, 97 bp, Homo sapiens
  misc_feature 1..97: note = chr12:103352170-103352267
  misc_feature 1..97: note = hyper
  source 1..97: mol_type = genomic DNA
cgcagcagcagcagcagcagcagcagcagcagcagcaggcgccgcagctgagaccggcggccgacggccagccctcagggggcggtcacaagtcagc

SEQ ID NO: 1060 - DNA, 15 bp, Homo sapiens
  misc_feature 1..15: note = chr12:103352268-103352283
  misc_feature 1..15: note = hyper
  source 1..15: mol_type = genomic DNA
cccaagcaagtcaag

SEQ ID NO: 1061 - DNA, 259 bp, Homo sapiens
  misc_feature 1..259: note = chr12:103352313-103352572
  misc_feature 1..259: note = hyper
  source 1..259: mol_type = genomic DNA
cgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgcct

SEQ ID NO: 1062 - DNA, 263 bp, Homo sapiens
  misc_feature 1..263: note = chr12:103889253-103889516
  misc_feature 1..263: note = hyper
  source 1..263: mol_type = genomic DNA
gccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggc

SEQ ID NO: 1063 - DNA, 197 bp, Homo sapiens
  misc_feature 1..197: note = chr12:103889517-103889714
  misc_feature 1..197: note = hyper
  source 1..197: mol_type = genomic DNA
accaccgcgacgggttccgccgcttgcctccgctccttggcctttgctgccgtgctgcctcttctcacgggcgcggctggagtcccggggagcagcagagagcaaacggtccggctctacctcaccctgccagggggcgagtcccgcgctccctgcgtctacctggagctgcagggtccctatcccggggcgccgcc

SEQ ID NO: 1064 - DNA, 24 bp, Homo sapiens
  misc_feature 1..24: note = chr12:103889788-103889812
  misc_feature 1..24: note = hyper
  source 1..24: mol_type = genomic DNA
cgcagtcgccgggcaaccacaatg

SEQ ID NO: 1065 - DNA, 78 bp, Homo sapiens
  misc_feature 1..78: note = chr12:104609448-104609526
  misc_feature 1..78: note = hyper
  source 1..78: mol_type = genomic DNA
cacgggctatgacttcgctgttgtcaccgagcgccccgcccaccgcgttctccgacccgcggccggcagggggctcgc

SEQ ID NO: 1066 - DNA, 270 bp, Homo sapiens
  misc_feature 1..270: note = chr12:104609527-104609797
  misc_feature 1..270: note = hyper
  source 1..270: mol_type = genomic DNA
gcctccgccaggcgtccttcggctccgtcagttcccacagggccttgtgcgacatgggctgcgccgagggcaaggcagtggcggcggccgccccaacggagctgcagacgaaaggcaagaacggcgatggccgccgtaggtcaggtacgaccgagggcgaaggcctggtccccaggtcgacgggccgaagcgggccttccggccggggttggggataaagtgccccggagccctggccttgaagcccctcactggagtcagtgactgacc

SEQ ID NO: 1067 - DNA, 628 bp, Homo sapiens
  misc_feature 1..628: note = chr12:106980911-106981539
  misc_feature 1..628: note = hyper
  source 1..628: mol_type = genomic DNA
cgcaggctgggtcctcggagtcccggattcagcacgcgactctgtgcggcagcctgggacagcgcgctttcctacccggcctgcaggtcccagagactcggaaaagtttgcaggggccgcccggcgcctcgggcctgggatttccaaagccgctcccgcccccgtccccagcgcgtcaccatggagactgctggaagttggtggtggaaaacagacctggcgcaaagcaaaatattatgagtgcagttggggtgacttcagggggcggggggaccggagggcaggagcgggagccagaggcagaggccgacaacaaagggcccagtgcgaggaagagagaggagtttgcacggggcctccccgccgctgtgtgagtgctggaccatcctgcttcccagaggctccgaggtctctaatttctctccagcagctataccttttctcagcccgccttggagcccttgctccctccctcctctccgggttctcttccagcctcccccctcacccgtccggaggttaggcgccagctgggcagtgcgcccgcctccccaggagccacaggctcaccaacgtgaaaggttctggcttttcttccccacgacccgtgggtcgcccagggtgagtt

SEQ ID NO: 1068 - DNA, 492 bp, Homo sapiens
  misc_feature 1..492: note = chr12:108168922-108169414
  misc_feature 1..492: note = hyper
  source 1..492: mol_type = genomic DNA
tctaagattctgtttcgtcttcttctattgagagattgacctcttgagtgatttgtgtgctttccggcaaatgatggagacgcgtaaaccggcggaacggctggccttgccatactcgctgcgcaccgcgcccctgggcgttccggggaccctgcccggactcccgcggagggaccccctcagggtcgccctgcgtctggacgccgcgtgctgggagtgggcgcgcagcggctgcgcacggggatggcagtacttgcccgtgccgctggacagcgccttcgagcccgccttcctccgcaagcgcaacgagcgcgagcggcagcgggtgcgctgcgtgaacgagggctatgcgcgcctccgagaccacctgccccgggagctggcagacaagcgcctcagcaaagtggagacgctccgcgctgccatcgactacatcaagcacctgcaggagctgctggagcgccaggcctgggggctcgagggcgcggccgg

SEQ ID NO: 1069 - DNA, 34 bp, Homo sapiens
  misc_feature 1..34: note = chr12:108169549-108169583
  misc_feature 1..34: note = hyper
  source 1..34: mol_type = genomic DNA
cgcacagcgcgcagccgggcgctcaacctaaggt

SEQ ID NO: 1070 - DNA, 325 bp, Homo sapiens
  misc_feature 1..325: note = chr12:113012954-113013279
  misc_feature 1..325: note = hyper
  source 1..325: mol_type = genomic DNA
ggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggtaaggcgggcgggggctgcgggccaccaggtcctgccctcccaagctgcagcacgcgctggctggggggtcgtgggggctcccgtgggggcgcggccggacgcgggacgctgcctccgggaatggggctgctggagcgggaggatgcgctagaac

SEQ ID NO: 1071 - DNA, 79 bp, Homo sapiens
  misc_feature 1..79: note = chr12:113541522-113541601
  misc_feature 1..79: note = hyper
  source 1..79: mol_type = genomic DNA
gcatacgccaagcagcgtcctatgctctttgtgtaaatcaagtcatttaattatcacaactccacgagataggcactgt

SEQ ID NO: 1072 - DNA, 438 bp, Homo sapiens
  misc_feature 1..438: note = chr12:113541661-113542099
  misc_feature 1..438: note = hyper
  source 1..438: mol_type = genomic DNA
aggttgcacagccagcccaggcggaagtgggacacccgctgattgacgggtggggagggcggagcctgcagtccgccctgccccctcacctgagcgctcagcctggaggcagcaggtccagcgcgcgctgcggaaggcaccggggtggcaggcggccagcttgttcgggttgggggcgctggccttgcgcaaggccgagagccactggttgagctcattcacattctgcagcgggtgggaggcgatcagggggcgggtgggaacagagggacgccccccgctccccatcgcggtggggtctcaccttgcactggaggtaggtggtgtgcagcgcccccgtgccgtcctgcgtcaccacctgcatcacgtggggcagttggaaggcgccctcgtctacgcgctccacggcgcggatgtgagacacggggatggagtgac

SEQ ID NO: 1073 - DNA, 401 bp, Homo sapiens
  misc_feature 1..401: note = chr12:113900758-113901159
  misc_feature 1..401: note = hyper
  source 1..401: mol_type = genomic DNA
ctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtc

SEQ ID NO: 1074 - DNA, 24 bp, Homo sapiens
  misc_feature 1..24: note = chr12:113901407-113901431
  misc_feature 1..24: note = hyper
  source 1..24: mol_type = genomic DNA
cgaagtaggcgggggacccgggac

SEQ ID NO: 1075 - DNA, 53 bp, Homo sapiens
  misc_feature 1..53: note = chr12:129337857-129337910
  misc_feature 1..53: note = hyper
  source 1..53: mol_type = genomic DNA
ggtggaaacagaccgcggctaccctggtgatggaccccacggggcacacccgc

SEQ ID NO: 1076 - DNA, 239 bp, Homo sapiens
  misc_feature 1..239: note = chr12:129338587-129338826
  misc_feature 1..239: note = hyper
  source 1..239: mol_type = genomic DNA
cggtgccagccctgccctcgcggatcgggtctcggctgtgtgccggcgtccggggtcctgtccccgaagtccctttcccacctcccctctgccctgtctattctcgtcttcctggctggttagctccttcacactcatctttttctgcctttgtcttatttgtttacttgttggtctgtgttctggtcgctggaacgcaagcccggcgggggcccggggaggggccgccgcgttaatcc

SEQ ID NO: 1077 - DNA, 55 bp, Homo sapiens
  misc_feature 1..55: note = chr12:129338851-129338906
  misc_feature 1..55: note = hyper
  source 1..55: mol_type = genomic DNA
cgctcggcctgtattagccggataaacatattccttgaggcgaagcctgggaagt

SEQ ID NO: 1078 - DNA, 120 bp, Homo sapiens
  misc_feature 1..120: note = chr12:130647950-130648070
  misc_feature 1..120: note = hyper
  source 1..120: mol_type = genomic DNA
cggacgagcccacccggggctcgggcctgttcccgccgctgttccggccgcagcggccccacagcgcgcaggagcacccgctgaaggacgggggccccgggcgcggcggctgcgacaacc

SEQ ID NO: 1079 - DNA, 15 bp, Homo sapiens
  misc_feature 1..15: note = chr12:133481368-133481383
  misc_feature 1..15: note = hyper
  source 1..15: mol_type = genomic DNA
gaagcttttcctcac

SEQ ID NO: 1080 - DNA, 31 bp, Homo sapiens
  misc_feature 1..31: note = chr12:133481489-133481520
  misc_feature 1..31: note = hyper
  source 1..31: mol_type = genomic DNA
cgccacgagccacaatcgtagggttgggcgc

SEQ ID NO: 1081 - DNA, 134 bp, Homo sapiens
  misc_feature 1..134: note = chr12:133481521-133481655
  misc_feature 1..134: note = hyper
  source 1..134: mol_type = genomic DNA
ccctgccggccaccaggggcagcgcaggagctgagcgcaccccatcagcgaaagaagcgcgcctccccgctcttttctgaaccgtatctcctaaactataattttggagatcaaaagtgcggtggagcctcctc

SEQ ID NO: 1082 - DNA, 187 bp, Homo sapiens
  misc_feature 1..187: note = chr12:133485161-133485348
  misc_feature 1..187: note = hyper
  source 1..187: mol_type = genomic DNA
ggcaacgtagaggcggggaattcgccaacgtgtctgaaacagacaacaattttagccaacggctgcgtgggccttgggcgtcctggccaatgggaatagtgaggggcctgtcactaagaaacctgtccctgagcaacgcataggaggggtggaacccagcagcgctgactgagccgccgcgaagtgc

SEQ ID NO: 1083 - DNA, 251 bp, Homo sapiens
  misc_feature 1..251: note = chr12:133485439-133485690
  misc_feature 1..251: note = hyper
  source 1..251: mol_type = genomic DNA
cgcctcgggccgtccccgcccagacgcttgtccccgcgagaagctgagcgcactgaagtgagcccggcggctgccgccggaggaggagcccggctctggacacggccgtcaggaagctcagaggctgcagcaccgcttctgcgttgatttccgcttgacttttactcttttcttgggttaaaaatcaaacgccgacccgaggcgtcagagatgggcggtcgttaggcgcagtggcggcccccggatgtttg

SEQ ID NO: 1084 - DNA, 481 bp, Homo sapiens
  misc_feature 1..481: note = chr13:23733629-23734110
  misc_feature 1..481: note = hyper
  source 1..481: mol_type = genomic DNA
agacttttaaaggctcgcaaatggaaccactccctccagagggactatctaaatctcctcaggtgctgaccctttctgacagtaaaggacgagggccagaagtgtaaagattgtggtcccgcgctccaagcccaagatgcgttcagcaggagtagttgggttggaaagaaggcacccagcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcg

SEQ ID NO: 1085 - DNA, 75 bp, Homo sapiens
  misc_feature 1..75: note = chr13:25319830-25319905
  misc_feature 1..75: note = hyper
  source 1..75: mol_type = genomic DNA
ccagaacaacgagggcgacgaagacaggactgaggaacatgcgcccctgccgccctcacccggaaccagggctcc

SEQ ID NO: 1086 - DNA, 295 bp, Homo sapiens
  misc_feature 1..295: note = chr13:25320734-25321029
  misc_feature 1..295: note = hyper
  source 1..295: mol_type = genomic DNA
atttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactgg

SEQ ID NO: 1087 - DNA, 1072 bp, Homo sapiens
  misc_feature 1..1072: note = chr13:25321112-25322184
  misc_feature 1..1072: note = hyper
  source 1..1072: mol_type = genomic DNA
cgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgac

SEQ ID NO: 1088 - DNA, 26 bp, Homo sapiens
  misc_feature 1..26: note = chr13:25744709-25744735
  misc_feature 1..26: note = hyper
  source 1..26: mol_type = genomic DNA
aggcagggtctggggcggcgggcgcc

SEQ ID NO: 1089 - DNA, 295 bp, Homo sapiens
  misc_feature 1..295: note = chr13:25745300-25745595
  misc_feature 1..295: note = hyper
  source 1..295: mol_type = genomic DNA
cgagggagcccccgccgggccctgcggctctggggggccccgggttcggccgccccccgccgcccccgccgctgtcgcccccgccgcgcggctcctccttcctgccgctctccagcaccagcacctcggcaagtccgtcgtgggtcctgctcctcaccagccccgtcggacccgagcttttcccgtcccctttgtttttgaccccaaaaatgctgggcatggtgccacccgatttcctcttcttgaataatttgaaggcagctttattaatcttccccgacggcggctcggcggc

SEQ ID NO: 1090 - DNA, 221 bp, Homo sapiens
  misc_feature 1..221: note = chr13:25745726-25745947
  misc_feature 1..221: note = hyper
  source 1..221: mol_type = genomic DNA
cgccgccgccgcggctccggctcgtctccatggaaaccgcgcgggataagccgctttcgtcagcagtgggctcgcgccaggccactgtcacccgtattctaaatcaacctgagccgcgctcgccgccgccgctgcaaaagaaacacacataaaagaccatcttccctcccgcaagggcttatataataccctaacccacttccatccgacttggctcggcg

SEQ ID NO: 1091 - DNA, 54 bp, Homo sapiens
  misc_feature 1..54: note = chr13:25946620-25946674
  misc_feature 1..54: note = hyper
  source 1..54: mol_type = genomic DNA
caaaaggctccaggccggggcgaggtgagcggcgggcgtcagagacccccggct

SEQ ID NO: 1092 - DNA, 18 bp, Homo sapiens
  misc_feature 1..18: note = chr13:25946801-25946819
  misc_feature 1..18: note = hyper
  source 1..18: mol_type = genomic DNA
cggcgcagagaagatgca

SEQ ID NO: 1093 - DNA, 95 bp, Homo sapiens
  misc_feature 1..95: note = chr13:28366482-28366577
  misc_feature 1..95: note = hyper
  source 1..95: mol_type = genomic DNA
gaaataatgaggaagcgtgcagagtgaatgccaagagaaaaggcacaaaaaccctattgagaggccccggccgctcctggcgtagtccatcacat

SEQ ID NO: 1094 - DNA, 152 bp, Homo sapiens
  misc_feature 1..152: note = chr13:28367794-28367946
  misc_feature 1..152: note = hyper
  source 1..152: mol_type = genomic DNA
aatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgc

SEQ ID NO: 1095 - DNA, 84 bp, Homo sapiens
  misc_feature 1..84: note = chr13:28368153-28368237
  misc_feature 1..84: note = hyper
  source 1..84: mol_type = genomic DNA
cgctgattcccaggcacccgcagccaaaccactgcctggcatggatttggcactgctttgcagaggtcccgggcctgggcaggg

SEQ ID NO: 1096 - DNA, 77 bp, Homo sapiens
  misc_feature 1..77: note = chr13:28368994-28369071
  misc_feature 1..77: note = hyper
  source 1..77: mol_type = genomic DNA
tctggagtagacaggcgccaacccggattgggcctcccttctgggaagggttggggatccagttgcagggtccgagc

SEQ ID NO: 1097 - DNA, 850 bp, Homo sapiens
  misc_feature 1..850: note = chr13:28369161-28370011
  misc_feature 1..850: note = hyper
  source 1..850: mol_type = genomic DNA
cgattgtcccgctccggcgtggcgcacaagcgtcgcggagctcagagagctaagccggaagggaaggagagcgctctccttggactgcaccatgggtcccaacccctgcagcgcctccttctcacctgggatccagccccacctccatccctcaccatttcgctgtcctggccaacagccgggagggcagaaaccactccctccataagcacaagaaatccgtccttcactgcgcttggattgataacgattcgttagggacaaatttccattctgcgggatggtgcagacttctctcagagggccctcctctctttgttttaaggcaaattcccttagccgagtccctggtcgcggaacattccgggcaaggaatccgagaatccgaagtgatcctgccccagggagtccccgagagggactctgcatagctggagccagtggctctgggacctcatgttctcaccaattctcgttaaaatcctatatccccctacgacttagaatccacaccccagctccctttgaggacatatgcgggtttttttactctctaagatggatgaggagaaggaagtgcgtgaggttctgcagaaacggagagcgcacagctgcgggaggagtatttctgcagtcagtatttctgcagtcagacctgggaagctaatatccgcgttctcgccgctcccattctgtgtccaggaaacctgatagaccttcttttcctgccagacccctacacacacacacagacacacacacacatacacaccctggggagcgctgaactccccgtgtctaggcaaagcaaatgcgtcttttccagcaggaaagacggtccacctgaggt

SEQ ID NO: 1098 - DNA, 171 bp, Homo sapiens
  misc_feature 1..171: note = chr13:28674056-28674227
  misc_feature 1..171: note = hyper
  source 1..171: mol_type = genomic DNA
ggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctgg

SEQ ID NO: 1099 - DNA, 436 bp, Homo sapiens
  misc_feature 1..436: note = chr13:28674720-28675156
  misc_feature 1..436: note = hyper
  source 1..436: mol_type = genomic DNA
gctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccg

SEQ ID NO: 1100 - DNA, 1213 bp, Homo sapiens
  misc_feature 1..1213: note = chr13:29067773-29068986
  misc_feature 1..1213: note = hyper
  source 1..1213: mol_type = genomic DNA
tgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgag

SEQ ID NO: 1101 - DNA, 182 bp, Homo sapiens
  misc_feature 1..182: note = chr13:29068993-29069175
  misc_feature 1..182: note = hyper
  source 1..182: mol_type = genomic DNA
cggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagcc

SEQ ID NO: 1102 - DNA, 114 bp, Homo sapiens
  misc_feature 1..114: note = chr13:29106308-29106422
  misc_feature 1..114: note = hyper
  source 1..114: mol_type = genomic DNA
gtctccccagaggctcgtttcgaacccgcagctagccaagggcaaatgcatactcgaaagtgccacgcctctcgtccaccctgcgccgcgtccagtccacccccttcatcccgc

SEQ ID NO: 1103 - DNA, 392 bp, Homo sapiens
  misc_feature 1..392: note = chr13:29106423-29106815
  misc_feature 1..392: note = hyper
  source 1..392: mol_type = genomic DNA
ccccatgtccacccgcccgctgtccaccctgcgccccatgtccatgcgccccctgtccacccgctcactgtccaacccgcgccccatgtccacccgcctgctgcccaccccgcgcccccagtgcacccgcccagccccgagcgcccgcggagccgagtggagagcagcggccgcagcgcggcgccaggctcgggctgggctggccggcgcgaacccccgggggcgtctgggcggccaggccgggtggcggctgcgcacgtaggagtaccccctgagcccagccgctcggccggcctgacccgcgggtgaccggatacgagtaacgcgtgcgccccgatctgtgccctgcgcggggtcgggcggggaccggccgggggcgccgcgcgcccggt

SEQ ID NO: 1104 - DNA, 60 bp, Homo sapiens
  misc_feature 1..60: note = chr13:29106898-29106958
  misc_feature 1..60: note = hyper
  source 1..60: mol_type = genomic DNA
cgccctgaggtcagggccggggcctgaggacacggcgctgggctccgggggacgcgggtt

SEQ ID NO: 1105 - DNA, 739 bp, Homo sapiens
  misc_feature 1..739: note = chr13:44947737-44948476
  misc_feature 1..739: note = hyper
  source 1..739: mol_type = genomic DNA
cgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctggg

SEQ ID NO: 1106 - DNA, 780 bp, Homo sapiens
  misc_feature 1..780: note = chr13:49794146-49794926
  misc_feature 1..780: note = hyper
  source 1..780: mol_type = genomic DNA
ctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccgcgcggagcacccatgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacc

SEQ ID NO: 1107 - DNA, 336 bp, Homo sapiens
  misc_feature 1..336: note = chr13:53312978-53313314
  misc_feature 1..336: note = hyper
  source 1..336: mol_type = genomic DNA
cttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggc

SEQ ID NO: 1108 - DNA, 17 bp, Homo sapiens
  misc_feature 1..17: note = chr13:53313512-53313529
  misc_feature 1..17: note = hyper
  source 1..17: mol_type = genomic DNA
cgcagcacagggccttc

SEQ ID NO: 1109 - DNA, 83 bp, Homo sapiens
  misc_feature 1..83: note = chr13:53313530-53313613
  misc_feature 1..83: note = hyper
  source 1..83: mol_type = genomic DNA
ccccaggacctgcaccctctaccggccacgggacgtccctccgcacccgcctgtggatgccgtgacccctgcacactcatacg

SEQ ID NO: 1110 - DNA, 37 bp, Homo sapiens
  misc_feature 1..37: note = chr13:53313677-53313714
  misc_feature 1..37: note = hyper
  source 1..37: mol_type = genomic DNA
cggtggcacgcacccctgagtccgaactgtggaacct

SEQ ID NO: 1111 - DNA, 592 bp, Homo sapiens
  misc_feature 1..592: note = chr13:58208334-58208926
  misc_feature 1..592: note = hyper
  source 1..592: mol_type = genomic DNA
tgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagcca

SEQ ID NO: 1112 - DNA, 37 bp, Homo sapiens
  misc_feature 1..37: note = chr13:79170347-79170384
  misc_feature 1..37: note = hyper
  source 1..37: mol_type = genomic DNA
cggtagctgtcctgcagtccgagcggagctgcgacct

SEQ ID NO: 1113 - DNA, 372 bp, Homo sapiens
  misc_feature 1..372: note = chr13:79170467-79170839
  misc_feature 1..372: note = hyper
  source 1..372: mol_type = genomic DNA
cgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgt

SEQ ID NO: 1114 - DNA, 242 bp, Homo sapiens
  misc_feature 1..242: note = chr13:79175702-79175944
  misc_feature 1..242: note = hyper
  source 1..242: mol_type = genomic DNA
ggagcgcttctcgggcgcggcgatggaagtccgcttgcgcttcttctcgccgccgttgaagagctcaggcttgttcattttctcgcgctgggcgccctcggcctcctcgagccacgcctgcaggatgggcttgagcgcgatcatgttgttgtgcgagagcgtgagcgactcgaacctgcagatggtgctctggctgagtgagcccacgcccgggatcttgaggttggccagcgccgagccca

SEQ ID NO: 1115 - DNA, 49 bp, Homo sapiens
  misc_feature 1..49: note = chr13:79176077-79176126
  misc_feature 1..49: note = hyper
  source 1..49: mol_type = genomic DNA
cgatgccgctgccacctgcccggccgccgccgccgccgctgccgctgcc

SEQ ID NO: 1116 - DNA, 145 bp, Homo sapiens
  misc_feature 1..145: note = chr13:79176276-79176421
  misc_feature 1..145: note = hyper
  source 1..145: mol_type = genomic DNA
gggccgccgccgccgccccccgggccgccaccgccgcctcccccggggccgccgcccgggccgccgccgccgcccgggccgccaccgccccccgggccgtcgtgggcgccgccgccgccggccgccgcgcccgcgccgcccgcgc

SEQ ID NO: 1117 - DNA, 224 bp, Homo sapiens
  misc_feature 1..224: note = chr13:79176608-79176832
  misc_feature 1..224: note = hyper
  source 1..224: mol_type = genomic DNA
ggcgatgtccacggccgccagcgcctcggcccgcgccagcagcgtctcgtccaggctggcgaagaggttgctctgcagctgcaggcgacacaaaccaaaccaaaaaaaccacaaaaccaaaagagcaaaacaaaacaacagaagaaacacacacacaggccggaaagcacagcatgcgaagggcaaacacaaagcaaccaaaataacaacgggtttgggggcag

SEQ ID NO: 1118 - DNA, 104 bp, Homo sapiens
  misc_feature 1..104: note = chr13:79177081-79177185
  misc_feature 1..104: note = hyper
  source 1..104: mol_type = genomic DNA
aaagtagagggaagtcgagagtcctggccccagcgctccctactccgatcgcaggcgcctgacgcggaggcagaggcagacaggaacacgacattaagggccgc

SEQ ID NO: 1119 - DNA, 318 bp, Homo sapiens
  misc_feature 1..318: note = chr13:79177305-79177623
  misc_feature 1..318: note = hyper
  source 1..318: mol_type = genomic DNA
cgcgggccggggccgcgggcgtggggcgcttaccggcggcgtgggcaggcaggcccgccggatggcctcggagctggagtgcagcgacgggtacttgtgctcagggagggtgggatgcatggcaaagtgaggctgcttgctgttcatggacatcatcgtggcggcttggcatgtatatccacaaacactccgaaagtccgcgggaaagtgcgtacgccggctcacccggcctcccttcggaggctgcagccgcggcggtcgcggcggctggcggcggccccgccgcgggctgctgctgctgctcctgctgctgccagg

SEQ ID NO: 1120 - DNA, 175 bp, Homo sapiens
  misc_feature 1..175: note = chr13:79177885-79178060
  misc_feature 1..175: note = hyper
  source 1..175: mol_type = genomic DNA
cgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgc

SEQ ID NO: 1121 - DNA, 51 bp, Homo sapiens
  misc_feature 1..51: note = chr13:100642150-100642201
  misc_feature 1..51: note = hyper
  source 1..51: mol_type = genomic DNA
cccccacactactccaccgaaatgatcggaagggcgcgctaggcctgcttc

SEQ ID NO: 1122 - DNA, 227 bp, Homo sapiens
  misc_feature 1..227: note = chr13:100649349-100649576
  misc_feature 1..227: note = hyper
  source 1..227: mol_type = genomic DNA
gtgtgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcc

SEQ ID NO: 1123 - DNA, 86 bp, Homo sapiens
  misc_feature 1..86: note = chr13:100649799-100649885
  misc_feature 1..86: note = hyper
  source 1..86: mol_type = genomic DNA
cgggcatgtgagggacttgagtgaatgcagctccctcaactcactcccgcaaaaccacagccaagagggccttaagtcagagaacc

SEQ ID NO: 1124 - DNA, 230 bp, Homo sapiens
  misc_feature 1..230: note = chr13:102569312-102569542
  misc_feature 1..230: note = hyper
  source 1..230: mol_type = genomic DNA
gctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctc

SEQ ID NO: 1125 - DNA, 930 bp, Homo sapiens
  misc_feature 1..930: note = chr13:112712048-112712978
  misc_feature 1..930: note = hyper
  source 1..930: mol_type = genomic DNA
ccccaaggtgggatccgacgcccaaaggagggcgccccaaggtgggatccgagcgggccgccctaggaggagtgaaccccgcccgggcgcacagctccgtgcgcctgtcctccctcctccagcgaaatcacacccgctttgcctcctcttgcagcaccgcgcgtgcctaggttctcggtctgcgcagctgggagtctcccccaccagcgccgcggagccgcccgcttccgctccctctttccgcgggtttgagcctcccgtggagaggaaaggtcacgaagtttcaaaggtgaaatggattttcggcggtggctggtgcgggagtcaatgggcagggcggggcaagcctggcagtcatcgacccgagcagggacccggctggccgcctccccttgcaggaaacaggtgtttgaacgcgatagcggccgccagtcaactaaggcattaaaagctcgctttataacatcgatttcctggagtgcggtggggcctgcgttctggaagctcgtttgtgaaaggcggggttgggggaattgccctgatggtaccccagttggcgcagaagatccccaaaagtccctgtcaccgcagcggcggacagcggggctgcccaggcggctgggagggcagcttttccctcccgctggggtggaaagaggagtcctgctccgttccccacccaggacaatggtcttgttaccccggcctcctcccctgcacctagggcctggcatgcagagagcgcccgcagcagagggggaagtctccaacaactggcaggtgtcccccgaggagctccgcttgatttggaagggtggttaaaccgggatccaggaggaaagcaattccgttgccacccacatcccctgggccctaccaggcttcttcccctgctagcacatctcccggatgcgacgcaggccaggtggc

SEQ ID NO: 1126 - DNA, 260 bp, Homo sapiens
  misc_feature 1..260: note = chr13:112715354-112715614
  misc_feature 1..260: note = hyper
  source 1..260: mol_type = genomic DNA
gggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaag

SEQ ID NO: 1127 - DNA, 417 bp, Homo sapiens
  misc_feature 1..417: note = chr13:112715936-112716353
  misc_feature 1..417: note = hyper
  source 1..417: mol_type = genomic DNA
tctttaagagccacccgacagaactgcgcgctacatctgcgccagctgggctgggtgggaacagcgcagaaatactcccgtgccggggcgtacagggcaggtaggcccagcagagagtcttctcggaaagtttcccacaaaagaagggccgggcaggccgagcggcaggaaaagccggtgctcagcggcgaggcccgagaggtctggcatccggcggcctcccagctttgctcgggtctcccgccgcctctctccagagccgcccgtagctccgtggggcggagggcgcaatgccccgctctggttccagcctttttcctccccttgtctcctctttcattcataaacctggtggctacagacgcagcttgaatattgacgtctctcccccaactgctctgccgttaacccaattac

SEQ ID NO: 1128 - DNA, 361 bp, Homo sapiens
  misc_feature 1..361: note = chr13:112758012-112758373
  misc_feature 1..361: note = hyper
  source 1..361: mol_type = genomic DNA
tgcaggcggggggaccgcgcgcttggctcgaagaccccgccctgggcaggggacagaaaatatgaaatcagatggggagttatgaataactgtcctcccctcccctctgccgtgtttcctgaatccgtacgctatgcaggaggggggcgggggcgggggcgcggggaggaggagggggccgtttgccattaatctgggaacaagcggctaacctcggtgactggtattttcgcttttcttttctcacttttctcagtgtggggaaagcagtcaagcccgcgcggagcgattgtgaggggctctgctggaatttggcagcgcggaggcttggagagaagccccatgctggctcccattcagc

SEQ ID NO: 1129 - DNA, 196 bp, Homo sapiens
  misc_feature 1..196: note = chr13:112758495-112758691
  misc_feature 1..196: note = hyper
  source 1..196: mol_type = genomic DNA
cgagggagccccttatcccggtgacagaatgggacaagctgggaaaggcttagaccacacaagtccaaggctcaccaggccgcagaaagcctgccttgggaaccgggggtcattatccgccctattcagcggggcccggggaccctgggggccgagcgaggccagcccgggcgggagcaccgccgccagcgcgcgc

SEQ ID NO: 1130 - DNA, 348 bp, Homo sapiens
  misc_feature 1..348: note = chr13:112760850-112761198
  misc_feature 1..348: note = hyper
  source 1..348: mol_type = genomic DNA
ggccaaggctctccccgcgttttcttctcgtgacctggggaatgtcccgccccatcgctcacctggctcttgtcatctcgctcatcttgaagtgacccgtggacaatgctgctccctgccgcagctccgccggtcactcaggcagaacggggtatgcaaatggcctggagaggccgaggccgaacactgcgcccattgtcccgggcgctcaaagcgccgagcagctgcgcagactttctgggctcggaccctcggccgccacgctaatgtcatcattgcaaaacatcagattttgagaactatgcagtctgaattcattagcagccttctcggcgaaggttcttttcc

SEQ ID NO: 1131 - DNA, 323 bp, Homo sapiens
  misc_feature 1..323: note = chr14:24803594-24803917
  misc_feature 1..323: note = hyper
  source 1..323: mol_type = genomic DNA
ctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttc

SEQ ID NO: 1132 - DNA, 205 bp, Homo sapiens
  misc_feature 1..205: note = chr14:24803918-24804123
  misc_feature 1..205: note = hyper
  source 1..205: mol_type = genomic DNA
gcccggcgggccccacctgagcttttctcacccgctcaaagccgctaccaccccgcgcccccaacctcgtggcaatcccgtctcctttttcaggccctccctgcggcctcccagcccgctcccagctggcgatgaggggatccctcagtcctttcctcctcctccctcaaacccggattgtagaggtgccctagaaaagcctcat

SEQ ID NO: 1133 - DNA, 23 bp, Homo sapiens
  misc_feature 1..23: note = chr14:24804424-24804447
  misc_feature 1..23: note = hyper
  source 1..23: mol_type = genomic DNA
cgcctccccgcttcagccccttc

SEQ ID NO: 1134 - DNA, 439 bp, Homo sapiens
  misc_feature 1..439: note = chr14:29234853-29235292
  misc_feature 1..439: note = hyper
  source 1..439: mol_type = genomic DNA
tgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctct

SEQ ID NO: 1135 - DNA, 84 bp, Homo sapiens
  misc_feature 1..84: note = chr14:36973454-36973538
  misc_feature 1..84: note = hyper
  source 1..84: mol_type = genomic DNA
ggaacgcaggctgaggtcaggctgaccacgccgcctcctcagtcgccgtatcgcggggctggcggccagcgccttagaagagcc

SEQ ID NO: 1136 - DNA, 171 bp, Homo sapiens
  misc_feature 1..171: note = chr14:36986301-36986472
  misc_feature 1..171: note = hyper
  source 1..171: mol_type = genomic DNA
ggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcc

SEQ ID NO: 1137 - DNA, 249 bp, Homo sapiens
  misc_feature 1..249: note = chr14:36987301-36987550
  misc_feature 1..249: note = hyper
  source 1..249: mol_type = genomic DNA
gcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcatta

SEQ ID NO: 1138 - DNA, 175 bp, Homo sapiens
  misc_feature 1..175: note = chr14:36990858-36991033
  misc_feature 1..175: note = hyper
  source 1..175: mol_type = genomic DNA
gctcaggacaccctccgccctcccacctgcgcccgcgtttttgtgcggtccccacggcagagctggggaggccaccctacgtttgcgcagggagacgcgctcgccgctggtgttgcgaaagaccagagcgaagcccggctccttgcccttccttcccaggggcttctctgggggg

SEQ ID NO: 1139 - DNA, 92 bp, Homo sapiens
  misc_feature 1..92: note = chr14:36991094-36991186
  misc_feature 1..92: note = hyper
  source 1..92: mol_type = genomic DNA
cgacgccgggcttaagcgaaccacagaggagaactggcaacgctgaatacagaccttgtctgcaggcgcgacctggccgggcctgagtcccg

SEQ ID NO: 1140 - DNA, 178 bp, Homo sapiens
  misc_feature 1..178: note = chr14:36991600-36991778
  misc_feature 1..178: note = hyper
  source 1..178: mol_type = genomic DNA
tggctggcagctccccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctgggg

SEQ ID NO: 1141 - DNA, 37 bp, Homo sapiens
  misc_feature 1..37: note = chr14:36991988-36992025
  misc_feature 1..37: note = hyper
  source 1..37: mol_type = genomic DNA
cgaaaataagcccggagactaacgcaccttgtaggga

SEQ ID NO: 1142 - DNA, 453 bp, Homo sapiens
  misc_feature 1..453: note = chr14:37123566-37124019
  misc_feature 1..453: note = hyper
  source 1..453: mol_type = genomic DNA
ggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccg

SEQ ID NO: 1143 - DNA, 91 bp, Homo sapiens
  misc_feature 1..91: note = chr14:37124481-37124572
  misc_feature 1..91: note = hyper
  source 1..91: mol_type = genomic DNA
cgtggactcttggccagcagtgaggaggacaaggttgcagatcctctttgctgcgggttctgggtccggccttgggcggcattctgtcttc

SEQ ID NO: 1144 - DNA, 264 bp, Homo sapiens
  misc_feature 1..264: note = chr14:37132290-37132554
  misc_feature 1..264: note = hyper
  source 1..264: mol_type = genomic DNA
cgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccag

SEQ ID NO: 1145 - DNA, 33 bp, Homo sapiens
  misc_feature 1..33: note = chr14:37132602-37132635
  misc_feature 1..33: note = hyper
  source 1..33: mol_type = genomic DNA
cggccgccaaggtgcccacgccacccggggtgc

SEQ ID NO: 1146 - DNA, 382 bp, Homo sapiens
  misc_feature 1..382: note = chr14:38724978-38725360
  misc_feature 1..382: note = hyper
  source 1..382: mol_type = genomic DNA
gggccctgggcctgcccgcaggagcgcgagcacagcgcgcagctcggcgcccgcacgcacggtgctgagcgccccacctcgcaggatgcaggcctcctcggccgcctgccgcttcatggtagcgtggtgcaggctgtagcaggcccccgaggccgagcagccagcacggtcggcagtggggtgttcgccgccgcccggcccgggccagagcgcctgccagaggaggcacagggcgaacgccggcctcattctctgaggccccgcacgcagagctgctcccaacttggatctgtcccgctcgaggacgcagagctgtgtctggagcgcggtcaccgccctctacagctggcttccccaacccggttccccctcccttcccctc

SEQ ID NO: 1147 - DNA, 385 bp, Homo sapiens
  misc_feature 1..385: note = chr14:51560329-51560714
  misc_feature 1..385: note = hyper
  source 1..385: mol_type = genomic DNA
gtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacat

SEQ ID NO: 1148 - DNA, 523 bp, Homo sapiens
  misc_feature 1..523: note = chr14:51560770-51561293
  misc_feature 1..523: note = hyper
  source 1..523: mol_type = genomic DNA
cgtctgctgcaaaaccggatgatcggagacgcagggagttaggagtgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggcgggtggcagcgcaggcggcacggatcgcagtagaagacatcgcactgttcgcacatgacggtggcttccttgggcgccttctcgcagagctggcacttgagggccgcggctttgctctgctggtagcggtcaattaccccttccagtacgcgattcttggggaagccgcggagcccccggtcatccaggatgaggctgcggtgacactgggggcaggtgatacaggagttgc

SEQ ID NO: 1149 - DNA, 226 bp, Homo sapiens
  misc_feature 1..226: note = chr14:51561294-51561520
  misc_feature 1..226: note = hyper
  source 1..226: mol_type = genomic DNA
gggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggg

SEQ ID NO: 1150 - DNA, 379 bp, Homo sapiens
  misc_feature 1..379: note = chr14:52534648-52535027
  misc_feature 1..379: note = hyper
  source 1..379: mol_type = genomic DNA
tgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaag

SEQ ID NO: 1151 - DNA, 209 bp, Homo sapiens
  misc_feature 1..209: note = chr14:52535055-52535264
  misc_feature 1..209: note = hyper
  source 1..209: mol_type = genomic DNA
cgctgcagtaggtccaggggccctaaaactcgttcacctatcttctcactcccctcacaaccccggagccccatgtcctcggagaggaagcctccaggtctgaagagggaacaccccagctccgcagacgggcacagccttctcgcggtcctaactgcaaagcccgctggccgccctagcaacgccaccttttctgcctgggacgcgta

SEQ ID NO: 1152 - DNA, 91 bp, Homo sapiens
  misc_feature 1..91: note = chr14:52535334-52535425
  misc_feature 1..91: note = hyper
  source 1..91: mol_type = genomic DNA
cggcatcgctctctggccgggtaccaccgcaagggtgctggggggctccaggagtggggtctgtttcctcccctctggaggcagggtttcc

SEQ ID NO: 1153 - DNA, 332 bp, Homo sapiens
  misc_feature 1..332: note = chr14:52535426-52535758
  misc_feature 1..332: note = hyper
  source 1..332: mol_type = genomic DNA
tgagaccgaccccagggaagaagctgcgggaaaagtgccaggagggggctgaacttacgtagaggttgctgaatcgggcttcgtagaagtgcaggggattcgccagcttcaccacggctgagctttcgtcgtcgccttcctgcaggagctggtccccccacgactccccgtgtgggaagagctcgtctgggtgcagcgccgcggcccgcaacattagcaacggcagcagcagtagcactggtaacgacgacagcaccggccgcccggccacccggtccccctccatgctcgctcggccgtgcgcttacccgctgcacaacgcgtcccgcccc

SEQ ID NO: 1154 - DNA, 214 bp, Homo sapiens
  misc_feature 1..214: note = chr14:52535759-52535973
  misc_feature 1..214: note = hyper
  source 1..214: mol_type = genomic DNA
gcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggctggc

SEQ ID NO: 1155 - DNA, 92 bp, Homo sapiens
  misc_feature 1..92: note = chr14:52535974-52536066
  misc_feature 1..92: note = hyper
  source 1..92: mol_type = genomic DNA
gggtaaaagctcctggccagggctgcctggagctgccccttccactccgcccccagggagctcccgggtcatcctctcatccgggctgcccc

SEQ ID NO: 1156 - DNA, 38 bp, Homo sapiens
  misc_feature 1..38: note = chr14:52536067-52536105
  misc_feature 1..38: note = hyper
  source 1..38: mol_type = genomic DNA
cggcccccaaggagccccacccccgggaccaaatggcc

SEQ ID NO: 1157 - DNA, 50 bp, Homo sapiens
  misc_feature 1..50: note = chr14:52536342-52536392
  misc_feature 1..50: note = hyper
  source 1..50: mol_type = genomic DNA
cgcttcgctccacccagagacgccctgaggagaagcgagcctttgtacga

SEQ ID NO: 1158 - DNA, 220 bp, Homo sapiens
  misc_feature 1..220: note = chr14:57260875-57261095
  misc_feature 1..220: note = hyper
  source 1..220: mol_type = genomic DNA
attcgttaaaccagccgtctaaacgggccctggcactgggtatccgaccgctccacgcgccagctggtgaggcctggagttggaaccggaagccgtctccagccggcctcctaggccctaggtgcccgggtgggcacacttccgcgagggcccggggacagcgccggccaagtcttgcgggcaactgcacactcggttccgggaggcaggtactccaggt

SEQ ID NO: 1159 - DNA, 234 bp, Homo sapiens
  misc_feature 1..234: note = chr14:57261174-57261408
  misc_feature 1..234: note = hyper
  source 1..234: mol_type = genomic DNA
cgcggtcccggagcgcggcgggaagaacgcccacgtcacctcccggtgttgttacacccacaatcaccacactctgacccccgcaaagaccacagaggagtaggaagagggctgccctcgtactccccaagccacccccgcctctgagcgcggaggcacgatgttctggggctcgagccttcgcatccaccgggccagcgctaaccaccggccgccgccctggaggggacccgg

SEQ ID NO: 1160 - DNA, 382 bp, Homo sapiens
  misc_feature 1..382: note = chr14:57261465-57261847
  misc_feature 1..382: note = hyper
  source 1..382: mol_type = genomic DNA
cggaggcctgggttggggggtcgtgagccggatgttccccgcagctggccagaaagctgcctctgagcctcttgagcaactccctgcctcctccggtagtctctctggactctccaagtgacttgctgggggcaccgggcgcggggagggcaggcccccggggtgacgcaggtgtgtactttacagccagagaaggcctagctttcagggacattggcttagtttgttgggtgagacgtgggggtggagaatgggagcactgtctctttgccaaattttccagagaaaccccgggactagctctgtccctggtgccccggctactgccagcgggtccttagcgctgtcgattgcgcgcaccggagcccgaagtcttccccac

SEQ ID NO: 1161 - DNA, 567 bp, Homo sapiens
  misc_feature 1..567: note = chr14:57264079-57264646
  misc_feature 1..567: note = hyper
  source 1..567: mol_type = genomic DNA
catttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcc

SEQ ID NO: 1162 - DNA, 43 bp, Homo sapiens
  misc_feature 1..43: note = chr14:57264764-57264807
  misc_feature 1..43: note = hyper
  source 1..43: mol_type = genomic DNA
cgtcagcggctcatcctaccgggagacctggaaaaccagcagc

SEQ ID NO: 1163 - DNA, 93 bp, Homo sapiens
  misc_feature 1..93: note = chr14:57265147-57265240
  misc_feature 1..93: note = hyper
  source 1..93: mol_type = genomic DNA
gccctgggaccggcgcccccgaggcctgagaactacgcccggggggcgcgggctgaggctcaagagaggtcctaggtgcgggccagggatgga

SEQ ID NO: 1164 - DNA, 15 bp, Homo sapiens
  misc_feature 1..15: note = chr14:57270957-57270972
  misc_feature 1..15: note = hyper
  source 1..15: mol_type = genomic DNA
aagatgtctgggtac

SEQ ID NO: 1165 - DNA, 28 bp, Homo sapiens
  misc_feature 1..28: note = chr14:57271153-57271181
  misc_feature 1..28: note = hyper
  source 1..28: mol_type = genomic DNA
cgcagcagtcccccgttcctcacagccc

SEQ ID NO: 1166 - DNA, 322 bp, Homo sapiens
  misc_feature 1..322: note = chr14:57274417-57274739
  misc_feature 1..322: note = hyper
  source 1..322: mol_type = genomic DNA
gattctctccacaaccggcctaggtatgcactctgcatagaaggcatgggcccttcaatctaactttcaaagctcttttcctctcgaagcagggtccagaacggggaaaagaaataacttttgaaaaatccacgcctcactatgactgctcacgaggtggcctctggagaactcatacctagaagctgaccgcggtcgcgcggcgagttccggcagccggtcggcgaccgcacctccgggcgcgagtgcctgggtcccgcgttcctgcccggcagccccgcagccccgcagccccgcagccccgcagccccgcaggcctggc

SEQ ID NO: 1167 - DNA, 310 bp, Homo sapiens
  misc_feature 1..310: note = chr14:57274740-57275050
  misc_feature 1..310: note = hyper
  source 1..310: mol_type = genomic DNA
cccgaggtcccgctccactgcccgcgccccccgcgcagccttatatctaacggtcaattcgtgcaatctgtcgcttctccctcccccacgccttgttttttttttcttccaagaagcccatctaccagttgctgtgtcctcgctcaacaataattacctcgtccgagaattaattataataaatgttttcttgataaactaacgagataatccgaggggcacacgtcccttaattacaggccgccatgctcctctctgcttctcgtccgggctgattaattttctgcatgatggaaaggaaacaaaacta

SEQ ID NO: 1168 - DNA, 17 bp, Homo sapiens
  misc_feature 1..17: note = chr14:57275210-57275227
  misc_feature 1..17: note = hyper
  source 1..17: mol_type = genomic DNA
cgcgagggagggaggaa

SEQ ID NO: 1169 - DNA, 417 bp, Homo sapiens
  misc_feature 1..417: note = chr14:57277979-57278396
  misc_feature 1..417: note = hyper
  source 1..417: mol_type = genomic DNA
gaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtgg

SEQ ID NO: 1170 - DNA, 69 bp, Homo sapiens
  misc_feature 1..69: note = chr14:57278694-57278763
  misc_feature 1..69: note = hyper
  source 1..69: mol_type = genomic DNA
atttacagcaattaacgaattacgggagtgcgcacgaggcagcaagctctcggcagccgggctccggct

SEQ ID NO: 1171 - DNA, 728 bp, Homo sapiens
  misc_feature 1..728: note = chr14:57278837-57279565
  misc_feature 1..728: note = hyper
  source 1..728: mol_type = genomic DNA
cggcccctcgagcccccgaggggcccggagcccgcccagctccttcccggccctctgcagcagctccagtccggagacccgctggctgtcgcgttcccaggagtcaagagtttctaggggcccgggcgggggggagggtgagtaccgaccttttttctcaccccacccccactgtactgaaacacctggcggccgcccccgaagcctttaatggggatggtggtgaggagggggtaacaaatgccccgggcgttatgaccctcgtggcgctggctgtcggaggcactggttgggtgcgcttggtcagagtcatgatgctttcgatgaaggaaaggcaaatccacctcgatcacctgaagcagagtctccttcctacccctagaaaagacaacgtttcccccagtttgatcacaatgatgtttaaagcataaaagagccgaaaaagaaaaatggacgttgtgaatctggcagaggggaaggccggaggaaggccttggggacagtgggcatggggtgggatggagaatgatcagaacatgcgcttgtgagctaaaccaagtaaaccattttggactgggagatccatctgccgtagggtccagtgtccagggtaacctttcaagcccgatgtagaggtttgcgatgtcctcccagatggcgggggcagctgaatctccctaaaaatccccctgttctattcgacaggggcagatttatgcatggtgggg

SEQ ID NO: 1172 - DNA, 110 bp, Homo sapiens
  misc_feature 1..110: note = chr14:57283299-57283409
  misc_feature 1..110: note = hyper
  source 1..110: mol_type = genomic DNA
catacctgagatacacggtgcaaacgcccccggctccctcctttcccaattcacccacttcttaatttgagtttcttaatgtgcaagcgccagggccggctgtggtcagg

SEQ ID NO: 1173 - DNA, 592 bp, Homo sapiens
  misc_feature 1..592: note = chr14:57283445-57284037
  misc_feature 1..592: note = hyper
  source 1..592: mol_type = genomic DNA
cgcccctgccggcgggtcgccgggtctcgagctgcgccgccccgctggaggcgccggggctgcctggctctccgcgcaaacctcgcgcccttccgtttgcgcgcatggagccgggtgagggcggccgcggccaccgcgcgatggaggatttggaagctcagagccagctggtacattttgagaaatttagcaaaccagactgggctgcctcggaaactgggttctgttctgactcatttgcagaaaagttatggggaaaaacatcttgtaaaattaaggttatgtttggcgggtacagtcttgagcgcacatggtcatccggcgaatcagccaagttttccaaagcgccccctctccagctctcaggccaggggagcaaagcgtaggtgtgtgcgtgtgcgtgtgcgcgcgcgcgtgtctctgtgtctgcgtgtgtgctcgcaagcgcgtgtgggtttggggtggggggacatcctgacctttctacaccctagtgcgtcccaactccagactgggaggagacgtctgcggcctctggtcttttcccttcttggacgaggtgcggccagctgagacctcacaccggccacct

SEQ ID NO: 1174 - DNA, 541 bp, Homo sapiens
  misc_feature 1..541: note = chr14:57284070-57284611
  misc_feature 1..541: note = hyper
  source 1..541: mol_type = genomic DNA
cgggactgggggacccctgggatcccgccctcgtagcggaaggagtggcagcccttggtgccgggcctggtccttgaggctgccggccctccggggcgccaggactcgaggacgcggtttgcccccgcagtcctaagatccccggggccgtgacagcttggggaaggggcaaactctgtttggtctccacgaagtgcttcgatgttcgcaaaagggtaggcccctcttgcttggggtcctacacccctcggaactggctctgcccctgcctcttccccagcacagtctcccagctaaggctcagacagccggggaaaggggcgcccccatcactattccccacaacccgccccagtgtgagccagggcgcggctgcaggctgacaggcgcaccgtgaccacgccgtcacttcccttcaccaaaggttagatgggaggcgtgcaccctctggggagttcgcaaagcttctcgctttgatcagccgcgcgcagtgccagggagagatattgctggggtctgagtccgtcggaagtgtctagaa

SEQ ID NO: 1175 - DNA, 225 bp, Homo sapiens
  misc_feature 1..225: note = chr14:60952195-60952420
  misc_feature 1..225: note = hyper
  source 1..225: mol_type = genomic DNA
cgtgtagcaaaattctaacgaaagcccttccccaacacccgggtaaacctagagaaacagtgcgatttcgcatttacgaatttaccacgaagaataaaaaaattggaggttttcacagaacagccaattcgcattacggcatacgcctgaggcggggttcctgtctaccgtgcccctcagagcccaggaaccacagcccgtgcgcctcccgcagtgggagttcgc

SEQ ID NO: 1176 - DNA, 117 bp, Homo sapiens
  misc_feature 1..117: note = chr14:60952516-60952633
  misc_feature 1..117: note = hyper
  source 1..117: mol_type = genomic DNA
cgggccgcaccaacccaggggataaggcgactccggtcgctctgaggggcagggccagccagccccctcccacccacgcacacgctccccctcagagccgccggcccagagaaaaac

SEQ ID NO: 1177 - DNA, 218 bp, Homo sapiens
  misc_feature 1..218: note = chr14:60952729-60952947
  misc_feature 1..218: note = hyper
  source 1..218: mol_type = genomic DNA
cgccacagcggatcctaactacaaacggtccccggagccctgggctggactcgctcagccccgcccccacgcccctggtaccagccctgagagaccccgcggagcacgccgcgggagccgcagatcgcgctgaagagcagcgagatcgcgctctggacgagacctgcgcggctgcaaccgctccttcttcgcgggtggaagcgcggaataagccccgt

SEQ ID NO: 1178 - DNA, 311 bp, Homo sapiens
  misc_feature 1..311: note = chr14:60973697-60974008
  misc_feature 1..311: note = hyper
  source 1..311: mol_type = genomic DNA
tgtccagtaaaagggcgagagggagacgtgtggtctcctggggcatggacaacctctcccacctcagcagctaggcgctgggatcggggtcggctctcggctcggctcgcgggctgtaaggtctccgcggaccccaccgcctcttctgcgcgctaagggtgagcgccaagcaatttcgcgagcaatagccggcaaagtaaccaccccgagagggaaaataaacctctgcaaactggagcaagggggtgctttcctcccctggccagaagctccgggatcgcagccctcccgggtccggcttcatccctgcc

SEQ ID NO: 1179 - DNA, 441 bp, Homo sapiens
  misc_feature 1..441: note = chr14:60975448-60975889
  misc_feature 1..441: note = hyper
  source 1..441: mol_type = genomic DNA
ttacaactaaacttgcgaattctcggagcatttcagtttggcccagtcctctttgtcctctggagacctctcgaccgagacaacgcatcgccccaaagtgaattcctgaattcctgtggcatcactgcctatttggtgggaaaaagggagggaggggtagagcggggtgggggagggaggagtagtgaacgctgccgcactcgcctctctttttctcccagacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccgg

SEQ ID NO: 1180 - DNA, 440 bp, Homo sapiens
  misc_feature 1..440: note = chr14:60976074-60976514
  misc_feature 1..440: note = hyper
  source 1..440: mol_type = genomic DNA
cgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacaca

SEQ ID NO: 1181 - DNA, 258 bp, Homo sapiens
  misc_feature 1..258: note = chr14:60982110-60982368
  misc_feature 1..258: note = hyper
  source 1..258: mol_type = genomic DNA
accttttccatccagcgccccgcgaactcgcggacgtgtaggcctcgagccactcctactgttgggctgcgtgactcagcggctcgaggagagaaacctctcaaaaccgggggaccgagacggggttcaatttaaacctaggtgggagaatgagcccacaagcgcgcgcccctgcagctgcggaggcgcgcgcccgcccaccctcgggcgcctgaagtcgcagcggttgcagagcctcgagcccgtggatgcggcgcg

SEQ ID NO: 1182 - DNA, 316 bp, Homo sapiens
  misc_feature 1..316: note = chr14:61104241-61104557
  misc_feature 1..316: note = hyper
  source 1..316: mol_type = genomic DNA
cggttgcaccccggacccctgcagctgtggacgccggagctgtgcgcagtcatcctgagccagcccgcggggcccgatcggaagggacgcctctcctaagagctggcctggagtcctggagcctccaagcgggcaagtaggggccgcaaaggctgggctgggcctccgctgaggccctcgggggcctctgggccctcatggcctggaggccgcgcggcccaagcccctagagcagaggccgcgctagcctgcaggggtcgacgcagggccggaggcagcggcttttccttcccactccgggttgaccctaaagaca

SEQ ID NO: 1183 - DNA, 241 bp, Homo sapiens
  misc_feature 1..241: note = chr14:61104623-61104864
  misc_feature 1..241: note = hyper
  source 1..241: mol_type = genomic DNA
cgaaactggcccggaggggggcccaggcctcacgcgcccggctctctcccagctctcctcctcctccttctcgggctcagaaagccttccagccgcggccccagccctccccccagcctgtgctgggctccgctttccctccatcaactccaagccgaattcaatccgagaaggctcctttgagcttttgtgtttgctgggggagatgtgggcgcaggagggatcgcgttacaactttcat

SEQ ID NO: 1184 - DNA, 220 bp, Homo sapiens
  misc_feature 1..220: note = chr14:70654070-70654290
  misc_feature 1..220: note = hyper
  source 1..220: mol_type = genomic DNA
ggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagc

SEQ ID NO: 1185 - DNA, 306 bp, Homo sapiens
  misc_feature 1..306: note = chr14:70654291-70654597
  misc_feature 1..306: note = hyper
  source 1..306: mol_type = genomic DNA
ctagcctctgaatcagggctttgactgtgtgtgtgtgtgtgtgtgtgtgtgtgtgtgtgtgtgtgtccgcgcgcgcgtgtgtgttgggggatcgggggagggttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgc

SEQ ID NO: 1186 - DNA, 41 bp, Homo sapiens
  misc_feature 1..41: note = chr14:70654598-70654639
  misc_feature 1..41: note = hyper
  source 1..41: mol_type = genomic DNA
cgccgagtggataacgcgcttccctgctagcccccaaaccc

SEQ ID NO: 1187 - DNA, 147 bp, Homo sapiens
  misc_feature 1..147: note = chr14:70654640-70654787
  misc_feature 1..147: note = hyper
  source 1..147: mol_type = genomic DNA
gcggacactcacagcaccagaagcacaacacgccctggcccaggtggcacacatatgccgacatgcatccagcacacacaacacagcagtcagtctccccaaacagcacccgctaccaacccagcatgctcacgatccaactgtacc

SEQ ID NO: 1188 - DNA, 351 bp, Homo sapiens
  misc_feature 1..351: note = chr14:74706046-74706397
  misc_feature 1..351: note = hyper
  source 1..351: mol_type = genomic DNA
tttggaattcctaatcgctcctggccccggtgattggctgctcagctctgaccccacttgggctgccgcctggttggataaaaggggaatctccttgggctccagagcattagacaccggagggggcacctgggaccaacttcgcgaagcgggaagcccggcgggggggtggggggagctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccc

SEQ ID NO: 1189 - DNA, 605 bp, Homo sapiens
  misc_feature 1..605: note = chr14:74706940-74707545
  misc_feature 1..605: note = hyper
  source 1..605: mol_type = genomic DNA
cgtggtgcagagtcgccggccgtgtcggagggccccagcaccgctgctccactgcggccccggcctggtgtaggatccgcactcctcgagcccgatgctgttccggctccggccccatccctggtgtccaaagttgtctgattcccaaatcccgcgctggtcaactggggtttatttttcacccccacgagctcagacaacccggccatcgcggcagctaaagcggccgccatcctctcccacgtaagcgccactatatactggagcccggggacgcgcgggctcggggaccctgggtgacctctccgccttctccccgcgctgctttccgggaggtgtgtcgcggcccgctcgaacctccgattcctgtttgagcttggcaattcccccgatttttcgttgcgttttactttgttttacgtggaaaggcaacgaaaaccagcgcgtcgcaggctctcgggcctcgagtagggacgcattgtgccgccttgcgaaaaggacggtgctcggcagcccccagtcttcccggagcccagctccccacgcctccgctccgctcctcgctcctcgaggccaactttccggcccggggcattggggctggc

SEQ ID NO: 1190 - DNA, 176 bp, Homo sapiens
  misc_feature 1..176: note = chr14:74707572-74707748
  misc_feature 1..176: note = hyper
  source 1..176: mol_type = genomic DNA
cgagcgctgccggggatctctgcggccccctaaggctgcctcgctctccgtcgtcccggtcccaagcgcgccggggcctttgcctctcttacaacgaaatctgttcaaaacctccggattcgggccccggcgcgggagaggtcagcctgagctcagggatgggacggccaccgggg

SEQ ID NO: 1191 - DNA, 120 bp, Homo sapiens
  misc_feature 1..120: note = chr14:74707791-74707911
  misc_feature 1..120: note = hyper
  source 1..120: mol_type = genomic DNA
cgcggaggcagcccggggtggggccctcgcgggtttcgggcacagcggagcgcgtcccccactctgccgcatgtccctacgcccgcttttcagattctgaagatgtttcctccagcgatc

SEQ ID NO: 1192 - DNA, 418 bp, Homo sapiens
  misc_feature 1..418: note = chr14:74707912-74708330
  misc_feature 1..418: note = hyper
  source 1..418: mol_type = genomic DNA
aaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctc

SEQ ID NO: 1193 - DNA, 70 bp, Homo sapiens
  misc_feature 1..70: note = chr14:89817946-89818016
  misc_feature 1..70: note = hyper
  source 1..70: mol_type = genomic DNA
tcctttgaggccccccggaactggcagcaggccgacgggcaatcgttcctctggccgcacactttcaagt

SEQ ID NO: 1194 - DNA, 212 bp, Homo sapiens
  misc_feature 1..212: note = chr14:95239421-95239633
  misc_feature 1..212: note = hyper
  source 1..212: mol_type = genomic DNA
cgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcat

SEQ ID NO: 1195 - DNA, 261 bp, Homo sapiens
  misc_feature 1..261: note = chr15:28341719-28341980
  misc_feature 1..261: note = hyper
  source 1..261: mol_type = genomic DNA
gggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttc

SEQ ID NO: 1196 - DNA, 39 bp, Homo sapiens
  misc_feature 1..39: note = chr15:28341981-28342020
  misc_feature 1..39: note = hyper
  source 1..39: mol_type = genomic DNA
cagggccccccgggactggcggccccgcggcaggccagg

SEQ ID NO: 1197 - DNA, 15 bp, Homo sapiens
  misc_feature 1..15: note = chr15:28342521-28342536
  misc_feature 1..15: note = hyper
  source 1..15: mol_type = genomic DNA
cggccccaaggagct

SEQ ID NO: 1198 - DNA, 334 bp, Homo sapiens
  misc_feature 1..334: note = chr15:34786610-34786944
  misc_feature 1..334: note = hyper
  source 1..334: mol_type = genomic DNA
caccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcac

SEQ ID NO: 1199 - DNA, 103 bp, Homo sapiens
  misc_feature 1..103: note = chr15:34787232-34787335
  misc_feature 1..103: note = hyper
  source 1..103: mol_type = genomic DNA
cgccccgagccggccactggctacacgctgcagttccgctccggcaatgtggccttccgcgactgcgagggccgttacctggcgccgtcggggcccagcggca

SEQ ID NO: 1200 - DNA, 291 bp, Homo sapiens
  misc_feature 1..291: note = chr15:37180507-37180798
  misc_feature 1..291: note = hyper
  source 1..291: mol_type = genomic DNA
cttcaaacactgccccgacggtctccattctcatcacaatctgaccggcctcccccatcagaccagcatttcccccgcgcggcactttctcccagccccggccccgacggagggggcccgccccggcgcgcgacgccctgagttgatgactgcaactgtaactgggacgggccccccgtgcccccatagtttgcaatacgttggtctaactctaacacacgcgcccagggaaggccaggtgagggccagggtagccctctgcacgcccctctgccgcggcccaagcctctg

SEQ ID NO: 1201 - DNA, 76 bp, Homo sapiens
  misc_feature 1..76: note = chr15:45403605-45403681
  misc_feature 1..76: note = hyper
  source 1..76: mol_type = genomic DNA
gcccggtggcggggtcgggcgccgcccacatgagcagggggttctgcgagtctcgggggaaagcggggtcgggccc

SEQ ID NO: 1202 - DNA, 202 bp, Homo sapiens
  misc_feature 1..202: note = chr15:45403798-45404000
  misc_feature 1..202: note = hyper
  source 1..202: mol_type = genomic DNA
cgggtgagcccgggtcgagaggcggcggcgggccagggaaggccggggcccggcgggtgtccgcggctggggagtgggcgcctctcccctccaggccctgccaggcccgaagcccaggccccacctggctggggtgcggtcccttcccgccgccttccccgcctcaccaggtcccgggggttgctgggactccgtccggtct

SEQ ID NO: 1203 - DNA, 71 bp, Homo sapiens
  misc_feature 1..71: note = chr15:45479446-45479517
  misc_feature 1..71: note = hyper
  source 1..71: mol_type = genomic DNA
agagtttggggcttccgtctcagattagtcggttgagaatctgaacaaaggtgggtgaaggctcggaaccc

SEQ ID NO: 1204 - skipped

SEQ ID NO: 1205 - DNA, 438 bp, Homo sapiens
  misc_feature 1..438: note = chr15:48936775-48937213
  misc_feature 1..438: note = hyper
  source 1..438: mol_type = genomic DNA
accaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgc

SEQ ID NO: 1206 - DNA, 432 bp, Homo sapiens
  misc_feature 1..432: note = chr15:48937214-48937646
  misc_feature 1..432: note = hyper
  source 1..432: mol_type = genomic DNA
gtccccattcccaagcccaacccgtgcgccgcctgcgcgtggcgcagttaatttgggtaagggaagaccgtttggtccacagctggctggaaagcccaggcccccggcggcagcagccccggccgatccctcggcctcccgggccccgccagaagagcgcggcgcaaagtacccatatccccagcggtcctaagccccgggcgagctctctgggtttattttttttagcggcacgaattgcgcgcgatgcgcgctctgaacgccccactcctcagcctgccctctccgccaggctggaagccagccgcgccgtccccgccgactccgggcgatgccaccgccccccgaacatctgacgcggagcccggcaccaagagccccgggccaggaagctgtcaggcaggggagggccagcgccagctgtggacgttc

SEQ ID NO: 1207 - DNA, 638 bp, Homo sapiens
  misc_feature 1..638: note = chr15:48937709-48938347
  misc_feature 1..638: note = hyper
  source 1..638: mol_type = genomic DNA
cgtggccgcagctccagccccggtggccgcccgacccccgtcgggaccccggctgcacccactggagaagcggcggctccgactcccgaggaggcggcggcggctgctcccagtcgtggccgctacagccactgctcggctccgctcgcagctgtcccagctgtggctcctgtccgcttgtggcacccacagtctctgccgcggctcccgcagccccctcctttccccacctcttcaagtatcgtccgcgcagcggtttctcgcgagagaaatactttttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgggaagaggtggagtagcggttttagcccgctctgcggctgcgaggtttagatccgagattaacctctcccgcgataggtgaagccctaccggagcagaaagctgttccacctgcaccaagaatgcgcgctggagac

SEQ ID NO: 1208 - DNA, 162 bp, Homo sapiens
  misc_feature 1..162: note = chr15:48938348-48938510
  misc_feature 1..162: note = hyper
  source 1..162: mol_type = genomic DNA
gttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctg

SEQ ID NO: 1209 - DNA, 15 bp, Homo sapiens
  misc_feature 1..15: note = chr15:53075850-53075865
  misc_feature 1..15: note = hyper
  source 1..15: mol_type = genomic DNA
acaaaacaaaggaac

SEQ ID NO: 1210 - DNA, 1016 bp, Homo sapiens
  misc_feature 1..1016: note = chr15:53075985-53077001
  misc_feature 1..1016: note = hyper
  source 1..1016: mol_type = genomic DNA
cggatacaaaatccaagtacgcatcttttttggggaggttagagctgaggtgtacttcggaagatgagaattttgttttcatgaattgggtaacacccaggcattgttaggtaccccgacagaccctctagatatccttctcttcctccttcacactttcttcctatcaaaatagttattgttttgaaattcactagaacaacgacgttctaaaaacaaaggcgcagcaagcatccctttcttcgctgccgcgggctgaaccacggacgctcgcgggtcgcccagccccgacggcccgcagggggcgcgcgccgcagccgcagcacagcccggctacccccagaaagggagccgaatggagggaagcagggagcgcggagggctcgaggcttgcagataaggagaggcgcatcctgggatttgggtcctctgctgctacaacacaaccgtgctattgttggcactgtccgacccaagtgtcggtggtaagcggcgatgtcggggctgggtctctagcaaccgctgtgccctgggtcaggctggtcgccccagctaccgggatccctctccggatgcttccagggcgataggtgctgcacccattgacgggatagccgcatacctccgaacaggtagtggagttcgtctctggcaggcatcctagctgcgctgacaccaaggtcgccacacaatagccatcagccccccttaagccccagaagtaggtttcccctgccccagccatagcggttccagtcgtcgccacgagcccacttcttatccccaagcgcacctccctctcctcacccgggtttatgcccgttacacagagagaactacacagggggaactatggtcctacaccctcgaggggacagacaccggccgtgagacaggcaccacgcagagccttctggtgactgtccgcaggagcgagaccttttttggttttgcagtcggctaggtgtgtgtgtgtgagggtccccagttgactaccgggatgcactgccactttt

SEQ ID NO: 1211 - DNA, 461 bp, Homo sapiens
  misc_feature 1..461: note = chr15:53077065-53077526
  misc_feature 1..461: note = hyper
  source 1..461: mol_type = genomic DNA
cgctcccagctggcggcgcccctcgccccgggctcagaggcggacacggtcggtcgcgccctgctggccctttgttcgcgccgcagcgggctgggagcagctgcgcgacaccagacccacagcgccaagacgcgaagcgcgaggaaaccgctgcgcttgactccttctcccccaactcttggacccaggaacgcttccagctcctgcgtcccacacgcccagtcctggcttctctcccggcccagaagtcttcaaggattgaagggctctgcctagggccccgcactcctgcctgactcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatg

SEQ ID NO: 1212 - DNA, 548 bp, Homo sapiens
  misc_feature 1..548: note = chr15:60287038-60287586
  misc_feature 1..548: note = hyper
  source 1..548: mol_type = genomic DNA
tgagacatttgccttcgagctcgctaagaaagtggcacctggttggtggaggggagagataccaaatgtcggcgcccagcctgaaataagtggcatgggacgcgcagggagggcgttcagcttcagaaagcagcggctacgctgggtccaaacccggcggctcgggaggccatagctcctaggtgcgtccgagctcctgctaccctgcgcggtgttgtcctaccggaggaagtggctgatgggcagtctaggatcccggcccctgacccagggccctctcctccctgcggtcctggtccgggtcatggtcccggggctggtctgaagtgctgtctacagagggcacttggggaaacatcgtaggtccggaaattcccagggaaagtttttgcaggagttgtggacgccgcagcagccccaactctcccaacccagcttgcgacccgagagaagtcgctcacacttctctttgggggagggcgacagttccggggaggacgcttggatcccgaaaatgacgggatccaggtcccacaaccctcaggaag

SEQ ID NO: 1213 - DNA, 33 bp, Homo sapiens
  misc_feature 1..33: note = chr15:60287643-60287676
  misc_feature 1..33: note = hyper
  source 1..33: mol_type = genomic DNA
cgagtccagtgcccgtgccggggagcattccag

SEQ ID NO: 1214 - DNA, 266 bp, Homo sapiens
  misc_feature 1..266: note = chr15:60295917-60296183
  misc_feature 1..266: note = hyper
  source 1..266: mol_type = genomic DNA
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctct

SEQ ID NO: 1215 - DNA, 18 bp, Homo sapiens
  misc_feature 1..18: note = chr15:60296600-60296618
  misc_feature 1..18: note = hyper
  source 1..18: mol_type = genomic DNA
cgctgccaccatccgcgc

SEQ ID NO: 1216 - DNA, 256 bp, Homo sapiens
  misc_feature 1..256: note = chr15:60297153-60297409
  misc_feature 1..256: note = hyper
  source 1..256: mol_type = genomic DNA
aggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggca

SEQ ID NO: 1217 - DNA, 809 bp, Homo sapiens
  misc_feature 1..809: note = chr15:68121149-68121958
  misc_feature 1..809: note = hyper
  source 1..809: mol_type = genomic DNA
cggttcattaaaacacgaatcattaaccggatgcgaaaggcgtcatttatgccgcggacggggcactggcgggagggaaaatgcctaaaaggaggcgggtgcagagggtggaggacactttgaacgcccctcggcttgggagccgctttgtgtttagagtaattttcccgagggcgctaacaattaccctgaatctacaagggggcaagggtgcgccgcgtgcgtcactgtgcccgctcaagtccagcgggcgcaccaacctttgccactccgtcggctttccctcttggccgcggggtagggctgggcgtctttgggccgccgcagggcgccaccctaatcgcctgtcatttctcggccgtcgcaggtgttcgcgcccgagagggatgagcacgtgaagagcgcggcggtggcgctggggcccgcggcctcctacgtctgcacccccgaggcccacggtaacgcctgtcgcggccgctggccactgtaatgggggaaccgcagacagagggccggggtcaaggaaggcctgcgaaggaagacaaggagagagacgcagagaaagagggagagggaaagaaaaataatgaaaacaaggaagctaagctagtactcccaacaacttccaatctttagttacttaaaaacaacagtgacaacgccctctccaccacacgcacacacatgctgcagtacacccagacacggcgttaaacccttaacaaaatcacgcccgacacggccttcaaatcctctcatttattcagcaagtgtgtttggccgcggggtcccctttggctaggccggat

SEQ ID NO: 1218 - DNA, 488 bp, Homo sapiens
  misc_feature 1..488: note = chr15:68125223-68125711
  misc_feature 1..488: note = hyper
  source 1..488: mol_type = genomic DNA
gattgaacttcttatcgcggcaatttccatggtttctaaattaaaaatcgaggcgtaaaattacctgggaagtaatgcctaagtttgctttaattttggttagatccatctgcctttaagcgccatcccaggccatttccttcctccgccagtctgcagttaggagctccggtaccccctcccccatccctggagttgtttctgcgcggagcttagccctggggagaggaggaagcccgggctgtgaccccggcctttcggagggtggtctgcgtttcctcactggcccctccccttgtcttccagataccctgtgtaacgaactcgaccaggagcggaaggcgcgctatgccatccagcagaaattgaaaggtgcggaagccgggaaacaaagataggaggggtgctgggtgccggccgtgctgtcgactgaatgaatgaatagtgggactagtgaggaaggccacgatccacgtggatcaggatct

SEQ ID NO: 1219 - DNA, 29 bp, Homo sapiens
  misc_feature 1..29: note = chr15:76627508-76627537
  misc_feature 1..29: note = hyper
  source 1..29: mol_type = genomic DNA
tcctaaaggtggaggcggagctcaaaagc

SEQ ID NO: 1220 - DNA, 251 bp, Homo sapiens
  misc_feature 1..251: note = chr15:76627575-76627826
  misc_feature 1..251: note = hyper
  source 1..251: mol_type = genomic DNA
cgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgc

SEQ ID NO: 1221 - DNA, 281 bp, Homo sapiens
  misc_feature 1..281: note = chr15:76629814-76630095
  misc_feature 1..281: note = hyper
  source 1..281: mol_type = genomic DNA
ctctcttcttagtttcgtgtttgcgtttagtttcaagacacgtcgacaaaacgactgtcattaatgaatgtaataacgaaatatttggggtgggggacagaagaaaccttcagcaatccacaagatactggtttttcgtttccaatgccctggacctttagagagctcatcatctttccttatggtcgcaagtcttgaaagaaagagcaagagagcgagcgggttgggttggggctggagtagccgaggccggcctgggtccgggcagtcaggcctgacgc

SEQ ID NO: 1222 - DNA, 29 bp, Homo sapiens
  misc_feature 1..29: note = chr15:76630096-76630125
  misc_feature 1..29: note = hyper
  source 1..29: mol_type = genomic DNA
gccccgcgcccttccccggcagagaagcc

SEQ ID NO: 1223 - DNA, 244 bp, Homo sapiens
  misc_feature 1..244: note = chr15:76630519-76630763
  misc_feature 1..244: note = hyper
  source 1..244: mol_type = genomic DNA
ggagccgtagcagccagggagatgagggcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccg

SEQ ID NO: 1224 - DNA, 900 bp, Homo sapiens
  misc_feature 1..900: note = chr15:79382098-79382998
  misc_feature 1..900: note = hyper
  source 1..900: mol_type = genomic DNA
cggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgcc

SEQ ID NO: 1225 - DNA, 258 bp, Homo sapiens
  misc_feature 1..258: note = chr15:79382999-79383257
  misc_feature 1..258: note = hyper
  source 1..258: mol_type = genomic DNA
agccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaactt

SEQ ID NO: 1226 - DNA, 67 bp, Homo sapiens
  misc_feature 1..67: note = chr15:79383317-79383384
  misc_feature 1..67: note = hyper
  source 1..67: mol_type = genomic DNA
cctgccctccctcccctcatctccccttctctccctcggatgttaaaaagcaaatcagatcaatttt

SEQ ID NO: 1227 - DNA, 81 bp, Homo sapiens
  misc_feature 1..81: note = chr15:79383438-79383519
  misc_feature 1..81: note = hyper
  source 1..81: mol_type = genomic DNA
cgccccaccgcggcgcactgtagacctggggttaagtgccagttgtcattttctcctccaaaggctcgcccccccccccca

SEQ ID NO: 1228 - DNA, 64 bp, Homo sapiens
  misc_feature 1..64: note = chr15:84115747-84115811
  misc_feature 1..64: note = hyper
  source 1..64: mol_type = genomic DNA
ttcttaaacatacaccgagcgaaaatgcgccggagggaggcgatgttgcctgtgagccaaagcc

SEQ ID NO: 1229 - DNA, 42 bp, Homo sapiens
  misc_feature 1..42: note = chr15:84115812-84115854
  misc_feature 1..42: note = hyper
  source 1..42: mol_type = genomic DNA
gttcggcaccaagacagaagcagagagaactgatctctctcc

SEQ ID NO: 1230 - DNA, 194 bp, Homo sapiens
  misc_feature 1..194: note = chr15:84115931-84116125
  misc_feature 1..194: note = hyper
  source 1..194: mol_type = genomic DNA
cgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcga

SEQ ID NO: 1231 - DNA, 42 bp, Homo sapiens
  misc_feature 1..42: note = chr15:84748578-84748620
  misc_feature 1..42: note = hyper
  source 1..42: mol_type = genomic DNA
gagtctcaggggctacgaacaaacgttttatccccgggtagc

SEQ ID NO: 1232 - DNA, 691 bp, Homo sapiens
  misc_feature 1..691: note = chr15:84748678-84749369
  misc_feature 1..691: note = hyper
  source 1..691: mol_type = genomic DNA
cgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgc

SEQ ID NO: 1233 - DNA, 492 bp, Homo sapiens
  misc_feature 1..492: note = chr15:88799507-88799999
  misc_feature 1..492: note = hyper
  source 1..492: mol_type = genomic DNA
cctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatc

SEQ ID NO: 1234 - DNA, 302 bp, Homo sapiens
  misc_feature 1..302: note = chr15:88800000-88800302
  misc_feature 1..302: note = hyper
  source 1..302: mol_type = genomic DNA
gagcgtcttcctcggctccctccctcccttcctccctccctcctcccctccctcgtcgcggcctcctccccccgccccccgcccgggctgggagcggcaggagagcggaatctccccctccctcccctccccacacccgtctctctccccgcctgtcctctccctcctccccacccacccacccacccactcgccggctcgcggctgtagccggcaccgccacccgcagcctcgcggcagcccgcccgctccacgcctcgcagcgcggcgcccgctagccgcagcccgggggaaaccgagac

SEQ ID NO: 1235 - DNA, 555 bp, Homo sapiens
  misc_feature 1..555: note = chr15:88800412-88800967
  misc_feature 1..555: note = hyper
  source 1..555: mol_type = genomic DNA
cgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagct

SEQ ID NO: 1236 - DNA, 289 bp, Homo sapiens
  misc_feature 1..289: note = chr15:89346038-89346327
  misc_feature 1..289: note = hyper
  source 1..289: mol_type = genomic DNA
agactcgcagctccccgtgagcctccccgctgacgccttacctccccctctccaccatcccctgccatcccggtgtacgccacccccaaaaaaactttcagccagctcctcggtgagggtcgttccaaatcgtggccgacagtagcgggctgcaccctccttagatcgcgtcgtggccagcctcagctgcagaaccccgccgggcgcccgggagccctgtcccgccgcggcggcctcagagtccgggcacttggggattctctgagggtgcagccctcctgggcccctc

SEQ ID NO: 1237 - DNA, 115 bp, Homo sapiens
  misc_feature 1..115: note = chr15:89346346-89346461
  misc_feature 1..115: note = hyper
  source 1..115: mol_type = genomic DNA
cgcaatgcagatgcgggccctccagcccttctcgcgccgccttcctcccgccagccccggagctgccgggtccgcgccgccccggggagcgctcctctcccgccctgagcgcagg

SEQ ID NO: 1238 - DNA, 383 bp, Homo sapiens
  misc_feature 1..383: note = chr15:89903431-89903814
  misc_feature 1..383: note = hyper
  source 1..383: mol_type = genomic DNA
cccacaagaatcatccgaggctgcaccgtgaccagcccctcaagacagagcgagacccaaataacccccgcgggcggacccgcagcgttctgtgactccaccgcggagtccaaaaggcagctgagggtgggagcggaggggaagggaggggggccacaggcgctcgggcgagggaggcgcgtcaatgggccgcaggggccggatcggtggcctaatggattcaggcctgcacggcagaggcgcacccggcggcctgcccgcgctctcaatagcggacaatggagtcccggggtgacctgaacaaagaatttggaagtagttaaactgcagaacacgttctcggcctgggtgcctcctttcaaaaggagcgctgggagaagaaa

SEQ ID NO: 1239 - DNA, 248 bp, Homo sapiens
  misc_feature 1..248: note = chr15:89922499-89922747
  misc_feature 1..248: note = hyper
  source 1..248: mol_type = genomic DNA
ggtaagagcccccctgactgggctgcccaccccgggcaggggcggaaacggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggcca

SEQ ID NO: 1240 - DNA, 326 bp, Homo sapiens
  misc_feature 1..326: note = chr15:89949616-89949942
  misc_feature 1..326: note = hyper
  source 1..326: mol_type = genomic DNA
cggccctccgcggcttgccagactgtcctgcaaaccacctcacccgtctctttggcgcaggagactcaggctgtaaccggagaaaacacttcaccctggaaccctaactcaggtcctggcaaaagatgcgagaggaagacttgctctcttaataaatctcggccgcccgcacatctggcccctagacctgctcggtagaggactggctggtggatgcgcggtccaggccgtgggcactcgacccacctctattttccttcccgaggcgcccctggattaccactttcggtttgcgcttacatccgggatgtcgaatttcccaggga

SEQ ID NO: 1241 - DNA, 126 bp, Homo sapiens
  misc_feature 1..126: note = chr15:89950355-89950481
  misc_feature 1..126: note = hyper
  source 1..126: mol_type = genomic DNA
ccccaggagtccctccgcccgctcccagtccgcaagcgcagaggatcctgcgctctgtcccccaaggtcttggcgtttgctgagctctctccgcgcgcgtcgaggagaggccgcctctcgtgagca

SEQ ID NO: 1242 - DNA, 308 bp, Homo sapiens
  misc_feature 1..308: note = chr15:89952145-89952453
  misc_feature 1..308: note = hyper
  source 1..308: mol_type = genomic DNA
tgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctc

SEQ ID NO: 1243 - DNA, 375 bp, Homo sapiens
  misc_feature 1..375: note = chr15:89952699-89953074
  misc_feature 1..375: note = hyper
  source 1..375: mol_type = genomic DNA
cgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggatt

SEQ ID NO: 1244 - DNA, 114 bp, Homo sapiens
  misc_feature 1..114: note = chr16:2040847-2040961
  misc_feature 1..114: note = hyper
  source 1..114: mol_type = genomic DNA
aacctctgggccagccgcacctcggcgcctgtcttggaggagggcggtgcccacggtggggcaggggctttggcctcccctgcggagtggctctgaccagaccgggaggcagga

SEQ ID NO: 1245 - skipped

SEQ ID NO: 1246 - DNA, 531 bp, Homo sapiens
  misc_feature 1..531: note = chr16:2040982-2041513
  misc_feature 1..531: note = hyper
  source 1..531: mol_type = genomic DNA
cacgtcccgacttgtggcccactcttggggacaagtgcatgtcccggcttcccccttggctccactctcggagctggagcgggaaaggagcgaagggatgaggttgaggctggaggtcgtttcttggaaacacagggctgccccgtgcagcgctggttaaaatgactgcggtccccctcatgcctgtctcccggaactggtgggcaggaggcattgaggtttgacggaacctcagaggtcaacggtgtcatcttttcagcccaaacacttacaggtgatattaataatcagtcacgtgggggctgtcatccctcgggtacccaccacgtgcaggaagctgggtggacatgtctgtcccagcactgcatgagctgtgcccgtcaccctatttgcatgctagaaaacaggccagacagttcccaaccgcgcaggaagcaacagctccgctgcctccataccctccctcccgccccgctctgcctgctgcactctcacctccccttcgccgttccggctccagcctgggaatcg

SEQ ID NO: 1247 - DNA, 619 bp, Homo sapiens
  misc_feature 1..619: note = chr16:2041581-2042200
  misc_feature 1..619: note = hyper
  source 1..619: mol_type = genomic DNA
cggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacc

SEQ ID NO: 1248 - DNA, 560 bp, Homo sapiens
  misc_feature 1..560: note = chr16:3221141-3221701
  misc_feature 1..560: note = hyper
  source 1..560: mol_type = genomic DNA
cgatgccagctctaggagcgtggccgggagcccacgatcgcggcagcgagaagcccaaccagaggggaggagggagtccccggagtgggacagcgctcaggtctggggtggggttgatctagggcaaaatagggcgggcggcctgtggcgatgggcaggaccctctcgcccaccacacgcggaactcgctggatcctctccacatccaggccgcgtccactggctttccaacctgctcaggtccttaaagaaggattcaaaaggtgttgcggtattggcccaacaggatttgaccctgaggcccactctcaccctaatcataaccgcaaaaccacagcgcctggagagagagtgagagagaaacagaaacggagcgagtgtgtgtcgctgtgatgccctttgccgtcgctgctcatccccagtgacctcctggaactttttcagctcttgctgacagaggaagacacgggggcagagctaacgtctgagtcagggcagaggcgctgggctccatccgagggaggctatgggggcgcctctgggatggagccaaccaccgg

SEQ ID NO: 1249 - DNA, 267 bp, Homo sapiens
  misc_feature 1..267: note = chr16:3221786-3222053
  misc_feature 1..267: note = hyper
  source 1..267: mol_type = genomic DNA
cgcagacccggtaaccccggcgcaggggaaaatacagcggggagccccaggctgcaggcctgaccctgagcatcccctaccaagcccagtgtggatgggctctgtctccaaggggctggttcaccagggtctccccgcagcgaccccagaattctgccaatcacttggggacggcgatgagctctatccacttcggaatcagccgatttgtgccggattggtggcaggtgtctgaaatgtcagcggaaatacacgcacgggaggctc

SEQ ID NO: 1250 - DNA, 15 bp, Homo sapiens
  misc_feature 1..15: note = chr16:3222113-3222128
  misc_feature 1..15: note = hyper
  source 1..15: mol_type = genomic DNA
cgagccctagaagtg

SEQ ID NO: 1251 - DNA, 376 bp, Homo sapiens
  misc_feature 1..376: note = chr16:3232641-3233017
  misc_feature 1..376: note = hyper
  source 1..376: mol_type = genomic DNA
tccgggatttgaacccgggacctctcgcaccctaagcgagaatcatacccctagaccaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccgg

SEQ ID NO: 1252 - DNA, 133 bp, Homo sapiens
  misc_feature 1..133: note = chr16:3233198-3233331
  misc_feature 1..133: note = hyper
  source 1..133: mol_type = genomic DNA
cgcttctcccgctccggtcctctcttctcccccagggaagccaaaacccagaaggtgagcttcccacgtggaacctcaattcaagaggctgacactgagcgtcgcttcgctccaccagacccgcggcgcccgc

SEQ ID NO: 1253 - DNA, 670 bp, Homo sapiens
  misc_feature 1..670: note = chr16:3233434-3234104
  misc_feature 1..670: note = hyper
  source 1..670: mol_type = genomic DNA
cgtccaggtgtcggttccggggcaccttttactgtcactctgtccttctctgtgtccaaatttcacccggagcccgagaattcggcaggtctggactgaaaacgtctccccatcccctccggatccaagcctcgaatttcctggctcagtgggaaggcctcggggtctgggcgtggagacggggcccgagacccccaccccgccagggcccactaaagtgctgccagctgagccccggccttcgcccctccttcgtctctccctcattcccctccctctgacaccccgccacatacattactccccgcaataccatgcaattttaagctagggtagggctcacctgagactggagccgccataccgtcgaaccctacgaaaaatttatgcccgtaaataaacaagcccggcgcattcttccttattctaaataacttcttcctgctgcacggggtcgtctcctttaaccacggctaccgcagttggtagtgctggatcccatttcagggtgatgggatgctggatcccatttcagggtgataggaccgaccgcaaggcgaacgattcaggcccgtccgtctgcgtcccgggaccccgggaggtctccactgacgccctgccagcagcaggctccctccgccttcctagtctcctgtccttgctgaaaatg

SEQ ID NO: 1254 - DNA, 196 bp, Homo sapiens
  misc_feature 1..196: note = chr16:3234164-3234360
  misc_feature 1..196: note = hyper
  source 1..196: mol_type = genomic DNA
cgcacccaaagcgagaatcatacccctagaccaacgagccgccgcttcccctctgttttgttgttgttgttgttgttttttgacacgtccttccgcccctgacgcagagcgagactctctccatcgccccaatagctcagtccttagcgcgcgcacctgcgaatctgggcttttgggttcgcggccaccctcagat

SEQ ID NO: 1255 - DNA, 164 bp, Homo sapiens
  misc_feature 1..164: note = chr16:3237900-3238064
  misc_feature 1..164: note = hyper
  source 1..164: mol_type = genomic DNA
gagtaaagcctgcctcggaaatctgagggtggccgcgaacccacaagtcaagattcgcaggtgcgcgcgctaaggactgagctattggggcgatggagagagtctcgctctgcgtcagggacggaaggacgtgtcccccaccagaaaaaggaaaaaaaaaaaaa

SEQ ID NO: 1256 - DNA, 1500 bp, Homo sapiens
  misc_feature 1..1500: note = chr16:3238124-3239624
  misc_feature 1..1500: note = hyper
  source 1..1500: mol_type = genomic DNA
ttgggtgcgagaggtcccgggttcaaatcccggacgagcccccttttccttctcttttttcccatttcgcattttcagcaaggacaggagactaggaaggcggagggaggctgctattggcagggcctcagtggagacctcccggggtcccgggacgcagacggacgggcctgaatcgctcgccttggtgaaatgggatccagcgctgccaactgcggcaactgcggttaaaggagacgaccccgtgcagcaggaggaggttatttagaataaggaagaatgcgccgggctcattggtcgctacaggggcataaattttttctaggattccagagtatggctgctccagtcccaggtgagccctcctccgcttaaaattccagtttattcggagaaggggagaataccggaagcgggggagaagggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcacttgaggccaggcaggcgctgcggggctggttcagtcgatggagaaaagagactctcagcgtcagcctttagggttcgaggcccacgtgggaaactcgctttctgggttttggcttccctggggagaagggaggaccggagccggagaagcgtgaggtgcggcgaggtagggtgcctggtagctggtgtctcgtgcactccgtcaggcctttattgaacacccattggtgccacgctgagggactgcagcgtttccaaggcgagcttgcagtgatcgaggctcgcagaccctcagcgcagccgctgcctgctattgggaggttcccatgtcctgcggaagctggagctcctcactgcgcgcctcggagacgccgaatccccaactcaaggccgagtggcggtggcgggcgaggacccagggcccttctggattgtggtagcgccagggctgctccccattttgtgcgtcgcggaggaggggccggggctctgggcttccgccacacccatcctcacttgaaattgccccttccaggcgggtctgaaataagattctactcactgggtcctgctgggtccgccccagccgcccccaggatgctaggacgcccacaaagataaccttaatgcgt

SEQ ID NO: 1257 - DNA, 164 bp, Homo sapiens
  misc_feature 1..164: note = chr16:3239684-3239848
  misc_feature 1..164: note = hyper
  source 1..164: mol_type = genomic DNA
gttcaaatcccggacgagcccggcttttggtgcagggtaaaagtcgtttcctgctcttttttagattcggctcgacttacagacctcagcgcaggacgtggacgccctgcaaaggtaatttgtacaaaggtctcaagctatgttgacgccgcctactatcccac

SEQ ID NO: 1258 - DNA, 143 bp, Homo sapiens
  misc_feature 1..143: note = chr16:22825327-22825470
  misc_feature 1..143: note = hyper
  source 1..143: mol_type = genomic DNA
tgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcag

SEQ ID NO: 1259 - DNA, 216 bp, Homo sapiens
  misc_feature 1..216: note = chr16:23846838-23847054
  misc_feature 1..216: note = hyper
  source 1..216: mol_type = genomic DNA
ggccacaagcctttccgaatgagtgacagcgggagcccatccctccaggagacgcgtgcagaatgaccaatgggatggatgggggtggatgggtaccagtctccgcagaggccggggtggaattcgctgcgccccaccccttccacccgctccccttcgccccgtaggtctttccactctcgctcctcccctgggcacatctcctgaacgcagccc

SEQ ID NO: 1260 - DNA, 15 bp, Homo sapiens
  misc_feature 1..15: note = chr16:23847310-23847325
  misc_feature 1..15: note = hyper
  source 1..15: mol_type = genomic DNA
cggcagcagctgggc

SEQ ID NO: 1261 - DNA, 186 bp, Homo sapiens
  misc_feature 1..186: note = chr16:23847326-23847512
  misc_feature 1..186: note = hyper
  source 1..186: mol_type = genomic DNA
agtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctg

SEQ ID NO: 1262 - DNA, 28 bp, Homo sapiens
  misc_feature 1..28: note = chr16:23847788-23847816
  misc_feature 1..28: note = hyper
  source 1..28: mol_type = genomic DNA
ggactcccggctccggaccctgctgccc

SEQ ID NO: 1263 - DNA, 58 bp, Homo sapiens
  misc_feature 1..58: note = chr16:23847817-23847875
  misc_feature 1..58: note = hyper
  source 1..58: mol_type = genomic DNA
ggactcccggatggacagtcctgccgttgccctgtccccaccctggtcccagacgggc

SEQ ID NO: 1264 - DNA, 70 bp, Homo sapiens
  misc_feature 1..70: note = chr16:23847933-23848003
  misc_feature 1..70: note = hyper
  source 1..70: mol_type = genomic DNA
cggcgtcgcgggagcctttgctccacctgactaggagcgcgcggggtctgtgcctgccctggagggcagc

SEQ ID NO: 1265 - DNA, 68 bp, Homo sapiens
  misc_feature 1..68: note = chr16:23848004-23848072
  misc_feature 1..68: note = hyper
  source 1..68: mol_type = genomic DNA
cctcgggtgctctccgacccggggttccctatctctccgcctgcttccgggcgcgaggagccctcgcc

SEQ ID NO: 1266 - DNA, 552 bp, Homo sapiens
  misc_feature 1..552: note = chr16:49315764-49316316
  misc_feature 1..552: note = hyper
  source 1..552: mol_type = genomic DNA
caaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcaggg

SEQ ID NO: 1267 - DNA, 87 bp, Homo sapiens
  misc_feature 1..87: note = chr16:55363136-55363223
  misc_feature 1..87: note = hyper
  source 1..87: mol_type = genomic DNA
ccctgcagggactaccgctgaactgtgcgccgtgcccgcggaggagcgagcctgtagtgcagtgccagtacccgtctggagcagaag

SEQ ID NO: 1268 - DNA, 610 bp, Homo sapiens
  misc_feature 1..610: note = chr16:56659128-56659738
  misc_feature 1..610: note = hyper
  source 1..610: mol_type = genomic DNA
ctatgtaaggaggtgcgggaccgaggaacctaggtgtggacagggacaggcaaggcgggggacgaagagaaatgaaagccacatcggtggcggatgttctgaacacaactcgctcgctaccgcacgttccccgctccgcactcagcggatcccgggacggcagcaggtgggctgcacacggactctgggacaagtcgagctgaaaaccgcggagctaggggtggggtggagacgcccgcgacgccaaggctggggtcccggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtg

SEQ ID NO: 1269 - DNA, 30 bp, Homo sapiens
  misc_feature 1..30: note = chr16:56672513-56672543
  misc_feature 1..30: note = hyper
  source 1..30: mol_type = genomic DNA
cgggtcctttgcgtccggccctctttcccc

SEQ ID NO: 1270 - DNA, 110 bp, Homo sapiens
  misc_feature 1..110: note = chr16:71459979-71460089
  misc_feature 1..110: note = hyper
  source 1..110: mol_type = genomic DNA
ctccgccgcttgcaccggacccaggcgctcatcccccgcttcccccgcgccccagcccggtcacgcctcggagcttgtccccacctggccgtgctcagagtctgcctgcc

SEQ ID NO: 1271 - DNA, 81 bp, Homo sapiens
  misc_feature 1..81: note = chr16:71460270-71460351
  misc_feature 1..81: note = hyper
  source 1..81: mol_type = genomic DNA
cgcacaagcccggggtgagaccagaagctgctgcctgcagagcccgaccttgcgtagatgactccgcgagtgcaaggggct

SEQ ID NO: 1272 - DNA, 56 bp, Homo sapiens
  misc_feature 1..56: note = chr16:86544502-86544558
  misc_feature 1..56: note = hyper
  source 1..56: mol_type = genomic DNA
cccaagggccttgggcggcccggcaagggccactactggaccatcgacccggccag

SEQ ID NO: 1273 - DNA, 364 bp, Homo sapiens
  misc_feature 1..364: note = chr16:86599480-86599844
  misc_feature 1..364: note = hyper
  source 1..364: mol_type = genomic DNA
cgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagt

SEQ ID NO: 1274 - DNA, 48 bp, Homo sapiens
  misc_feature 1..48: note = chr17:8868620-8868668
  misc_feature 1..48: note = hyper
  source 1..48: mol_type = genomic DNA
ctgaggacacagctgcgcagagccgcccagcagaggttacccggataa

SEQ ID NO: 1275 - DNA, 399 bp, Homo sapiens
  misc_feature 1..399: note = chr17:8868814-8869213
  misc_feature 1..399: note = hyper
  source 1..399: mol_type = genomic DNA
cggagcccactctccccgacggtccccagcttgctccagctctgcctggagctcccatgcgtgccctccgcatccgccctggccgcccagtcacacacctgcagtccccgccgggcgccgagcccctctccagcggcgactccctgcgattcgggtgaccgtcgggaccaccgcgccccagctggagccgcgcggcgagccgcagcatctgcccagcctgggctcctccggcgggcggggcggagcctgtcagggggcggggcctaatggggcggggctgaccgcggagccggcctctccagccacctggcggcccggcagcgtcagccaggtgcgcgcccggccccacatcctctgggtcacgcccccgaggccgcaaggcgtctgagaagcagcccc

SEQ ID NO: 1276 - DNA, 171 bp, Homo sapiens
  misc_feature 1..171: note = chr17:8869214-8869385
  misc_feature 1..171: note = hyper
  source 1..171: mol_type = genomic DNA
gctctgacccgccagccctcggaagaagcagaccctggccggtccatggcagtggcccgaggggcaccagcgcggagcaccagcgacccccaaggagtaaggggaggttaggcccccgcgtcggaagcgcggctttggccccgcaggagggctgggcggagcaggggggca

SEQ ID NO: 1277 - DNA, 434 bp, Homo sapiens
  misc_feature 1..434: note = chr17:8907294-8907728
  misc_feature 1..434: note = hyper
  source 1..434: mol_type = genomic DNA
ctcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgct

SEQ ID NO: 1278 - DNA, 22 bp, Homo sapiens
  misc_feature 1..22: note = chr17:8907776-8907798
  misc_feature 1..22: note = hyper
  source 1..22: mol_type = genomic DNA
cgggtgacggaggctttatcct

SEQ ID NO: 1279 - DNA, 15 bp, Homo sapiens
  misc_feature 1..15: note = chr17:10101095-10101110
  misc_feature 1..15: note = hyper
  source 1..15: mol_type = genomic DNA
actccggggtggaga

SEQ ID NO: 1280 - DNA, 317 bp, Homo sapiens
  misc_feature 1..317: note = chr17:10101131-10101448
  misc_feature 1..317: note = hyper
  source 1..317: mol_type = genomic DNA
cggtgccactttctcgcacccctgatcctccgtgcctcttcccaagaccgccagacccttcaccggcccctgccactgccgggaacgctcccgcctgctccttaactcacacaggcaacaagttctcgcttcctcagagcagccacggtgtgctccggaggcccggcgcaaggtggaagctccccgcgagtccgcgttgcccacgccccgaggggcgcccgctgccgtcgctgccccccaggagcgtggagctacaggtagcgccggcaagggctgccccccggggcgcccctccgaccgggacgctgcggcatccc

SEQ ID NO: 1281 - DNA, 118 bp, Homo sapiens
  misc_feature 1..118: note = chr17:31618291-31618409
  misc_feature 1..118: note = hyper
  source 1..118: mol_type = genomic DNA
gttctgccttggcatcgtggagtggtaacactgcaagaggcctggggacagccccgagggggcggaacaccaggcctcctgactgccggggagtggggcgcagagggagcgggttcgc

SEQ ID NO: 1282 - DNA, 344 bp, Homo sapiens
  misc_feature 1..344: note = chr17:31618410-31618754
  misc_feature 1..344: note = hyper
  source 1..344: mol_type = genomic DNA
cggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaact

SEQ ID NO: 1283 - DNA, 228 bp, Homo sapiens
  misc_feature 1..228: note = chr17:35297936-35298164
  misc_feature 1..228: note = hyper
  source 1..228: mol_type = genomic DNA
cggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcc

SEQ ID NO: 1284 - DNA, 259 bp, Homo sapiens
  misc_feature 1..259: note = chr17:35299185-35299444
  misc_feature 1..259: note = hyper
  source 1..259: mol_type = genomic DNA
acagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccc

SEQ ID NO: 1285 - DNA, 89 bp, Homo sapiens
  misc_feature 1..89: note = chr17:35299600-35299689
  misc_feature 1..89: note = hyper
  source 1..89: mol_type = genomic DNA
gctggtggaccgcctggagccgggcgagctcatccccaatggtcccttctccttctacggaggtgggtgcgcgccgaatggcggggcac

SEQ ID NO: 1286 - DNA, 56 bp, Homo sapiens
  misc_feature 1..56: note = chr17:35299910-35299966
  misc_feature 1..56: note = hyper
  source 1..56: mol_type = genomic DNA
cccgcgagggctccccgcgatccgcgagttccccgcgtggccttcctcagcccgcc

SEQ ID NO: 1287 - DNA, 453 bp, Homo sapiens
  misc_feature 1..453: note = chr17:35300260-35300713
  misc_feature 1..453: note = hyper
  source 1..453: mol_type = genomic DNA
ggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatc

SEQ ID NO: 1288 - DNA, 30 bp, Homo sapiens
  misc_feature 1..30: note = chr17:35300812-35300842
  misc_feature 1..30: note = hyper
  source 1..30: mol_type = genomic DNA
cgtggggagggaggccgtgagcacagccgg

SEQ ID NO: 1289 - DNA, 210 bp, Homo sapiens
  misc_feature 1..210: note = chr17:35303325-35303535
  misc_feature 1..210: note = hyper
  source 1..210: mol_type = genomic DNA
acaacgtggttgtggcgcagtctctcccctcgtcgcgggattcagaatcctggcgaaaacccgaacaggtggcaacgctcagcagtcaaatttggagccgaaggccccaaggaggaggcctggaaatgtcagggcctgttctccttcccatcagtgctgtgccgcccacctctggccccgaggtgcggggacgtgcggcaccatacctag

SEQ ID NO: 1290 - DNA, 423 bp, Homo sapiens
  misc_feature 1..423: note = chr17:37381007-37381430
  misc_feature 1..423: note = hyper
  source 1..423: mol_type = genomic DNA
gcaggcccccgtcctcgcccgtgaccgacggccggcgctgctgcaggccccctcgcggactccgcagctgcgcacccccggccgcggcctcgcgtccccgagcccaacagggctaggagcggggaatgcaggactgcggaggggcagggagagacgccctgagacgcggagataaacacccggagacgccgggagagacggggagagacgcacacagagacaccaagacacagacacgcaggttgtagagacaaattcagagacacgagcgaggatagaggcgcggactgagcccgggactgggacccggcggccgctggagggtgcgcctcgcacgcacagccgggcgcgtaccccgcccgcaccgctccacgcgcgccctccggcctcgctgcgcccatctctccaacgaagaccagtggc

SEQ ID NO: 1291 - DNA, 157 bp, Homo sapiens
  misc_feature 1..157: note = chr17:37381570-37381727
  misc_feature 1..157: note = hyper
  source 1..157: mol_type = genomic DNA
cgcgaccctaggacgcccgggcccacaggaggaccccgccgggaagagggcgcccgggcccggggcgcggacaggccttgcgccccccaagttaccttggtttcctggagggcggagacggtccctggggggctgtgggtggccgcgtcatccggtt

SEQ ID NO: 1292 - DNA, 292 bp, Homo sapiens
  misc_feature 1..292: note = chr17:37381825-37382117
  misc_feature 1..292: note = hyper
  source 1..292: mol_type = genomic DNA
cgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccg

SEQ ID NO: 1293 - DNA, 466 bp, Homo sapiens
  misc_feature 1..466: note = chr17:42635294-42635760
  misc_feature 1..466: note = hyper
  source 1..466: mol_type = genomic DNA
tgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgtt

SEQ ID NO: 1294 - DNA, 96 bp, Homo sapiens
  misc_feature 1..96: note = chr17:43047752-43047848
  misc_feature 1..96: note = hyper
  source 1..96: mol_type = genomic DNA
cgcagagccctccgggcacaccgcggctggccgcccggggccaaggatggggcgggagcgcccacccacccccgcgccggccggggcatccaagag

SEQ ID NO: 1295 - DNA, 324 bp, Homo sapiens
  misc_feature 1..324: note = chr17:46655070-46655394
  misc_feature 1..324: note = hyper
  source 1..324: mol_type = genomic DNA
ctgaaaacaggcgaccgtaaatctccggcaatggcgagtttatagcggggacaattggcttccccagctcaacccccccccaacccatgcctccgaagtccctttggtgtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggc

SEQ ID NO: 1296 - DNA, 24 bp, Homo sapiens
  misc_feature 1..24: note = chr17:46655395-46655419
  misc_feature 1..24: note = hyper
  source 1..24: mol_type = genomic DNA
gcgcaggagcccgaggggacagac

SEQ ID NO: 1297 - DNA, 111 bp, Homo sapiens
  misc_feature 1..111: note = chr17:46655450-46655561
  misc_feature 1..111: note = hyper
  source 1..111: mol_type = genomic DNA
cggaggcggcgggggcccagggtcccggcaggccgcgtagcgctgcacggtgcacgccgcgcgccgcccgaagcccgcctccggctggaagctgctctctcgcctctggcc

SEQ ID NO: 1298 - DNA, 437 bp, Homo sapiens
  misc_feature 1..437: note = chr17:46655562-46655999
  misc_feature 1..437: note = hyper
  source 1..437: mol_type = genomic DNA
ccggcgtagtacccgggcgagtggtcgctgggtaggtaatcgctctgtgaatattcctcgcatggagggaacttggggtcgacatagtttgagttgatcaaaaaagaactcatagccattaatttctgggaattgcccacaaaatatactaaaatttattccgacccctgactcgttttcctgtttccgaaagccctcctacttactgtcaagtgaacaaagttaggcgcccacgtgatcctccgagccaatggccgccccgcctgcgattcccggataaggaaatctgctcacccggaccccactccagccaaagaggtttatttccccttcttcccttccccctccccacccacccacccaacaccaggatttacatagggctcctgcggggcgaccccctccttgcctcgctctctccgggatcagagagagag

SEQ ID NO: 1299 - DNA, 341 bp, Homo sapiens
  misc_feature 1..341: note = chr17:46656057-46656398
  misc_feature 1..341: note = hyper
  source 1..341: mol_type = genomic DNA
cgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgatag

SEQ ID NO: 1300 - DNA, 938 bp, Homo sapiens
  misc_feature 1..938: note = chr17:46795436-46796374
  misc_feature 1..938: note = hyper
  source 1..938: mol_type = genomic DNA
ctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagcaatgtagatgtgatctcgtttgctctgaatcgaattccacagaaaccgctgtgccgaatactgcaaatccttaactttcataaacgccggcaccgaactcaacgcaaaactacccaagtgccaaagaccatttctgggaagctcattccatgagaccttcgcatttttccaaatcaaaggcttcccttcggatctaattatttctcctctacagggctgcgggagggggaggggatgtgagactagggcaacagattaagattgaaagtcctttctcgcagcttcattttcgcccccacactgtcccaaatgcttagaaccctcctcgtcagaatgggaacggtgcccccgcttgtcctaaaagacacagaccaggtccgtgaacttgacccaggcgcccacgcctcttttccccgaaggtcagacaaaggcagaagggttggctggattctttcccgggccgcgaaggcctggggatcgcaagttgaggaggagaagaccgcaaacccctttggttcaagcaagctctgcggcaggtaaaaggcaaattggtggggacgggtaggacagggagagcattatctggctaactcccgcaggcctcttccgatttgtcggcggggacctgactccctgcggtgtctctggccccaaatacggaggccaggagcttttcgttgtctcgcccgatttggtatcttattagccggtgtcgctgagccgcgggggactcc

SEQ ID NO: 1301 - DNA, 55 bp, Homo sapiens
  misc_feature 1..55: note = chr17:46796498-46796553
  misc_feature 1..55: note = hyper
  source 1..55: mol_type = genomic DNA
ggagatcgagtgtttgatcttcccttgctccaggatcctgaattctttaaacaca

SEQ ID NO: 1302 - DNA, 25 bp, Homo sapiens
  misc_feature 1..25: note = chr17:46796613-46796638
  misc_feature 1..25: note = hyper
  source 1..25: mol_type = genomic DNA
cagcactactaccgtctgagcaggc

SEQ ID NO: 1303 - DNA, 606 bp, Homo sapiens
  misc_feature 1..606: note = chr17:46802306-46802912
  misc_feature 1..606: note = hyper
  source 1..606: mol_type = genomic DNA
tccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccac

SEQ ID NO: 1304 - DNA, 117 bp, Homo sapiens
  misc_feature 1..117: note = chr17:46802993-46803110
  misc_feature 1..117: note = hyper
  source 1..117: mol_type = genomic DNA
cgtggagaatgcgccggcaggccccccacccccagcctaaggtgcaggaaggaccagcacgaacccgctggctttgctgcgcggccaggagatgagtcccaccgggcactgagccca

SEQ ID NO: 1305 - DNA, 318 bp, Homo sapiens
  misc_feature 1..318: note = chr17:46804107-46804425
  misc_feature 1..318: note = hyper
  source 1..318: mol_type = genomic DNA
ggacacccccactttcgctcctcccacccaggcaaggagatctcttaaggggtagcgctgttcttcaccttggcgagaaccttcttctctttgacccggcggttctgaaaccagatggtaatctggcgctccgagaggctggtggctgccgagatcttgcgcctcttgtccttggtgatgaacttgttagccgcatactcccgctccagctcccgcaactgccccttgctgtacggaatgcgtttcttgcggccgcgacgaaaggcgcaggcgtcaggagggtgctgcccgctggagtctgcgcggcgtgaaagggag

SEQ ID NO: 1306 - DNA, 347 bp, Homo sapiens
  misc_feature 1..347: note = chr17:46824568-46824915
  misc_feature 1..347: note = hyper
  source 1..347: mol_type = genomic DNA
attcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctc

SEQ ID NO: 1307 - DNA, 469 bp, Homo sapiens
  misc_feature 1..469: note = chr17:46824916-46825385
  misc_feature 1..469: note = hyper
  source 1..469: mol_type = genomic DNA
gcccgcgggcttcctcaccaaatccccaaaaaccgacgcaggcacagagggctgactgtgttttgagtaatgcacgcgaggcagtccaatccggcgagatggcccgaagcggggcccagcggtcgggggtgtgggtctggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcccgccggccaagtcgccgccgaaacaggatctcctaaagcgggctccaccgggtcccagggcgaaaaggtccgaagatctacgctgtcggaaagacctggag

SEQ ID NO: 1308 - DNA, 502 bp, Homo sapiens
  misc_feature 1..502: note = chr17:46831824-46832326
  misc_feature 1..502: note = hyper
  source 1..502: mol_type = genomic DNA
agcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctc

SEQ ID NO: 1309 - DNA, 150 bp, Homo sapiens
  misc_feature 1..150: note = chr17:46832489-46832639
  misc_feature 1..150: note = hyper
  source 1..150: mol_type = genomic DNA
cgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctc

SEQ ID NO: 1310 - DNA, 177 bp, Homo sapiens
  misc_feature 1..177: note = chr17:47075225-47075402
  misc_feature 1..177: note = hyper
  source 1..177: mol_type = genomic DNA
ccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctcc

SEQ ID NO: 1311 - DNA, 239 bp, Homo sapiens
  misc_feature 1..239: note = chr17:48042409-48042648
  misc_feature 1..239: note = hyper
  source 1..239: mol_type = genomic DNA
aactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctaggg

SEQ ID NO: 1312 - DNA, 206 bp, Homo sapiens
  misc_feature 1..206: note = chr17:48042750-48042956
  misc_feature 1..206: note = hyper
  source 1..206: mol_type = genomic DNA
cggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaatccctgcgcctcggcccaatccctag

SEQ ID NO: 1313 - DNA, 1027 bp, Homo sapiens
  misc_feature 1..1027: note = chr17:48049499-48050526
  misc_feature 1..1027: note = hyper
  source 1..1027: mol_type = genomic DNA
agaacagaaacccctcggcccaaccctcccctgtccctcagcattctagggctgggctgtcccgcggccgagattcctggagagctaggcgggccagagctgaccagatcccccgcggcggcaccgcagcgcgatccaggagtggccccgccgggctacgctgcgcgctcttggaacccgggtcaccttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcccaccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctact

SEQ ID NO: 1314 - DNA, 414 bp, Homo sapiens
  misc_feature 1..414: note = chr17:59478133-59478547
  misc_feature 1..414: note = hyper
  source 1..414: mol_type = genomic DNA
aacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccga

SEQ ID NO: 1315 - DNA, 275 bp, Homo sapiens
  misc_feature 1..275: note = chr17:59528876-59529151
  misc_feature 1..275: note = hyper
  source 1..275: mol_type = genomic DNA
atctcaaggagctgccgcggaatcctggccctgggccgcagtttccccaggaggctctgccaagcctggcaccttgcagcccggcctgggctctgtcaaggcccgagccggactcggctccactcagaggccggcccagcacttccctgccgccgccgccccgcacccggccaccgggcttcctcccagtcctcacccctgacctccgcggccgacttcgaggcgcgccaggccgggtccagcgcccgcggccccctgggccgggacaaggaggg

SEQ ID NO: 1316 - DNA, 12 bp, Homo sapiens
  misc_feature 1..12: note = chr17:59529253-59529265
  misc_feature 1..12: note = hyper
  source 1..12: mol_type = genomic DNA
cgacctcgggac

SEQ ID NO: 1317 - DNA, 233 bp, Homo sapiens
  misc_feature 1..233: note = chr17:59529843-59530076
  misc_feature 1..233: note = hyper
  source 1..233: mol_type = genomic DNA
cggagtcggagccccggccgtcccgcgctcctcggacccgaacctgcaggggacctcgggccgctggcgcctccgcatgcggcaccgcaattagggtgagtgtgggttccagccgagtggggacgagctgggcgtgcggggctggggccacaggggctcagggttaggctgcggggacggacaggaggatgagctggaaaggggtgagtcacgcgacccggggaagaacttca

SEQ ID NO: 1318 - DNA, 170 bp, Homo sapiens
  misc_feature 1..170: note = chr17:59533874-59534044
  misc_feature 1..170: note = hyper
  source 1..170: mol_type = genomic DNA
cgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggc

SEQ ID NO: 1319 - DNA, 66 bp, Homo sapiens
  misc_feature 1..66: note = chr17:59534340-59534406
  misc_feature 1..66: note = hyper
  source 1..66: mol_type = genomic DNA
ccagctccaacaacccgtagagggcctgggacccaacggcgagggggcaggaggaggccaccccgc

SEQ ID NO: 1320 - DNA, 225 bp, Homo sapiens
  misc_feature 1..225: note = chr17:59534556-59534781
  misc_feature 1..225: note = hyper
  source 1..225: mol_type = genomic DNA
cgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagcca

SEQ ID NO: 1321 - DNA, 21 bp, Homo sapiens
  misc_feature 1..21: note = chr17:70113546-70113567
  misc_feature 1..21: note = hyper
  source 1..21: mol_type = genomic DNA
cttccacaagaaactcgtgtc

SEQ ID NO: 1322 - DNA, 372 bp, Homo sapiens
  misc_feature 1..372: note = chr17:70113647-70114019
  misc_feature 1..372: note = hyper
  source 1..372: mol_type = genomic DNA
cggggacctgtccctccagggataggagtcttctacctgcaagggacccggcctggggaactggaatagacaaggggtaaccccttctcccatcacctctaatgagaacattgtccggggctgagatatttgggggacgccgctgctcaccccaccaaactttccctagggacagaaaagcgtccctaccgaaaacggatttaaacaccgtccccacttttgctaaggaagtttggatagggaggttgtggtccttaattcgccaggtaaaaggaaccccatcagctcgcatccctcacccccatcctgagcactgagtgtttgcgagaaactcgccctgcgccagcaactctgggctccggtctcagctcc

SEQ ID NO: 1323 - DNA, 365 bp, Homo sapiens
  misc_feature 1..365: note = chr17:70114152-70114517
  misc_feature 1..365: note = hyper
  source 1..365: mol_type = genomic DNA
cgcacctctgtgtctccgctcccggcggcagacctcgcggcgcttgctcaagagcgggtatccgaaagcacgtcccgaacacggagaagcgccctccgtctcctgcctcgtgacctgcgccctttccctccctcaccgcatcagatggaggaccctggctcctttcgcccctggcaaaatgctctagccaacactgggtcaacagccttagtttccagatctgtaacctgaacatcaggagcgggttcctttccttctacctgtgtctgaggtcctctggtcggggactgcgcgcgtcttcccaggtcagggaggaggggtcggggcgacctgagaaagacacaacgaagcgaatggagcccctg

SEQ ID NO: 1324 - DNA, 640 bp, Homo sapiens
  misc_feature 1..640: note = chr17:70215667-70216307
  misc_feature 1..640: note = hyper
  source 1..640: mol_type = genomic DNA
ccagggcagcagacacgctctcccaaaggggcggacacagacgtcctcacaccgcggcccgaccggccgcacattaatccgggtggatttggccatcttgtgacatagccaatcagttcgagggaggggacggcaggaacgcctctcctttcacgccacaaaaggattttcgtcccttgagagcacaatgaaaaaaaaaaaaaaaaaaagccaatcaaggcgggatcagctgtgggctggtcgctgcagatctgtctctcccagaggggggtgggggcacatattggtccgtgtgggaaacccagagcctcagcttctcacacattgttctcctcctcttcaactgcaccccctccccaccagcccggaccctcccctctcccctccccaaagccgttattgccacaaaagatactttccccattgtgccccggacagctgagaggtccgagttagccatacacagctccgcgtcctctccagggagaaaggggatggaccctgcaagtggagagcgggatgcttatcatacaaaggaattaaacccacttgggctctctcgccatccaggactgtggggggttaaatacggttacattttcattaggtgctaatagcagaagggcagccccgggcagca

SEQ ID NO: 1325 - DNA, 54 bp, Homo sapiens
  misc_feature 1..54: note = chr17:70216392-70216446
  misc_feature 1..54: note = hyper
  source 1..54: mol_type = genomic DNA
cgtcaaagccgggtccagggaaggggggcatgccatgggcgtattgttggcctg

SEQ ID NO: 1326 - DNA, 38 bp, Homo sapiens
  misc_feature 1..38: note = chr17:74072998-74073036
  misc_feature 1..38: note = hyper
  source 1..38: mol_type = genomic DNA
cgtcgacccggtggccgcgggctcgggtgcccggcgcg

SEQ ID NO: 1327 - DNA, 18 bp, Homo sapiens
  misc_feature 1..18: note = chr17:75369440-75369458
  misc_feature 1..18: note = hyper
  source 1..18: mol_type = genomic DNA
gcctaggggctcctccgg

SEQ ID NO: 1328 - DNA, 228 bp, Homo sapiens
  misc_feature 1..228: note = chr17:75369492-75369720
  misc_feature 1..228: note = hyper
  source 1..228: mol_type = genomic DNA
cgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgag

SEQ ID NO: 1329 - DNA, 324 bp, Homo sapiens
  misc_feature 1..324: note = chr18:12307602-12307926
  misc_feature 1..324: note = hyper
  source 1..324: mol_type = genomic DNA
cgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcgg

SEQ ID NO: 1330 - DNA, 350 bp, Homo sapiens
  misc_feature 1..350: note = chr18:13868570-13868920
  misc_feature 1..350: note = hyper
  source 1..350: mol_type = genomic DNA
gtccaggatgctcagcgtgggcctcggagtctgtgtgcgatcagctggagtccaggatgctcagcgtggacctcggagaccgtgtgggctctgcgctctgcagctgagacacagtcacccgcccgatgggcggagaaaggggcagctttgaaaacaagcgcaaggagatgcatccaaaagacaaccgaacccatcagggtaaggagcgcagcggtggagtgtgagggggaaccagaagggcggccagggccggcggcatgccatgccaggcagccccgcgccaccccggaacactgggacactctcatattcccaaagggacttctccatgcggcgctctgaccaggcat

SEQ ID NO: 1331 - DNA, 526 bp, Homo sapiens
  misc_feature 1..526: note = chr18:31739116-31739642
  misc_feature 1..526: note = hyper
  source 1..526: mol_type = genomic DNA
tggcagggagaaaggcgccctccaccctgtcagcctcctcctcgcctcccccgacctgcaggcgcgctaagcgctccgggcgccgcgctccgcgagggggagcagtgctcccaacccgcgaccctccgcctcagacatcacagttgccgcggcaacggccggaggaggaaggccaaggcttttctcccgctgacgtcccccgccaccagtacccagagtgctggggcctggatgagatctgcgtccgcttcacccgagcatgagcttgggtctctcggaggagcaggagacgcgggctcgaagccgcgggcctgaccctgatccgtggatgccgccgccgccttctcctcccctgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacc

SEQ ID NO: 1332 - DNA, 262 bp, Homo sapiens
  misc_feature 1..262: note = chr18:44336188-44336450
  misc_feature 1..262: note = hyper
  source 1..262: mol_type = genomic DNA
tggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggc

SEQ ID NO: 1333 - DNA, 164 bp, Homo sapiens
  misc_feature 1..164: note = chr18:44337012-44337176
  misc_feature 1..164: note = hyper
  source 1..164: mol_type = genomic DNA
cgatagggacggggggagggggcgtacaaaacacccgcgcagtctggctaatgataggcgggccgtggggagggggaggggcggagcgcaaaacgccgggtttgaatcttggaattaaaaagagggcaggggctgggcgcggtggctcactcctgtaatcccag

SEQ ID NO: 1334 - DNA, 202 bp, Homo sapiens
  misc_feature 1..202: note = chr18:44337416-44337618
  misc_feature 1..202: note = hyper
  source 1..202: mol_type = genomic DNA
agactccgtctcaaaaagaaaaaaaaagaaaaaaaagagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaagga

SEQ ID NO: 1335 - DNA, 193 bp, Homo sapiens
  misc_feature 1..193: note = chr18:44337649-44337842
  misc_feature 1..193: note = hyper
  source 1..193: mol_type = genomic DNA
cggggctgcctgcccgtgccccggcgcccaactcctacaaggaagaaattcaggggctccccgcccccgccacagtcctcttccccctccccagctgcaactcggcagccgttcgtcaaagaccctgttgtcaccgagacactgggaccttgtctcatccttggaaccactcgtaaatcttaggtcaggcagc

SEQ ID NO: 1336 - DNA, 140 bp, Homo sapiens
  misc_feature 1..140: note = chr18:44772977-44773117
  misc_feature 1..140: note = hyper
  source 1..140: mol_type = genomic DNA
gtgaactgggctgcccgggctgctgctgccgccgccactcgccttctggggggccaggggcggcggcgggggcgggggcaggtccgagccggggtccccgagtttcccgtcttcctgcagcagcctggaggagttcaggc

SEQ ID NO: 1337 - DNA, 501 bp, Homo sapiens
  misc_feature 1..501: note = chr18:44773466-44773967
  misc_feature 1..501: note = hyper
  source 1..501: mol_type = genomic DNA
cggcggggccgggtggtggcgctcggaacccggctcgtcgggctgcgggggcagcagcagaagcggcgacggcggctgcggggggtggtggtggtggtggtggtggtgagggtggtgatggtggtggggatgcgtctgggccgagtggggcgcgcccgccgacgccccgtgcagcttggccaggctctccgcgtcgtccttgccgcccactggccggaaggcgctggaatggtggtagctgccaccgcccgctttgcgcccctccagaaggtgcggatggtggggcgccggaacccgggagcccgcggggccagacccggcggccgcggcccctgccccggcagctgccacagagtccgcgggcggcgtggagcccgcgctgcagtccccgccgctgccgcccgggggcgactcgaagagcgcgtcgcgagagccggcgcccccggcaggaggaggtgggccggagcccgggccgttggccactacctgcgggggctgccc

SEQ ID NO: 1338 - DNA, 609 bp, Homo sapiens
  misc_feature 1..609: note = chr18:53446866-53447475
  misc_feature 1..609: note = hyper
  source 1..609: mol_type = genomic DNA
aaatgccaggagccccgggggtgtgatgtttccggtggataatgtctcccgttccctgccccggggcccagacagttggtgcttaagcgtctacaatgtagagtttcctgcattttcctcgggccgccatttgtctacttgtcccatccaggacatctccctaaataatctctaagtggaaaaatcacggtcctctaggagatttatccgggaacgaacgtgcgtggggcagttcaaattcctgagctcagatttcgtttcccgcggtcagatggtgcggtcggtggggcccgagggatgcgcacagctgtgcctgagaggtgctgctctcccgccaccgaagtcgctgggaaattctgctgcactgagacattttaatgtcggatgttctaatcctgcgggcaaaaaaaaaaaaaaagtttgaaccaggtactgggcttttgtcacggtgaaccccacccgcgccccgcgccgtcccttcattcactcaggcgaggtggcttggatttgcacctcgttgaagaagcctcccatgcgacatctccgccagcaccccgcgcggacttggctgggcggcggcggggagtcagcttgtcaccgcacggcggc

SEQ ID NO: 1339 - DNA, 57 bp, Homo sapiens
  misc_feature 1..57: note = chr18:53447798-53447855
  misc_feature 1..57: note = hyper
  source 1..57: mol_type = genomic DNA
cgccggctactcagctggccccgcagcttccctgcggctcagcggcctcccacccag

SEQ ID NO: 1340 - DNA, 154 bp, Homo sapiens
  misc_feature 1..154: note = chr18:56939498-56939652
  misc_feature 1..154: note = hyper
  source 1..154: mol_type = genomic DNA
aaatgcatggacacccgtgaattccgagaagcattggctgcaatttgggcctcgggccctcccagatcccagttcctcaacctgggcgctttacctggacccggacctctggtaggttgaccttgccggccagctcctcgcggctgtacacgtc

SEQ ID NO: 1341 - DNA, 408 bp, Homo sapiens
  misc_feature 1..408: note = chr18:56939763-56940171
  misc_feature 1..408: note = hyper
  source 1..408: mol_type = genomic DNA
cgcttcgccggtggctggcccgacgggcagccctgggctcggccgtgcctccccgggctccttggggcagtagggtcgaggggctggggcgacgaggcccgggagggtcagatgcactccccaaaacacccttgggccgaccccgcctcgctgtgggcactggccagcccgcctgcgggctccgagatggcccggggaggtccgtggtgagggcggcgatgggtcctaagctttctctgaatgcaaattggaagctcccgccatagacggtccccaaccccgcgcccagttgccttaataaaagttaaggaaggggcgctctcgtctggccaactcctaagctcgggcgcccgaacggcctcgcacagccaggggtgcgcactcaccttcgtactcgggggcgggcgc

SEQ ID NO: 1342 - DNA, 680 bp, Homo sapiens
  misc_feature 1..680: note = chr18:56940565-56941245
  misc_feature 1..680: note = hyper
  source 1..680: mol_type = genomic DNA
gcccgggctgcgcacgctgggggtggccgagcgctcagcccgctgccgccttagtcccagaagtcggaagttcgggctcggggtagctggggctctcggcgctaaaggcggggagccaactggccctcggctcctcccctctcgccctggacccagccccttctctcggcccctccctccacagaggggcgtgtcctcacccggcccagccacagggtcctctagtggccacccctgggccggcactaggaatattccccttccacctcttgatccgttttaagctttacaaacacactccggggatccgcggcgggatgcctgatgggctcgggaacctggtcgcggcgcacccctagtcctgcctcagtggggccgacgcccttgggctcatctctccccttgcgtttgtctccctctacttcgggcttaccctctcacttcagactaccccctgggggtcacctccctccttggacgcacccctccccagcttcagactcgcccctctagccccctctggctcacctccgcggggccgccaccctggcctgtgccccctggaagcgccgagacccagccgaaggcttcccagccccgcactcgtcgcagtttgaatttcccctcgctggctcccttttcgggacccactcctttcttggctgggttgtacgaagtcc

SEQ ID NO: 1343 - DNA, 240 bp, Homo sapiens
  misc_feature 1..240: note = chr18:56941557-56941797
  misc_feature 1..240: note = hyper
  source 1..240: mol_type = genomic DNA
gggccaaggagatggcccagagctggctggggaaggaccttctcccggggaagaggcctctcgcctccccgagggttcaggagtaattggcttgcagttctttctcctttggaccccctcgaggcttccgtggcccacagtgactgatcggccacttggaaagatgattggatagggtgagtgtgtttcacctccagcagcgcggatggacaatggcgctgtgaacgtctcacccctcaa

SEQ ID NO: 1344 - DNA, 182 bp, Homo sapiens
  misc_feature 1..182: note = chr18:70535373-70535555
  misc_feature 1..182: note = hyper
  source 1..182: mol_type = genomic DNA
tggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatc

SEQ ID NO: 1345 - DNA, 80 bp, Homo sapiens
  misc_feature 1..80: note = chr18:70535575-70535655
  misc_feature 1..80: note = hyper
  source 1..80: mol_type = genomic DNA
cgcagagagaggatgcagccgcaaatcccgagccggatcctcgtgccggacggaaggcgtggaagcgggaggggccttcg

SEQ ID NO: 1346 - DNA, 78 bp, Homo sapiens
  misc_feature 1..78: note = chr18:77547970-77548048
  misc_feature 1..78: note = hyper
  source 1..78: mol_type = genomic DNA
ccgggggaggcgggacgcaggcgaaggccgccccgggagagcggggtcccgggagagcggggtcccggctgtggggga

SEQ ID NO: 1347 - DNA, 258 bp, Homo sapiens
  misc_feature 1..258: note = chr18:77548351-77548609
  misc_feature 1..258: note = hyper
  source 1..258: mol_type = genomic DNA
ggcaggcccagctcggacgaggctcagctgccgcccccgttgcctttgtgggtttttctgcggaagccccttttcctcgggtggatgggaccctgcgcgtggaaccccgcacagcccccgctccgccgcgggccgcaggacccattccttctccacggtggcgctggggaggggctgcttccacccaggagattcgcgagggagagaaaacatgcggctcacatccggacggcagccccgccccgcttagaaacaata

SEQ ID NO: 1348 - DNA, 415 bp, Homo sapiens
  misc_feature 1..415: note = chr18:77557982-77558397
  misc_feature 1..415: note = hyper
  source 1..415: mol_type = genomic DNA
ggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagc

SEQ ID NO: 1349 - DNA, 726 bp, Homo sapiens
  misc_feature 1..726: note = chr18:77558416-77559142
  misc_feature 1..726: note = hyper
  source 1..726: mol_type = genomic DNA
cgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtgaactgggcccgctccgcgtcccgaacgttcccctaaacccacaagtcccggagaccctggggcattctgcgatttcggagtgaccggtggagcccccgcccgcgcgcctggctcccggggtctccccacacagcaggggctgcggggaccccctctgtcacctcctccaaagggtctgggagcaattcgacctgcctggagaattccaggaagtcctttccctgcgggagcctcatgggtccccccttctctgcctgcagagacctctggcttccgcgtgcgctcaaagtgagcgccgggcagattgtaaa

SEQ ID NO: 1350 - DNA, 199 bp, Homo sapiens
  misc_feature 1..199: note = chr19:3785637-3785836
  misc_feature 1..199: note = hyper
  source 1..199: mol_type = genomic DNA
gaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccact

SEQ ID NO: 1351 - DNA, 357 bp, Homo sapiens
  misc_feature 1..357: note = chr19:3785864-3786221
  misc_feature 1..357: note = hyper
  source 1..357: mol_type = genomic DNA
cgcacacgcttttcggccacacgcgcacagccctccacgtggacgcgcgggtacacacgcccggggctcgtagccgcgcacacccgcacccaggaaaccccagccaccaccacgcggggtccgatcgcctctgagcaccctccgccccagccgcgcacccgctgcgcgcccgggacgcgcacactcgcgcacacaccggcccttcctgcgcacgtcccgggcccacccccgcctagagccctcggggtttccccccaccccggcctcggggtctctccacgtctccccgccgacgtgctcacctgctcagggggcgcccccgagccgcgccccgcgcccgcccccaggagggcctcc

SEQ ID NO: 1352 - DNA, 16 bp, Homo sapiens
  misc_feature 1..16: note = chr19:3786583-3786599
  misc_feature 1..16: note = hyper
  source 1..16: mol_type = genomic DNA
gcgcggcggggaccgg

SEQ ID NO: 1353 - DNA, 141 bp, Homo sapiens
  misc_feature 1..141: note = chr19:6590370-6590511
  misc_feature 1..141: note = hyper
  source 1..141: mol_type = genomic DNA
aacttcttcgtttcccgaatcgttttcctggatgtcactgggcgcgagagcaccgcgcgcagcggactctctacgctgcaaaggcgcccggcgcggtccccaaagggacccctcccccacccggagcgagtggctggggcc

SEQ ID NO: 1354 - DNA, 118 bp, Homo sapiens
  misc_feature 1..118: note = chr19:9473938-9474056
  misc_feature 1..118: note = hyper
  source 1..118: mol_type = genomic DNA
ccattccgggcattggttcccgggaggaggcaagtgggttcatgtggtcagagtgcgtcggcggggccttttctccactttctgtacccttctctttaaacgtcgtccccagtaggag

SEQ ID NO: 1355 - skipped

SEQ ID NO: 1356 - DNA, 443 bp, Homo sapiens
  misc_feature 1..443: note = chr19:10624965-10625408
  misc_feature 1..443: note = hyper
  source 1..443: mol_type = genomic DNA
cgcgcccgggtcgaggtggtccccgcagtcccgggccgtgccggcaggcgccgcgcgttggcgcgtacctggcagtagatgcgcgcgtagagtgcacagatagcggccaggatgcccacgaaggcgagcacgcagaagagcacgtaggccttggcgtagagcggcaagacagtggagcaagcgtccaggcgacccaggcaattccagcccagcgctggcaggagcccgaggagcagcgacacgccccaggccgcggctgccatcgccagcgtgcgcccccgactggagacgggcgcgggccccctgcgcgccatggtgaggctgcgctccagcgcgatggccaggaggctcagcacggacgcagtgagtgccacgaagacgcctccctcccgtgcgaaccagagcgcgggggacagtttcagcgtgagcggccccgacagtag

SEQ ID NO: 1357 - DNA, 336 bp, Homo sapiens
  misc_feature 1..336: note = chr19:12203013-12203349
  misc_feature 1..336: note = hyper
  source 1..336: mol_type = genomic DNA
tcagggctctgaaggcgaggcggggagcacggtccaatcaggagcgccggggcggggccctgccaacttttttcggggaaggagacggctgcaagcccgcggtctcttgttgctgtgctaacgaccgttggaaccctctttctggctcttggaacgctcggctctgagaggctccaggtttctccgccagagctcctgtcgctctgtcagttgcgctgtgttcctctctagtcacaagagccttggggaagacagttggaagctcagacatggtgagtgtgtggggccaggcgtcctgagacgggggcgaagggcttcttagaacctgctggaacc

SEQ ID NO: 1358 - DNA, 343 bp, Homo sapiens
  misc_feature 1..343: note = chr19:12203350-12203693
  misc_feature 1..343: note = hyper
  source 1..343: mol_type = genomic DNA
gctgtggcgggacccgggcctccccgcggcgactccggggtctgtggggctgggccggcagccgggacccggggcatcctgtctcgtcccttcgcagcgaccgcggccccggacccggagccctctttgggcagctccgcgtcttcagccgcgggtctcctcagattgtgctgggccatgaggaggatcatggggggaatcccgtctcgggtgtagggttcttgcgtcagaaaagcggtggtctgtggagtccccagtcgtcttttctcctcttaaaagttaaaatggccgggcgcggtggctcacctgaggtcaggagttcgagaccaacctaacatggaga

SEQ ID NO: 1359 - DNA, 261 bp, Homo sapiens
  misc_feature 1..261: note = chr19:13616696-13616957
  misc_feature 1..261: note = hyper
  source 1..261: mol_type = genomic DNA
gggaggagggggaggcgcagctgctgctggggttcgggcaaaaggatatggccattcggtgatctttttggcgtattttctcaccacgttgtcttcgctgaagaggaagagagaccggttaaccgtgaggcagttctgtcggacggggatggggttgtagagtgccatggtccgcgctctctgcgccattgactgcttgtacatcctttgcgccccgggctgcccgccctgccggctgcccccggctcctcgcccgcctcc

SEQ ID NO: 1360 - DNA, 307 bp, Homo sapiens
  misc_feature 1..307: note = chr19:13617158-13617465
  misc_feature 1..307: note = hyper
  source 1..307: mol_type = genomic DNA
cgactgcggagacgctccacggcccagcccatcgggcggcggcggctcggcgcctcgggtcgggggctcagaaggcggctgcccgggccgagccggggatagcagctcgggacatcttcctggctgaccccggagaaggaggggcgggaggagggtgcgggggcggggcgcgggggcccggggaggaggggggaggggagagagaagcgaggcaaaaaataaccgaggaaggaatccaggcaatccccagtccacccactccggaaaaaaaaaaaaagagacagttaaaaaaaaaaaatccacccaa

SEQ ID NO: 1361 - DNA, 29 bp, Homo sapiens
  misc_feature 1..29: note = chr19:13617489-13617518
  misc_feature 1..29: note = hyper
  source 1..29: mol_type = genomic DNA
cggtttgcaaaggacgccccccccgggac

SEQ ID NO: 1362 - DNA, 138 bp, Homo sapiens
  misc_feature 1..138: note = chr19:17007251-17007389
  misc_feature 1..138: note = hyper
  source 1..138: mol_type = genomic DNA
gggtagggtcctcaccgagggcgcagcagctgggaggcgcgggctccaggggcgcggcctggcggcaggcggcctcccgcaggcggcaggcgctggcgtagaccaccccgtcggagccgcacaccgggttcccctggg

SEQ ID NO: 1363 - DNA, 347 bp, Homo sapiens
  misc_feature 1..347: note = chr19:17007446-17007793
  misc_feature 1..347: note = hyper
  source 1..347: mol_type = genomic DNA
cggcagggcccgactcgccggggaaccagcctgggggacgaggcaggctcgacagaccccccaccctgaaccttgcccgcgcccccacagaacctgggggtggggaagatgtccctgggtcccgggcccactaccccctcggtgggtcttggggcgcgacagttaatgggaggtcctgagccctggccttatggaatttcacgcaggtatttgcctaatacttacaaaaacagaaacagacttttaaaaagcggttgtaggagagaaaggagacagggcgtcctgtctgggccgccctgcaacaacagccccgtcccctgccgcgcctcctccgcactgaccacacc

SEQ ID NO: 1364 - DNA, 256 bp, Homo sapiens
  misc_feature 1..256: note = chr19:23257752-23258008
  misc_feature 1..256: note = hyper
  source 1..256: mol_type = genomic DNA
gcctctcaaagtgctgggatcacaggcgtgagccaccgccccccgacgcctcagctcatttgttaattagcagtaattgcccgggtcagtgacacctcctacttgagcctctttccctgtccataaaatgcactaatactggggtgggtgggattgggaggtgggtcctggagctccatccaatcagtggcactggtgtaggaaccgcccgatcaggcgcgcagttggagaggagggcgtggcttccggcatttgg

SEQ ID NO: 1365 - DNA, 287 bp, Homo sapiens
  misc_feature 1..287: note = chr19:23258305-23258592
  misc_feature 1..287: note = hyper
  source 1..287: mol_type = genomic DNA
cggccccaggcgtctctggccgcaagatggcggctgggcccgcggccgggacccccagcgtctcgccgcgtccctgctgggcgccctgtctggacctccctgggcagctctgcgcccgcagccccgagtatttcccagagtgcttagggatgccaggcgggtcatcagggtagaatcccgactaggtgtgtgcgtgggaggagctgcgacccgtggggttcccaagctttcctgttattttttttttcttttctttttagacagtctcgctctgtcgctaaggtaaa

SEQ ID NO: 1366 - DNA, 79 bp, Homo sapiens
  misc_feature 1..79: note = chr19:23258652-23258731
  misc_feature 1..79: note = hyper
  source 1..79: mol_type = genomic DNA
tgccgggattacagggttgagccaccgcgcctggcctaatatattaatttataagaaatgcattcgagttgggttttag

SEQ ID NO: 1367 - DNA, 391 bp, Homo sapiens
  misc_feature 1..391: note = chr19:30015572-30015963
  misc_feature 1..391: note = hyper
  source 1..391: mol_type = genomic DNA
ctcctgggccatagacgaggaaactgaaaggcaggcactggaggcaagaagggctggccccgggcacccgctggcgaggacagccttggagagggcctgcagctcctcccctctgagctgtgctgcgctggccgcctggaccagggtggctgctggagagtgttttccctctgggtttccttctccttggctcccagggaatcctctggcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagataggagagacccaaggcgagccttaggact

SEQ ID NO: 1368 - DNA, 724 bp, Homo sapiens
  misc_feature 1..724: note = chr19:30016024-30016748
  misc_feature 1..724: note = hyper
  source 1..724: mol_type = genomic DNA
cggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccga

SEQ ID NO: 1369 - DNA, 59 bp, Homo sapiens
  misc_feature 1..59: note = chr19:30017451-30017510
  misc_feature 1..59: note = hyper
  source 1..59: mol_type = genomic DNA
gctcccgggcccccgccgccaccgcgccccccgcgggagatggaacagcggaaccggct

SEQ ID NO: 1370 - DNA, 145 bp, Homo sapiens
  misc_feature 1..145: note = chr19:30017577-30017722
  misc_feature 1..145: note = hyper
  source 1..145: mol_type = genomic DNA
cgcgggaactttgctgccgctgtggactcgggggggtctttgctggggccgccaccgagaagaagaagaaagagaacgaaccgggaagcttcgcggtctccagcaatcccgctgtgcagcctgggcccggaggggtagggagagg

SEQ ID NO: 1371 - DNA, 967 bp, Homo sapiens
  misc_feature 1..967: note = chr19:30017765-30018732
  misc_feature 1..967: note = hyper
  source 1..967: mol_type = genomic DNA
cgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagc

SEQ ID NO: 1372 - DNA, 416 bp, Homo sapiens
  misc_feature 1..416: note = chr19:30019113-30019529
  misc_feature 1..416: note = hyper
  source 1..416: mol_type = genomic DNA
accagggcagccacccgttggtcaggcaccatgctagctccaaagcccgcttcctcctgggaaactcttggaaagccggacgtcctttgtgccctcaacccccatcccccgggcggtttcggtcctagcctgccggaggagggtgcccttgcctaaaggcggatccgagttcccctagccagaaggccgcgagcctcacgtctctctctccctctttgcattttaggtaacaaataaggatgcaactaaaatcagcgtaagtgtggagcccagcgcgggccgcgggagaccccttctggccgcctcgggtcccgcagctccctcccttagcaagccgcggcggccgcgcatgtggggccgcgcaagtagggcagcgatcgcagccttgcatcggtggctgctcggcgtgtccgggc

SEQ ID NO: 1373 - DNA, 81 bp, Homo sapiens
  misc_feature 1..81: note = chr19:30019530-30019611
  misc_feature 1..81: note = hyper
  source 1..81: mol_type = genomic DNA
ccatctgtcgccggttgcagggtcgggttctcttttgtgtaaatcaagggtccaaggcttgagtcccctaattcggctcgg

SEQ ID NO: 1374 - DNA, 252 bp, Homo sapiens
  misc_feature 1..252: note = chr19:30019660-30019912
  misc_feature 1..252: note = hyper
  source 1..252: mol_type = genomic DNA
cgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttg

SEQ ID NO: 1375 - DNA, 457 bp, Homo sapiens
  misc_feature 1..457: note = chr19:30716313-30716770
  misc_feature 1..457: note = hyper
  source 1..457: mol_type = genomic DNA
atgagtatcaatgaacggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttct

SEQ ID NO: 1376 - DNA, 779 bp, Homo sapiens
  misc_feature 1..779: note = chr19:30716952-30717731
  misc_feature 1..779: note = hyper
  source 1..779: mol_type = genomic DNA
cgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaaga

SEQ ID NO: 1377 - DNA, 756 bp, Homo sapiens
  misc_feature 1..756: note = chr19:30719283-30720039
  misc_feature 1..756: note = hyper
  source 1..756: mol_type = genomic DNA
tagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccgtaaatgcaagcctgtagccaaatgcttcccccattattctaaggtttgtgtctgcgtgtgcgtgtatgt

SEQ ID NO: 1378 - DNA, 280 bp, Homo sapiens
  misc_feature 1..280: note = chr19:36909069-36909349
  misc_feature 1..280: note = hyper
  source 1..280: mol_type = genomic DNA
tcgctctcccagagctctgggattacagatgtgagccacctggtccggcctagtctgcgcgtttctgctgggagtctttggcgtgcagaaactgaccgagggccatttctctgcagctgggcccggtgtgggcagaggatgctggggtcagtcacgcactccacggccacaacaaccttcgctcatacaatagtctctgcacccaagtcagccgcacagactccgtcacgtcccagccccggccccgtcacgcccacgacacacacacccgggcctgagg

SEQ ID NO: 1379 - DNA, 244 bp, Homo sapiens
  misc_feature 1..244: note = chr19:36909623-36909867
  misc_feature 1..244: note = hyper
  source 1..244: mol_type = genomic DNA
cgctcgctggtgcagcccctgctctgcgtgaacccggagccggagctaggtccgtcccagcgaggctgcgcttcgagtcccttagcgcctggggacggcgcggcagggcctggaggggagcggggacagatggctggcgcgttaaagaggggcgcccgcgaccgcctctctatagtgccaactagggagccctgtgagcgaggacggcgctgcgagtctgtccctggcgcgctcctgggtggga

SEQ ID NO: 1380 - DNA, 171 bp, Homo sapiens
  misc_feature 1..171: note = chr19:37264222-37264393
  misc_feature 1..171: note = hyper
  source 1..171: mol_type = genomic DNA
gctcagtctgcattgcgcggaaaatgaaggtgaaggtggaggtgggacctgatggtctcgtcccggatagggttgaagaagtgggagaaaaggaatcaaaatcgtggatgggataagattgtgcgcgaatgctctctgggagcggatcgtggccgacgagggcccgaagat

SEQ ID NO: 1381 - DNA, 25 bp, Homo sapiens
  misc_feature 1..25: note = chr19:37287936-37287961
  misc_feature 1..25: note = hyper
  source 1..25: mol_type = genomic DNA
tttgttttttgaaaccgagtttcgc

SEQ ID NO: 1382 - DNA, 224 bp, Homo sapiens
  misc_feature 1..224: note = chr19:37288201-37288425
  misc_feature 1..224: note = hyper
  source 1..224: mol_type = genomic DNA
acaggcgtgagccgccgcgctcggccggccccaaacacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccc

SEQ ID NO: 1383 - DNA, 99 bp, Homo sapiens
  misc_feature 1..99: note = chr19:37288606-37288705
  misc_feature 1..99: note = hyper
  source 1..99: mol_type = genomic DNA
cgggctgcgtcccggcccttccacatcggtccaccgcactcgtgggcgcccgcattggtgctgacataatttcctgacctctgacccgtattgtctcgc

SEQ ID NO: 1384 - DNA, 59 bp, Homo sapiens
  misc_feature 1..59: note = chr19:37288706-37288765
  misc_feature 1..59: note = hyper
  source 1..59: mol_type = genomic DNA
attaaaggtaaaaaacggggctttttcatcccactggggtaaaacgcccttttatttct

SEQ ID NO: 1385 - DNA, 71 bp, Homo sapiens
  misc_feature 1..71: note = chr19:37407081-37407152
  misc_feature 1..71: note = hyper
  source 1..71: mol_type = genomic DNA
catccagccgagcctcggagttgcgggtcgccgtagcgctgcgcaatggagatgagcctcccggggaaccc

SEQ ID NO: 1386 - DNA, 221 bp, Homo sapiens
  misc_feature 1..221: note = chr19:37407153-37407374
  misc_feature 1..221: note = hyper
  source 1..221: mol_type = genomic DNA
gcccaagcctcaccctcacacaggaaagcagatgtgttctggccggaagttgagtggggccgcggggcctgctgggaggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgac

SEQ ID NO: 1387 - DNA, 68 bp, Homo sapiens
  misc_feature 1..68: note = chr19:37407375-37407443
  misc_feature 1..68: note = hyper
  source 1..68: mol_type = genomic DNA
ctgccgagtccccgcagcagggggcgagcaagggactcgcggttgacgggacacggatcctctaaggc

SEQ ID NO: 1388 - DNA, 347 bp, Homo sapiens
  misc_feature 1..347: note = chr19:39754886-39755233
  misc_feature 1..347: note = hyper
  source 1..347: mol_type = genomic DNA
aggcgaggagggggccggctcccgctctctctccctctgtgtgtgctgcgcctcccctgtgagcctaacccaaggcaggggactggacgcgtgggaccctctctttggcctccctgacgtccctcaggagcagagatgcgaccgagtgtgtgggccgcggtggccgcgggactgtgggtcgtgtgcacggtgggcgcggcgatccgccagcgctgcctgctctcgcactaccgctcgctggagccccggacgctggcggcggtcaaggcgctgaggaaccgctaagtgagtgaccgcccagcccttgcgccccccggtacactggccccgccgggttcccacacacc

SEQ ID NO: 1389 - DNA, 156 bp, Homo sapiens
  misc_feature 1..156: note = chr19:39755264-39755420
  misc_feature 1..156: note = hyper
  source 1..156: mol_type = genomic DNA
cgcccagcaggcgcctcttgtacgtcagagcccacagttcccaccacgagatccccgcagtccccgtcgtcagcgcgaacgcaggctcagggtcagtcacaaaaggagccctgcagggcggactcggctccaggtcgcgggcgcagggctatgccg

SEQ ID NO: 1390 - DNA, 616 bp, Homo sapiens
  misc_feature 1..616: note = chr19:45655778-45656394
  misc_feature 1..616: note = hyper
  source 1..616: mol_type = genomic DNA
tgctgctgcagcaggcgcacggtgatgggcacggtgttgacgatgcgccgcatggacaccacgttgtcgggcacgtactcgtagaggcagtcgcgctcgtcgtgaaggcagaagagcgcctcctggattcgccgcgccgcctcgtcgtcgatgcggccctgcccgcgctccgtccccgcctgcgcctgcaccgccagcagctgcgcgctctcgcccccggcgtcccccggcagccacggcttgcgcgtcatctcgcggtacaacaggtcgtcgcggctctgcaccgcatcgtgcaggaactgcagcttggtgcggcggcccataatgggcacagagaagggcagcgtgacagtgcggttgaggaagaggtagccgttatcggccgtgcccttcatgttgcccgcgctctctaggcacgcggccaggatgctggggtccacgaccaggatgaagatgaagggcgcgtggctgtcggacagcagcgtgttgatggcgttgagcacgcccaccacgcgctccgggtagcacgtgtccagcccggtgacctccagcaccacgcgcagcctgcgccgctggtagatctccaggaagcacaggaagtcggtgagcagctcca

SEQ ID NO: 1391 - DNA, 361 bp, Homo sapiens
  misc_feature 1..361: note = chr19:45888864-45889225
  misc_feature 1..361: note = hyper
  source 1..361: mol_type = genomic DNA
cgcacttctcgaaggcggtggcgccgtcgctgagcgtggtggcgaagattgcagcgccgtgctgcaccagcgccatgcagatgactgtgtcgttgcacgacgccgcgcagtgcaagggtgtcctaggcgtgggggtggggggttgcggggaacgatgcgtgagaggctgcgcgtccgcccacgggggacccagcccaccgcgcgggtcggggctcaccagccgtggctgtcgggggagttgacattggcacccgcggtgatgaggaaatccacgatagagtagttggcgccgcagatggcgttgtgcaaggcagtgatgccctcctcgttgggctggctcgggtcgttcatctgagtgcac

SEQ ID NO: 1392 - DNA, 82 bp, Homo sapiens
  misc_feature 1..82: note = chr19:45889315-45889397
  misc_feature 1..82: note = hyper
  source 1..82: mol_type = genomic DNA
cgcctgctgcaccacctccagctccccggtcagcgccgcgtccaggaggagcaccagagggttgaggcgcgcgcggcgggcc

SEQ ID NO: 1393 - DNA, 78 bp, Homo sapiens
  misc_feature 1..78: note = chr19:48918201-48918279
  misc_feature 1..78: note = hyper
  source 1..78: mol_type = genomic DNA
catcggcttcagctacgacctctacctggtcaccaatggcaagcacggaaagaagatcgatggcgtctggaacggcat

SEQ ID NO: 1394 - DNA, 114 bp, Homo sapiens
  misc_feature 1..114: note = chr19:51830889-51831003
  misc_feature 1..114: note = hyper
  source 1..114: mol_type = genomic DNA
agaatgctgggtcaccggggaacggaggagcctgagagtcggggggctggcctggctgggcgctgcggcccggcccctgacccggatccctggcaggctgagcagcggcacggc

SEQ ID NO: 1395 - DNA, 270 bp, Homo sapiens
  misc_feature 1..270: note = chr19:51831120-51831390
  misc_feature 1..270: note = hyper
  source 1..270: mol_type = genomic DNA
cgcctccatgcggctcctgcgtgcgtcttcgggcggggcggggccgggaaggtgggcggggccgggggcggggctagggaagtggagacgccgggaccgcccttcaggctggccctgaacttaggagatggacgctgagactgaaaagcaatgcgagtaagaaaccgatccacgcaatcaatattcattgagtgccagctaagggtttgtcgtgggggacgcagctgtgcacaaaagaaacaaggtttggggattcgcagagcttatagt

SEQ ID NO: 1396 - DNA, 197 bp, Homo sapiens
  misc_feature 1..197: note = chr19:54481771-54481968
  misc_feature 1..197: note = hyper
  source 1..197: mol_type = genomic DNA
ctggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttg

SEQ ID NO: 1397 - DNA, 77 bp, Homo sapiens
  misc_feature 1..77: note = chr19:54483391-54483468
  misc_feature 1..77: note = hyper
  source 1..77: mol_type = genomic DNA
tgccccgagcacccccgggggcccggagccttcctaggcggtccccaagctccatcgccacccgctgggtaaggtgg

SEQ ID NO: 1398 - DNA, 53 bp, Homo sapiens
  misc_feature 1..53: note = chr19:56879501-56879554
  misc_feature 1..53: note = hyper
  source 1..53: mol_type = genomic DNA
gtactcagtcaccagcggaaccctctccaccaggctccgcgtcgaggccctac

SEQ ID NO: 1399 - DNA, 90 bp, Homo sapiens
  misc_feature 1..90: note = chr19:56879555-56879645
  misc_feature 1..90: note = hyper
  source 1..90: mol_type = genomic DNA
gggcgtcaatacgcacgcgtactttgtgtcccaggtagctcgtctcttagccatgtacgcctctgcattccggtcactgggagcggggcc

SEQ ID NO: 1400 - DNA, 322 bp, Homo sapiens
  misc_feature 1..322: note = chr19:56879646-56879968
  misc_feature 1..322: note = hyper
  source 1..322: mol_type = genomic DNA
tgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgaggtttgtgttgcgtcggggcggtccgtctcagaggcgctccggggaggagtgggcggctgaatggccagaggcccagggatccgttcaggtcagcgctggcgtccgggcctgagtttggaggtggcgggtgccttacaag

SEQ ID NO: 1401 - DNA, 193 bp, Homo sapiens
  misc_feature 1..193: note = chr19:56904511-56904704
  misc_feature 1..193: note = hyper
  source 1..193: mol_type = genomic DNA
aaaaaaaaaaaggcacgcataacagtgaatgcaaaacatccgcaatttcagggggtcggagacccctgcgcacccacctaaggggtccatgcacctgggctatgaggctggaagcagaaagggggcgccagaaagcgcacgccgcgagggccggcgggaaatgtagtctcacgccggtaaagccacagagcga

SEQ ID NO: 1402 - DNA, 274 bp, Homo sapiens
  misc_feature 1..274: note = chr19:56904723-56904997
  misc_feature 1..274: note = hyper
  source 1..274: mol_type = genomic DNA
cgttcttctcaggcctgagacccaaccggcccgggcaccagctcctgctggaccccagagcgcctggaaagctccggaacctctcacctgccgcctcctcgggtccaagtgccaccgcggccgcgcccccggcagcccagggcgcgcttccaccacggtaccggtggattcgccgtgcgcagccggaagatggcgcagacgcacaaagcacaccgatgctgcgccatgatagggccggcgccgcagtgtcttccgggaaacatagtctttaggc

SEQ ID NO: 1403 - DNA, 50 bp, Homo sapiens
  misc_feature 1..50: note = chr19:56904998-56905048
  misc_feature 1..50: note = hyper
  source 1..50: mol_type = genomic DNA
taaaggcagcagcccggccttgaagccggatctcgcgatgtttcagggtg

SEQ ID NO: 1404 - DNA, 183 bp, Homo sapiens
  misc_feature 1..183: note = chr19:57182944-57183127
  misc_feature 1..183: note = hyper
  source 1..183: mol_type = genomic DNA
gttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcaccaggc

SEQ ID NO: 1405 - DNA, 480 bp, Homo sapiens
  misc_feature 1..480: note = chr19:58094988-58095468
  misc_feature 1..480: note = hyper
  source 1..480: mol_type = genomic DNA
ccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggtgacgctgggcggcagcatccttccctcagccctggggaccagcggggactacagaacccagaaggttttgtctccagccgcagggatgctgagccaatccgcgctgagaaaagggtcgtttcc

SEQ ID NO: 1406 - DNA, 308 bp, Homo sapiens
  misc_feature 1..308: note = chr19:58095469-58095777
  misc_feature 1..308: note = hyper
  source 1..308: mol_type = genomic DNA
ctttgggaccaatgggtcggggagggacttccggtatcacttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgg

SEQ ID NO: 1407 - DNA, 467 bp, Homo sapiens
  misc_feature 1..467: note = chr19:58219926-58220393
  misc_feature 1..467: note = hyper
  source 1..467: mol_type = genomic DNA
gcgaaactccgtctcaaagaaaaaaaaactaacataaatggcgtccctcctttgttcagaactctccgtggcttctagcatcctcacaatgacagtacaaccctaggagtaactccgcctcatattcttcgttccctgcagaaaacagctttccgaattctcctggctcagtcgcgcctcaacctttgcacgcgccggttcctccgcctgtcacgctctcccacacctcgtcacacgcagtgtcaaaaaaagggccccacccacgaacgcctcagtgtccccgaccctgggcagcggggactcgagcaggcgcccctcactgatggctttagaacgtgggtgggggaaggtgtgtgaggacgggaagacgccgcactcacctgagttggcgtcctcagagtggccgctgccatcagactctgcgggtagagctgggccgggagcgacgggcgacattggtagggacc

SEQ ID NO: 1408 - DNA, 217 bp, Homo sapiens
  misc_feature 1..217: note = chr19:58220515-58220732
  misc_feature 1..217: note = hyper
  source 1..217: mol_type = genomic DNA
cgctctgctatctctgatccggtgaacacacctcagagaagctaaaatggccgccacgaagaggcccccccaaaagtcccgtcctttctttttgtgactctcaaggaaagtcggttttctgagctcttactggcttagtagcgtggcgttcaacgcagagcattctaggtaatgtagttttcatagatcccgaggtgggtgccggggaccctttgca

SEQ ID NO: 1409 - DNA, 413 bp, Homo sapiens
  misc_feature 1..413: note = chr19:58238326-58238739
  misc_feature 1..413: note = hyper
  source 1..413: mol_type = genomic DNA
cagtagcctccttaccggtctcctcgtatccatcctcgcagtccccaccccaaactaatgttctcccctgagcaaatttcgagacacttaaaatcccagctaagatcacgtccttctattcaaaaccctcagttaatctcaacgccctcagaatgaagcgacaacttctcagcctgccattccagtcacagttcctcaaactctgctctgtgttgatgagaaccctgtctcccaaatgtttgggggtcagcagcacccccgagcctttacctgcgccgtcccctccgcccgtaactctcccacacccacccacaccgagataggaccccgccccaagagtgcgtcgctgtcctgggacacaggggctgcaggcactttacgattcggagtcggagaaagggtgactgagggcc

SEQ ID NO: 1410 - DNA, 25 bp, Homo sapiens
  misc_feature 1..25: note = chr19:58238987-58239012
  misc_feature 1..25: note = hyper
  source 1..25: mol_type = genomic DNA
gctacaaggaggagccggaagtccc

SEQ ID NO: 1411 - DNA, 188 bp, Homo sapiens
  misc_feature 1..188: note = chr19:58239013-58239201
  misc_feature 1..188: note = hyper
  source 1..188: mol_type = genomic DNA
cccacgcaccccccgcaggcactgaaacacccctctcctgggccctcattgggtatgcaacgtataggtttgtgggtagagtgtggttcccactgagctatccttcaaggcaggggattctcggcctgggctcttgggaaaactcgaagtaggagggccaagttgtttgggaaaagtaacccgagttt

SEQ ID NO: 1412 - DNA, 112 bp, Homo sapiens
  misc_feature 1..112: note = chr19:58400406-58400518
  misc_feature 1..112: note = hyper
  source 1..112: mol_type = genomic DNA
gccgccaccagagggcgccggaagtccggacccattgtcacgtgcacacaggaaacgcctttattctgagccctcagaggtcttctacgctatcattcgaggctgagttttc

SEQ ID NO: 1413 - DNA, 74 bp, Homo sapiens
  misc_feature 1..74: note = chr19:58951525-58951599
  misc_feature 1..74: note = hyper
  source 1..74: mol_type = genomic DNA
cgccggaagtcccgcctctcaatgacagctcggacttgccactggtccgagctttcattggctcaaggatcccc

SEQ ID NO: 1414 - DNA, 178 bp, Homo sapiens
  misc_feature 1..178: note = chr19:58951600-58951778
  misc_feature 1..178: note = hyper
  source 1..178: mol_type = genomic DNA
ccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggc

SEQ ID NO: 1415 - DNA, 279 bp, Homo sapiens
  misc_feature 1..279: note = chr19:58951779-58952058
  misc_feature 1..279: note = hyper
  source 1..279: mol_type = genomic DNA
gagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccc

SEQ ID NO: 1416 - DNA, 28 bp, Homo sapiens
  misc_feature 1..28: note = chr20:291135-291163
  misc_feature 1..28: note = hyper
  source 1..28: mol_type = genomic DNA
cgttgccatagaaaccggccgcacaggc

SEQ ID NO: 1417 - DNA, 153 bp, Homo sapiens
  misc_feature 1..153: note = chr20:291220-291373
  misc_feature 1..153: note = hyper
  source 1..153: mol_type = genomic DNA
cgccagaggccccgccccccagctctggggagtccaccaatcagcaggtcccgtgacttagagccctgccctcggcccagggacaccaccaatgcgcttcgaccctgccctccttctcttcggtgtaacaagaagactcgatatttttttttt

SEQ ID NO: 1418 - DNA, 274 bp, Homo sapiens
  misc_feature 1..274: note = chr20:644552-644826
  misc_feature 1..274: note = hyper
  source 1..274: mol_type = genomic DNA
ccctgcagcagccagggccgcgagaaggccttgccgcagacgccgcacttgtggcgcaggttgtgcgtgagcaggtgcatggcgagcgcgggcatggacacgtaggccttgccgcacgtcgggcatttgcgcgccagctggctgtccaggctgcggtgcgtctgcttgtggcggctcaggttcgacgacgtggcgtaggtcttgccgcactcggcgcacgcgtgccggtgcccgccgcccgcctgcgcccccgcgcgccccgcgcgccccccgg

SEQ ID NO: 1419 - DNA, 320 bp, Homo sapiens
  misc_feature 1..320: note = chr20:644985-645305
  misc_feature 1..320: note = hyper
  source 1..320: mol_type = genomic DNA
cggggtcgctgtactcctccggcgccgccggcgggtacgcgggctcggccggggccagctccaggcccggcttctggtccgcatcgtagctgctcgggggcaggcggtgcggggcgtaccctggagggggcgagaagtggaggggcggtgagaggaggcgccgaagagggtttcccgctttgagcgcgtcaccctttgcgccttccagcttggcgcccctgtggcagctccgacagtggtggtctccgacctgcacctcagctcttcctgtcaggcagcctgggttcaattccttcctccatcgacggcagtgcaaatag

SEQ ID NO: 1420 - DNA, 219 bp, Homo sapiens
  misc_feature 1..219: note = chr20:2780903-2781122
  misc_feature 1..219: note = hyper
  source 1..219: mol_type = genomic DNA
agtgtgcgtgcggggtgagtgtgcatgactgtgagtgtgcgtgggtgtgcgtgtgcccgcgtgttagggagggatcgccccacggggcaggagagccgggcagtcggcttgcgggggagcggaccgtcggtcggggaactcaccgttagctgtctccgccggcggctgtgccgggctgctatgcagggccggggtcgagcctgggaccttggtggtccc

SEQ ID NO: 1421 - DNA, 589 bp, Homo sapiens
  misc_feature 1..589: note = chr20:2781123-2781712
  misc_feature 1..589: note = hyper
  source 1..589: mol_type = genomic DNA
ggctgcgcgaggcccagcaccgagttcctgggcgcccccagagccgggccgacggccggcgcgaaggcggccagggcgagcaggagcccccacatggcggggattgagtgccaggggcgcgcgggctacggcgggtggcgggtcggtctcttcctgccgagtgcgccgagccccccgccccttcctgccccccgcccctccgcagcctcctgcccgcccacagcccgctgcccgcctcggacctcggagaggaggagagggccgggaggagcgagcggggctgacctccaaggggccgccccaagtctcaggaccgccgactctgcccttcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattg

SEQ ID NO: 1422 - DNA, 152 bp, Homo sapiens
  misc_feature 1..152: note = chr20:3052540-3052692
  misc_feature 1..152: note = hyper
  source 1..152: mol_type = genomic DNA
gcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgcccc

SEQ ID NO: 1423 - DNA, 380 bp, Homo sapiens
  misc_feature 1..380: note = chr20:3052693-3053073
  misc_feature 1..380: note = hyper
  source 1..380: mol_type = genomic DNA
gctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatg

SEQ ID NO: 1424 - DNA, 205 bp, Homo sapiens
  misc_feature 1..205: note = chr20:9489503-9489708
  misc_feature 1..205: note = hyper
  source 1..205: mol_type = genomic DNA
acttttatcacccatcgctatacccagagcagctgctcgaatgtgccaaggagcccaactcgggtgcaaagcgccgacgtctttcccaggttgaggacatcgcgagccagaggtgcaggcagcgaggcgcccaacagtagaatgcatcttccttcccgcgggcagaagccgtcaagtctggagtccgcagcgggcgcgcgggcca

SEQ ID NO: 1425 - DNA, 10 bp, Homo sapiens
  misc_feature 1..10: note = chr20:20346166-20346176
  misc_feature 1..10: note = hyper
  source 1..10: mol_type = genomic DNA
gggtggtgaa

SEQ ID NO: 1426 - DNA, 377 bp, Homo sapiens
  misc_feature 1..377: note = chr20:20347333-20347710
  misc_feature 1..377: note = hyper
  source 1..377: mol_type = genomic DNA
gggtgggggtgggggcggggggaatcttcgctgttgtctcttcctggtggcacaggggaggcggcttgtcctctcggaggcctcagcctgcctcagagtacagattgccccccctccccccgtccagcacgcgtctcttttgcgtccagattggccgcgaccggagctcaatagcaggaggttaatttccttcacaaaggtgaagggggcacggctccgtgggggctgcgcccagacaggcagcccctttatttcgcagcgccttgattggagcccttgatttagcatctgatgtcaaccggcaaacaaaatgcccgctcggaatgaaaatgcatgaggccgcgcggggaggagaaagccaacttcactggggcgca

SEQ ID NO: 1427 - DNA, 486 bp, Homo sapiens
  misc_feature 1..486: note = chr20:20347736-20348222
  misc_feature 1..486: note = hyper
  source 1..486: mol_type = genomic DNA
cggccaactcgacccggattaaccgagccttggaccacgcggaagctccgggcggcctgggtcgggccccgccaaagatgccattcccaagcctccaagaacccaaaagttcagaaattcacgttcctctgggaacccagcccagcccgcccgcgctccaatcccgcgctttcgggagactgagaaggccgtgccaattccttctcaaactcgaaagaaaccttctctagccccgtgggcgcgcggaggctgcgagcacaaacatcgccctcggccactgccagaaggccgggccccctgtccacacttggaaccccggggaacccttttgcttggcctcttgggtccagcggcccatccgtccaaggtccgggcggaggccgtccggaccctgctgctctctcggattcttgtttatttcccaaacaccacgcggagccactgcgcctccgcaacgatctcccccgcaccgccccggcgcgcccc

SEQ ID NO: 1428 - DNA, 26 bp, Homo sapiens
  misc_feature 1..26: note = chr20:20348257-20348283
  misc_feature 1..26: note = hyper
  source 1..26: mol_type = genomic DNA
cggctccggctcgcggattgaaccct

SEQ ID NO: 1429 - DNA, 281 bp, Homo sapiens
  misc_feature 1..281: note = chr20:21080676-21080957
  misc_feature 1..281: note = hyper
  source 1..281: mol_type = genomic DNA
gcctatcaattaccccgcccgcagtgaaagcgaaagcgacagtttcttctcttcgcttttttttcttttttaagaactcgaaaaaggaaatatttgcaataagcaggcggtagtagcacttcgtagctggaattatttaattgaatcttcaagtttttagggatgcccgtagaggataaaaccccagtgctcagcggagagggtgggaggggtacagggggcggaggaatctgttggtttgactgtacacctgcgggcggcggcaaaatacagccacgagc

SEQ ID NO: 1430 - DNA, 817 bp, Homo sapiens
  misc_feature 1..817: note = chr20:21081028-21081845
  misc_feature 1..817: note = hyper
  source 1..817: mol_type = genomic DNA
cgttagcccggggtttcaccgaagccggcgattcgaagggagtggcgtttccgcaaactgcatcgctaggggcccggcgtggaagcgcctctgcgcaactttcctccaccgctgcctacaagggaggctctggcttccgtttacttattttttaggagttttaacctttggttcctgcttttacaaccgctaaccccaaaaacattttttttttctttttgttctttgtaaaaccaaaccactatgctgtgcgttcatgttcaactctgttgaaatcccgggtgggccgaaataagatttaattgtctcctgcgtggagaagtgacacccactttttcccctgaattgagcaaacaccagggctttgtctgagcttgtggcttaaacgccgggcggtttctgcacccagttggtgggttgtaagacaggaggtttccaagtctttcatcatgtttctaacaaggaaaaccaaatcgggcccataatgtcatcagccccggcccgacctcgccgggacctcggcagcccgatgatgtcgctagcggccccggcgcagccacgacgcgccgcctttcagctcctcgcagtccccacaaaagccagacaacaatatcaattaatcatgcagcgggcaaacaaggagatttatcccgcgacaaacagccccaccgagagccgctgaatgggcgtgattagcatgtgaaaaggcgagcaaaactccgcggttcaacagctaaagagcaatttgatggggctgggatggggaaattacttgattagcgtccatcggaggagaacacggttacagcccctcggc

SEQ ID NO: 1431 - DNA, 30 bp, Homo sapiens
  misc_feature 1..30: note = chr20:21082094-21082124
  misc_feature 1..30: note = hyper
  source 1..30: mol_type = genomic DNA
ggctctggcccggaaagagagtgacagagg

SEQ ID NO: 1432 - DNA, 741 bp, Homo sapiens
  misc_feature 1..741: note = chr20:21082215-21082956
  misc_feature 1..741: note = hyper
  source 1..741: mol_type = genomic DNA
cgggccccaggttggagtagccacgctagcggctaggccgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgcggcgaggggtgagggcgcgaccgccttggggcaggggcggcgatggagtagctccgggctctccacggactcgattggacagccccaggccggctttggatccttggaggcggatacgcaaggccagacctggtggcgtggccagttgggcatcgcggtatcttccccaggcctggagggcagtgctgaaggcccgcggccgaggttttgctttaagtatacttgggcctcgcaactcagctgtttgcgaacagagacctggcgaatcgccgaggagcggcgcggctccgcgtccccacttcaaggccaagtggagagtgaggacacgctgaggccccctgctacctatcatgccatcttaagcgggcaccgactccttacccagaaaagatcctggagctaaagcctgcgcctacaccagaga

SEQ ID NO: 1433 - DNA, 170 bp, Homo sapiens
  misc_feature 1..170: note = chr20:21086917-21087087
  misc_feature 1..170: note = hyper
  source 1..170: mol_type = genomic DNA
aaggcgcagacccaccgctcgccaagcctcgccccgcactgtgcacgggaagagggggctccgcgcgcagcccagtccggttagctggtcggcgtcggcggggctgccgaggtggcgcagagctcccctcccccacgccttataatttaatcacacgcgatattaaatta

SEQ ID NO: 1434 - DNA, 15 bp, Homo sapiens
  misc_feature 1..15: note = chr20:21372178-21372193
  misc_feature 1..15: note = hyper
  source 1..15: mol_type = genomic DNA
gatggtggcggcgcc

SEQ ID NO: 1435 - DNA, 200 bp, Homo sapiens
  misc_feature 1..200: note = chr20:21372294-21372494
  misc_feature 1..200: note = hyper
  source 1..200: mol_type = genomic DNA
cgcccggcgcctgggtctcccctgcggctcgctagtcgcccggcccagcccgcagaccccgcggctggccctcccgggagccccgcgagccggccgcacgcacaggatgggcgcggaaagccccttcctctaccctcgggcgcaccctccttcctcgtccgcggcgccgcagcttctcaacctgccgctgcatctcaact

SEQ ID NO: 1436 - DNA, 130 bp, Homo sapiens
  misc_feature 1..130: note = chr20:21376207-21376337
  misc_feature 1..130: note = hyper
  source 1..130: mol_type = genomic DNA
ttttatagttacaaacgccaacaaagtttccaactttgagagctgtagttaagaatgccgtgtgaacttctccaccttttcgcgtcatttaagaacttctaggaggagaaaatcaccacctcaaagcctc

SEQ ID NO: 1437 - DNA, 32 bp, Homo sapiens
  misc_feature 1..32: note = chr20:21376702-21376734
  misc_feature 1..32: note = hyper
  source 1..32: mol_type = genomic DNA
ggcggctgcggaccggcctggccgggggtggg

SEQ ID NO: 1438 - DNA, 253 bp, Homo sapiens
  misc_feature 1..253: note = chr20:21376876-21377129
  misc_feature 1..253: note = hyper
  source 1..253: mol_type = genomic DNA
cgtttcatcttgtaccggtggttctggaaccagatcttgacctgcgtgggcgtcaggtggatcatgctggccaggtgctcgcgctcgggcgccgacaggtacttctgctgcttgaagcgccgctccagctcgtagacctgcgcctgcgagaagagcacgcggcgcttccttcgcggagcggctgccgccgccgccgcgtgcagcgggcccagcgacttggcggcgtccgcgatgccggtcagcgaccccatgc

SEQ ID NO: 1439 - DNA, 168 bp, Homo sapiens
  misc_feature 1..168: note = chr20:21377473-21377641
  misc_feature 1..168: note = hyper
  source 1..168: mol_type = genomic DNA
cgcgcccgctcggccccaggacctcctaagccgcgcgcaccccgtcccgcgcccccgcgcccctcggctgtggcgggaaacgcctgagccgcccgcagccccgcgctcctggcccctctcacttgacgagtagcgtgggtccgggttggcgccgtaccagccggtggc

SEQ ID NO: 1440 - DNA, 837 bp, Homo sapiens
  misc_feature 1..837: note = chr20:21377737-21378574
  misc_feature 1..837: note = hyper
  source 1..837: mol_type = genomic DNA
cgagacgccgggcggcatgtggtaggtggcggccgccgccgccgcagctgctgccgccgccgccgcggccgccgcgttgtgacccgccatggcgtgagaaggctgcatgcccgccacggtcgccgcctgcgaggagggcccaggtggcggcgcgcggtaggcggccgcggcccccaggggcgcccccaggccgggtggcgcgccgtccatggcgccgctgaacttcttgtaggtctcctcgatggggctcaggatgtcggacacggagaagggcgtcgtgtgctttgggctcaacgacatggctcggcgggcagccaggtaggggggcctggggcgcgcgccggcaggacgcggcggccgctcgtcgccgccacctcggccgcggcagctgagcctgtgacgaggagtcggcggctcggcgagccccccgggctgcgggatctggggtttattttagtccggcgccaggtttacgacagactcggggggcggagcaacatcccaaacgagcaaacaatggtcattgacatctttttctctcgcccccccaacccccgccccataatggaggcaaaaaaaggtaaaaggggcagttgggtgtttcttggaaagatcactccccgttgcttttcccatctttgcttttcccatcctttgcttttcccatccttcgctcctccatccgcggccgttaccccagccctcgagcaccagaaatagaaactcggaggctggcgtcgaggctagacatggactccgcgcctggccccttccagatcccagttttctaaagtgacttcgcaccaaagtccggtataattgcggaatggggaacgt

SEQ ID NO: 1441 - DNA, 146 bp, Homo sapiens
  misc_feature 1..146: note = chr20:21489301-21489447
  misc_feature 1..146: note = hyper
  source 1..146: mol_type = genomic DNA
tccgggattcactgccggcgataagcgcgctgaatggtgcggggtggggcggggggtggggggcgggccccttctccttcttcccctctctctgtccccgcgatcctttctctgtccctttttaatatgcacgcctctaacatctc

SEQ ID NO: 1442 - DNA, 80 bp, Homo sapiens
  misc_feature 1..80: note = chr20:21489621-21489701
  misc_feature 1..80: note = hyper
  source 1..80: mol_type = genomic DNA
cgggcgccgggtccacctcccgggctcccggccggccacaggagcgcacacccagattgcaggcccgcggtcctggccac

SEQ ID NO: 1443 - DNA, 523 bp, Homo sapiens
  misc_feature 1..523: note = chr20:21490175-21490698
  misc_feature 1..523: note = hyper
  source 1..523: mol_type = genomic DNA
tcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgccc

SEQ ID NO: 1444 - DNA, 88 bp, Homo sapiens
  misc_feature 1..88: note = chr20:21491258-21491346
  misc_feature 1..88: note = hyper
  source 1..88: mol_type = genomic DNA
atagatttgggccagcgaggggggtttgctctcctcgcctttgcggctcccgaagtcacttttcctcccgtagccggacgctgccgcc

SEQ ID NO: 1445 - DNA, 319 bp, Homo sapiens
  misc_feature 1..319: note = chr20:21492507-21492826
  misc_feature 1..319: note = hyper
  source 1..319: mol_type = genomic DNA
cgccgccggggtggggcctgggcctggggccgcgagtctcgttggggcggcgctcaccaagtccactgctgggcctggaccagggggtgtgctgtcgggtactggggggtgctggccgagctgtactgggcgttgtactgcatgtgctgcagcgactgcgcgctgtaggcagaaaagggaatgcccgcctggaaggtggcggctgccaggtcctgggctttgagcgcgtgacatggtttgccgtccctgaccaagacgggcacggccacccggcgcggcgagggcaggggcgtcacctccatacctttctcggcccggg

SEQ ID NO: 1446 - DNA, 764 bp, Homo sapiens
  misc_feature 1..764: note = chr20:21493230-21493994
  misc_feature 1..764: note = hyper
  source 1..764: mol_type = genomic DNA
ctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctg

SEQ ID NO: 1447 - DNA, 303 bp, Homo sapiens
  misc_feature 1..303: note = chr20:21501450-21501753
  misc_feature 1..303: note = hyper
  source 1..303: mol_type = genomic DNA
tgttgccttcaggaacgttctttcagccaagcccgaccttccccggatgagggcgatttcaatacgggagatctgggtttctccaggaaacacgcgctgaaagcactctcttatctgaatttacttcttaacacgtgacaaaatcattaccacaagactttggaaaacaagcggctctcctaacgggttgcattcagcacttaaagctgggtcgggcaggctgatgtgaaaagtagttgtcggtggcgcggagaaggcacgctcttagctggagctaagggctggttccgggaaggacaggga

SEQ ID NO: 1448 - DNA, 58 bp, Homo sapiens
  misc_feature 1..58: note = chr20:21502087-21502145
  misc_feature 1..58: note = hyper
  source 1..58: mol_type = genomic DNA
actccagtcttcagtcgcctctccagagacctcagtccactgcgcgggccctcagccc

SEQ ID NO: 1449 - DNA, 257 bp, Homo sapiens
  misc_feature 1..257: note = chr20:21502443-21502700
  misc_feature 1..257: note = hyper
  source 1..257: mol_type = genomic DNA
cgctccgccttctactcccggagctgcggcgacagccccgccgcatttcaaggcgcgtctttatctagtactccacctacccggacccccctcgctctgcgcccttcccccaccgcgcgccctaccaggcggggctcaggggaccgcaggcggggaccgccgcgggtgccgcgcccctccctcctcctccgcctcccagccccgcaccttcccagcccctgggacagtcccgctttccctgaccgcaccggaaagtg

SEQ ID NO: 1450 - DNA, 57 bp, Homo sapiens
  misc_feature 1..57: note = chr20:21682399-21682456
  misc_feature 1..57: note = hyper
  source 1..57: mol_type = genomic DNA
ggtttgttagttgttcgcattcccccagggtttgcagctccccgatctggctcagct

SEQ ID NO: 1451 - DNA, 43 bp, Homo sapiens
  misc_feature 1..43: note = chr20:25061746-25061789
  misc_feature 1..43: note = hyper
  source 1..43: mol_type = genomic DNA
aggggactgggaggacgctgcgccggcagaggagcgcggtacc

SEQ ID NO: 1452 - DNA, 334 bp, Homo sapiens
  misc_feature 1..334: note = chr20:25061978-25062312
  misc_feature 1..334: note = hyper
  source 1..334: mol_type = genomic DNA
cgcctggcgctggggggaaaaatggccctctggagatggttgttgaagaccccagggtctcatcaaaaggttccacccggaaccaggtggtggcggtctcacatcgctgagggaacaggaccccggatgagaggcagggatttaggatgcagcaaggggcaggcggcgcagctccgcgaatgcccctcccgcgacggggcctcgctctgggctccccgcctagatctgggccgctggggccaggggtgcggtggggcgatggtctgtgacccctgcgcggctcagagcctaggggacaggggcaggagcggaaagcgcgggcctgattaccgga

SEQ ID NO: 1453 - DNA, 136 bp, Homo sapiens
  misc_feature 1..136: note = chr20:25062510-25062646
  misc_feature 1..136: note = hyper
  source 1..136: mol_type = genomic DNA
cgccaggctggagccgtcaagccccgggcccgggcacggcgcgactgccggaccctcgcagccagatccctgtcctgggccagcgggcgccggcagctcggcctccaagcccagcaggtccgtgatggcgaagccc

SEQ ID NO: 1454 - DNA, 111 bp, Homo sapiens
  misc_feature 1..111: note = chr20:25062707-25062818
  misc_feature 1..111: note = hyper
  source 1..111: mol_type = genomic DNA
cggaaagcgagtcccggccggtcatggttccttagcaagcaaggcgcgagcctctctggatcccgtttgcggagggcccagcttagaggaagctttataggattgggctgc

SEQ ID NO: 1455 - DNA, 71 bp, Homo sapiens
  misc_feature 1..71: note = chr20:25062870-25062941
  misc_feature 1..71: note = hyper
  source 1..71: mol_type = genomic DNA
cgccgttccggaccccgcgagatggggacgccaccagttcccctcccctcggttaccgcccacccagctgc

SEQ ID NO: 1456 - DNA, 180 bp, Homo sapiens
  misc_feature 1..180: note = chr20:25063727-25063907
  misc_feature 1..180: note = hyper
  source 1..180: mol_type = genomic DNA
tattgtccaatttcacgattattcaaagaaagcctgattctttgaataatcagtgaaactctgatattcgctaaagttggccccaagcacgtgggtaagtaactactggttcgcgctttgaacccaaccagccctcatcgctcggagccctgcgtcccccgcttcccaatcccagaaccc

SEQ ID NO: 1457 - DNA, 518 bp, Homo sapiens
  misc_feature 1..518: note = chr20:25063993-25064511
  misc_feature 1..518: note = hyper
  source 1..518: mol_type = genomic DNA
cgggaacccggcgcggctgcctgcgcgcacgcagggaccggagcccgagcctgggccctgcaaagtgggtctcccactcgctgcgcgttcgagtggggcctccgctaaacatgcagattaaacaaggggcttccgataaggataattacaggaggctgcgcattgactttccgttactaaaggaagacccaaatctcccccttgcaagctgttcccgggattaccaaaacaatcactttcttttgagatcattgtcttttgaaccactccagctcggggcagaacgctttagacgctggcgttgttttccgctccgcgaggaattttcccccagatttatctctgggtttagggaaggcgttgggcattcgggactgcgtagtcgtttgtaaatccgaatttggggtagcagttaagtgagatacctacgcttccacacagtttgtagcccgagaccagtcaggcaggcagggtagtcgattctaaggtggcccgaccggggtcgcccgcgaatggaa

SEQ ID NO: 1458 - DNA, 28 bp, Homo sapiens
  misc_feature 1..28: note = chr20:25065179-25065207
  misc_feature 1..28: note = hyper
  source 1..28: mol_type = genomic DNA
ccacccagagcccagcgtcaagttatac

SEQ ID NO: 1459 - DNA, 187 bp, Homo sapiens
  misc_feature 1..187: note = chr20:25065208-25065395
  misc_feature 1..187: note = hyper
  source 1..187: mol_type = genomic DNA
ggcgcttcactcagcgtcagccaagaccagggaagcgcttcttgccgtttaggagacgtctgcaagagataaaaagctagcccacgatccacccacaatcctcgtgtccccggggtgccctcgcagttgccaaacctacgggccgcgtttaggggaagcctccgcgtcctggcggccaaaagaatgg

SEQ ID NO: 1460 - DNA, 24 bp, Homo sapiens
  misc_feature 1..24: note = chr20:34188608-34188632
  misc_feature 1..24: note = hyper
  source 1..24: mol_type = genomic DNA
ttctttttcttctttcgggtgagc

SEQ ID NO: 1461 - DNA, 342 bp, Homo sapiens
  misc_feature 1..342: note = chr20:34188747-34189089
  misc_feature 1..342: note = hyper
  source 1..342: mol_type = genomic DNA
cgccttcgttgagaccttgaagactatcccggagccccgcgccggggggcgagccatagaggggcacccaggccgggccgaaggtagggttaaaccccgctgtggggaacaagagaagcgtgttggaggggagcgtggggagggcgagtgctggtaaatctctgcacctcaccctgatctcctccaagtattcgggggtgagggcaggggaggggggctaagccgctctgaaacggaagaagttggccagcagctgcggacgcgccgctgtggaacacgacctggggcgcctccaaaacagctcagcgccccaaggagctggaaatcgcgggagcccggcct

SEQ ID NO: 1462 - DNA, 326 bp, Homo sapiens
  misc_feature 1..326: note = chr20:34189166-34189492
  misc_feature 1..326: note = hyper
  source 1..326: mol_type = genomic DNA
cggggaaaggagtggaccggcagtgtcagcgtgtgcacagctgtagaagggtgggactgggctggttactggacaggcggttgtggtcagaattttgccaacggagccaaaccgatggtggggttcacagtctgggggcggcttgaagcagtttgttttgcgggcggaccagccctcctaggcggagcggggtcgcgaggatggggcttgcggttgggaatgggccctatggagccctatggaccgaggcgagtgaggccagatttgccgcggccagaagcgctcacccgcgcggcccggatgggagatccgcctcaggtccggca

SEQ ID NO: 1463 - DNA, 375 bp, Homo sapiens
  misc_feature 1..375: note = chr20:34189679-34190054
  misc_feature 1..375: note = hyper
  source 1..375: mol_type = genomic DNA
cggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctgg

SEQ ID NO: 1464 - DNA, 796 bp, Homo sapiens
  misc_feature 1..796: note = chr20:37302580-37303376
  misc_feature 1..796: note = hyper
  source 1..796: mol_type = genomic DNA
tggagcctgatcactcggggtcttactggccacggtgaggagtcagggtttcatgcgcccctgcagtcagaaagcatggcccaaccccagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaa

SEQ ID NO: 1465 - DNA, 401 bp, Homo sapiens
  misc_feature 1..401: note = chr20:37352115-37352516
  misc_feature 1..401: note = hyper
  source 1..401: mol_type = genomic DNA
ttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggc

SEQ ID NO: 1466 - DNA, 20 bp, Homo sapiens
  misc_feature 1..20: note = chr20:37352606-37352626
  misc_feature 1..20: note = hyper
  source 1..20: mol_type = genomic DNA
cggggcgcccagaccagtcc

SEQ ID NO: 1467 - DNA, 284 bp, Homo sapiens
  misc_feature 1..284: note = chr20:37353435-37353719
  misc_feature 1..284: note = hyper
  source 1..284: mol_type = genomic DNA
gatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacgg

SEQ ID NO: 1468 - DNA, 1026 bp, Homo sapiens
  misc_feature 1..1026: note = chr20:37353806-37354832
  misc_feature 1..1026: note = hyper
  source 1..1026: mol_type = genomic DNA
cgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaaagaagaaggggaaatcgctgaggtcggagtctcctccccccgcacacacgcatagacacgcacacgtatataggcaggcacaccacatgcccacagccccccttcccacgaacaaaggcgcaggcacaggcgcacacgacatgtatctatatatagaccacagtactatccccaaatgcacctgcgtacacccctacagctccacaaacaaaagcatatacctgcacataccaaacacacgaatattcgtttgaacatatgcacacacacatgcacagatgcatgcagacaggaaccagcctgctcccttgggtgcggccctgttggagacatacaggtatacacacacgaaagcacacacatgctcccacacaaacacatttagtccgcaataatccagcattacctgtgcacagactcgcccctctcgcccgaaatcccggctgcaccgcaaagaggcggccagctcctccccgtgtgaccctggcgaagccctctccagaggctaagaatggcccctgctctctaggccctctccccttattcctaaccccccactccccaccaggcggcgcaggactcctacatagggagcaggtttggagtcttggcaacgacctccgagctagcaggggctggcaggccgcagctttctgggccgaaggagacttcagctctaggcaaccc

SEQ ID NO: 1469 - DNA, 239 bp, Homo sapiens
  misc_feature 1..239: note = chr20:37354993-37355232
  misc_feature 1..239: note = hyper
  source 1..239: mol_type = genomic DNA
cgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaag

SEQ ID NO: 1470 - DNA, 541 bp, Homo sapiens
  misc_feature 1..541: note = chr20:37355502-37356043
  misc_feature 1..541: note = hyper
  source 1..541: mol_type = genomic DNA
accctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatc

SEQ ID NO: 1471 - DNA, 297 bp, Homo sapiens
  misc_feature 1..297: note = chr20:37356168-37356465
  misc_feature 1..297: note = hyper
  source 1..297: mol_type = genomic DNA
cgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttg

SEQ ID NO: 1472 - DNA, 365 bp, Homo sapiens
  misc_feature 1..365: note = chr20:37357825-37358190
  misc_feature 1..365: note = hyper
  source 1..365: mol_type = genomic DNA
ggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctca

SEQ ID NO: 1473 - DNA, 224 bp, Homo sapiens
  misc_feature 1..224: note = chr20:37434129-37434353
  misc_feature 1..224: note = hyper
  source 1..224: mol_type = genomic DNA
ttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgt

SEQ ID NO: 1474 - DNA, 234 bp, Homo sapiens
  misc_feature 1..234: note = chr20:37434488-37434722
  misc_feature 1..234: note = hyper
  source 1..234: mol_type = genomic DNA
cgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctg

SEQ ID NO: 1475 - DNA, 158 bp, Homo sapiens
  misc_feature 1..158: note = chr20:37434736-37434894
  misc_feature 1..158: note = hyper
  source 1..158: mol_type = genomic DNA
cgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcg

SEQ ID NO: 1476 - DNA, 440 bp, Homo sapiens
  misc_feature 1..440: note = chr20:37434930-37435370
  misc_feature 1..440: note = hyper
  source 1..440: mol_type = genomic DNA
cgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcc

SEQ ID NO: 1477 - DNA, 229 bp, Homo sapiens
  misc_feature 1..229: note = chr20:37435487-37435716
  misc_feature 1..229: note = hyper
  source 1..229: mol_type = genomic DNA
cgcgccaggcctgggtcccggtgctcccgggcacctcaggagcggagggagagggatgtggcttcatcagcgcttctaggaaccgaaaaccgagctgcctgcgcgcccatgtgattgcatttcacataaagggcccctgttttcactgtcagaagagccccccagctctccgcggctctggacaccaggtgccgcctctgaatcaccctctgtggaggacccggggccc

SEQ ID NO: 1478 - DNA, 132 bp, Homo sapiens
  misc_feature 1..132: note = chr20:37435717-37435849
  misc_feature 1..132: note = hyper
  source 1..132: mol_type = genomic DNA
gaggtacaggcgccctttcccgcagggctctccctggaaagggcctgccgatggcggcctcagtccgcaggggtacttccctgtgtaccctgccatttcctgcggctggtgaagcaccggagaaaaaccgtc

SEQ ID NO: 1479 - DNA, 236 bp, Homo sapiens
  misc_feature 1..236: note = chr20:41818513-41818749
  misc_feature 1..236: note = hyper
  source 1..236: mol_type = genomic DNA
tcctgcgttccaagccgaggcgcggcgcgaactgaggcgggaggctgggcgggggcgggacgcggggggcggggggcggtgtcccccgagtcctaacgccgccgccgttgccgccgccgccgccgccgccgcccgcccgggcgctccgcctcggccgtgcacacaccctcacgcgcacgcccgcgcctggcacacgcccgcggctggcacacgcgggctcccccgcgcaccctctc

SEQ ID NO: 1480 - DNA, 211 bp, Homo sapiens
  misc_feature 1..211: note = chr20:41818804-41819015
  misc_feature 1..211: note = hyper
  source 1..211: mol_type = genomic DNA
cgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataa

SEQ ID NO: 1481 - DNA, 836 bp, Homo sapiens
  misc_feature 1..836: note = chr20:42543698-42544534
  misc_feature 1..836: note = hyper
  source 1..836: mol_type = genomic DNA
gctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgc

SEQ ID NO: 1482 - DNA, 257 bp, Homo sapiens
  misc_feature 1..257: note = chr20:42544727-42544984
  misc_feature 1..257: note = hyper
  source 1..257: mol_type = genomic DNA
cgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggc

SEQ ID NO: 1483 - DNA, 128 bp, Homo sapiens
  misc_feature 1..128: note = chr20:45279854-45279982
  misc_feature 1..128: note = hyper
  source 1..128: mol_type = genomic DNA
acactgggacctcagcggtctcccaacttggaggcttgggagaagaggatcccgcctgtggttgaccgggggcgcacaggcggaggaggcgttaccttgggcgggagggcgaagaccaccggcagcag

SEQ ID NO: 1484 - DNA, 218 bp, Homo sapiens
  misc_feature 1..218: note = chr20:45280039-45280257
  misc_feature 1..218: note = hyper
  source 1..218: mol_type = genomic DNA
cgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagtta

SEQ ID NO: 1485 - DNA, 809 bp, Homo sapiens
  misc_feature 1..809: note = chr20:50720392-50721201
  misc_feature 1..809: note = hyper
  source 1..809: mol_type = genomic DNA
aacatataagctattcgtttagtggaggcttcattaaactactcccctccaccaccacctcgggaagttgtggtcaaaacccaccagaccgactgtggtggaagttgatgcggaagctggagagcccgcggctctggaggggtgagccgccccggagaggggacccatcctcctttccgcgcccggaaagagcgggggagaagaggaagtccagttacaactcctttcctcagccccttaaaggaaaggtatcagctaaccacggggagctggcagcctaagagaaagtaggaacctacaatctcttaatctaagcacaagataagcaaaaagggaagcgccttagaaatgcagattccccaaccccacccctgagattccagtggaggcgggggatggggggatccctaacttgcaggaagaatttggcgagcgagaaaaggtcccctcccgcaggctcttctgaagcggaggatcccgggacgagaaatgctgcccggggggcttaaggtagccgacgatctccttgctacatcctgtgtccacgtggcagccgaggagggggtgtgggggccgcctgttaagtgcgacagcatcactgctctatccccaccacggctcccacttcgctcagataaaatgcagagctcttaccaaggctcacggccgtcccccgccccccaccgtctgcccccatcacctctcgggcctccggtgacctctcgggctacagcagcgctgacgccctgggtccctgcgcttctgttccctcggcctggaatgctcttcccccgggtacctgcacagct

SEQ ID NO: 1486 - DNA, 437 bp, Homo sapiens
  misc_feature 1..437: note = chr20:50721234-50721671
  misc_feature 1..437: note = hyper
  source 1..437: mol_type = genomic DNA
cgtccgctcctcggtgaggccttccctggacaacgcatttgaaacgtaaccccaaggcaagaagccaccttccaggcgcgcagccgaagcccagtgccaaggaggccggagactcgggtgcccgcgcatcccgaaaacagcctctgaggggtcctctgagcatccttccagcgtgtttgggaggcaaactcgttgactagctcttgagaggagtggctagaggaatccaggcggggaaggggacggtggactccaggagagtgtaatttacaaaggcggggggcggggacgcccaggtccgagtcccaggactctgcgccggacgcttcgcccgccctttcaggtcccctgcccggtcctcgtacccgcgcgggtccggagaacctctgagcaccggcccccagcccccgggcggggctccagcggcgctactcacc

SEQ ID NO: 1487 - DNA, 413 bp, Homo sapiens
  misc_feature 1..413: note = chr20:55199898-55200311
  misc_feature 1..413: note = hyper
  source 1..413: mol_type = genomic DNA
actgaagaagtcctacgtaccgcttgtcatatacatatgtaaagataatttaaaaccctagggtatacccttttcaaatgcagagtttatagtttccaaggggaggagggcaggggaggagtaaccaggacctttcctgccagtcttccaatcgcgatagctcgttttggctgtgaatttccccccttcccctccccctcccgttaattaaataaacgctggaagcgtgtgtttaccgcacacgactcggccctcggggaactctttttctacgtctctcctactcttaaactcctcaactcacagagggttggagagctggcaccatgagcttccagttcctacgggtgagaaaagaggtgtctgtgtggagggcaggtgcgaccccgggggctagcagagaggagaggctg

SEQ ID NO: 1488 - DNA, 98 bp, Homo sapiens
  misc_feature 1..98: note = chr20:55200615-55200713
  misc_feature 1..98: note = hyper
  source 1..98: mol_type = genomic DNA
cgtacggatgggctccgggatgttagtggagaggtgacaggagtctaccatcccacggccaagcgtgtgaggcctccggcgggcgggggtcccccccg

SEQ ID NO: 1489 - DNA, 264 bp, Homo sapiens
  misc_feature 1..264: note = chr20:57224816-57225080
  misc_feature 1..264: note = hyper
  source 1..264: mol_type = genomic DNA
gcccagccctgctcgcggctctctcgattttatgtgggtttcgttggatgcattttgttatttgcctcaatggatgtttcacattaatttttagttgcacaacgaacgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccggg

SEQ ID NO: 1490 - DNA, 177 bp, Homo sapiens
  misc_feature 1..177: note = chr20:57225218-57225395
  misc_feature 1..177: note = hyper
  source 1..177: mol_type = genomic DNA
cgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcg

SEQ ID NO: 1491 - DNA, 29 bp, Homo sapiens
  misc_feature 1..29: note = chr20:61637928-61637957
  misc_feature 1..29: note = hyper
  source 1..29: mol_type = genomic DNA
ggggaggtcgccgcccgggcccggagtgc

SEQ ID NO: 1492 - DNA, 250 bp, Homo sapiens
  misc_feature 1..250: note = chr20:61638220-61638470
  misc_feature 1..250: note = hyper
  source 1..250: mol_type = genomic DNA
cgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggac

SEQ ID NO: 1493 - DNA, 118 bp, Homo sapiens
  misc_feature 1..118: note = chr20:61638534-61638652
  misc_feature 1..118: note = hyper
  source 1..118: mol_type = genomic DNA
cgactccccggccgccgcctccggccgccccggggattccgccaccaaacgcacgcgtcccaggtgggcacccgcctcggtccgtctttgagtctgaccctagcgcaagagtccctgg

SEQ ID NO: 1494 - DNA, 53 bp, Homo sapiens
  misc_feature 1..53: note = chr20:61703709-61703762
  misc_feature 1..53: note = hyper
  source 1..53: mol_type = genomic DNA
cggagggaggcccggcgggaacgggcgccccctttgcacccacagccgtggaa

SEQ ID NO: 1495 - DNA, 190 bp, Homo sapiens
  misc_feature 1..190: note = chr20:61703845-61704035
  misc_feature 1..190: note = hyper
  source 1..190: mol_type = genomic DNA
cgcccgaggccgggacggggtgtgggggcgtcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctca

SEQ ID NO: 1496 - DNA, 200 bp, Homo sapiens
  misc_feature 1..200: note = chr20:61808181-61808381
  misc_feature 1..200: note = hyper
  source 1..200: mol_type = genomic DNA
ccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccgg

SEQ ID NO: 1497 - DNA, 222 bp, Homo sapiens
  misc_feature 1..222: note = chr20:61808666-61808888
  misc_feature 1..222: note = hyper
  source 1..222: mol_type = genomic DNA
cgtttccttgggtctccgtgtggccgccgggcgcagggcacggtcgagggcgctcgatggctgagtccgcgtgagccgaggagcgcgcggggcgggacgcggtgcgaatgcgcgggaggcacgaggcgcgcagtgcgtgtgtgcgcgtgtgcgcggcgcgcgtgccccgcagttctcaaggacacctcggggaggcagcggcggggccggtgtccgggtgac

SEQ ID NO: 1498 - DNA, 117 bp, Homo sapiens
  misc_feature 1..117: note = chr20:61808889-61809006
  misc_feature 1..117: note = hyper
  source 1..117: mol_type = genomic DNA
tcaccgcgcgccccagtgataatcggccggtgccggagcggagcgcggatacgcgcggaggcaacggcgacggcggcggcggcggcgggcgcggggacagttgcatcggggccgggc

SEQ ID NO: 1499 - DNA, 339 bp, Homo sapiens
  misc_feature 1..339: note = chr20:61809218-61809557
  misc_feature 1..339: note = hyper
  source 1..339: mol_type = genomic DNA
cggctcccgccgggactggtaattacgctcggggccgggccggggcgagccgggcaagcggcctctctgggtctccccgtctttctctccacgaacagctcgagcgccttctcgcgggcccgctgcgcgcggagaggacgagctcgctgggttgtaaaaagagacgagttttcatctttgagcatcgagattcgttcttttaaccgcattcggtgcgcgctcctgggtcggcacgggcagggcgacggcaggggaaggcagctgcggaggagctcgcgccgcccagtcggagcggttctgcgcccctcggagccccgcgggaggcggccgggtgcgcac

SEQ ID NO: 1500 - DNA, 74 bp, Homo sapiens
  misc_feature 1..74: note = chr20:61809558-61809632
  misc_feature 1..74: note = hyper
  source 1..74: mol_type = genomic DNA
cgctcaccacccccacccccggaatccgtcttcgcgattcccgggcgccccagctccaggaacgcccggaggga

SEQ ID NO: 1501 - DNA, 295 bp, Homo sapiens
  misc_feature 1..295: note = chr20:61809840-61810135
  misc_feature 1..295: note = hyper
  source 1..295: mol_type = genomic DNA
cgccccagccctgagggcccctctgcgtgttcacagcggaccttgatttaatgtctatacaattaaggcacgcggtgaatgccaagagaggcgcctccgccgctcctttctcatggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctgg

SEQ ID NO: 1502 - DNA, 638 bp, Homo sapiens
  misc_feature 1..638: note = chr21:34392436-34393074
  misc_feature 1..638: note = hyper
  source 1..638: mol_type = genomic DNA
cgccctatccaggtgcgccgccgcaccatggatcaccgcgcccggtcccgcagtcccgccatggcctggggaggcccgaagcccggggacagtggccggcccatctccggctccgcggacccccggctcaggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctg

SEQ ID NO: 1503 - DNA, 696 bp, Homo sapiens
  misc_feature 1..696: note = chr21:34396045-34396741
  misc_feature 1..696: note = hyper
  source 1..696: mol_type = genomic DNA
aaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaa

SEQ ID NO: 1504 - DNA, 93 bp, Homo sapiens
  misc_feature 1..93: note = chr21:34399166-34399259
  misc_feature 1..93: note = hyper
  source 1..93: mol_type = genomic DNA
ggccatggactcggacgccagcctggtgtccagccgcccgtcgtcgccagagcccgatgacctttttctgccggcccggagtaagggcagcag

SEQ ID NO: 1505 - DNA, 664 bp, Homo sapiens
  misc_feature 1..664: note = chr21:34399441-34400105
  misc_feature 1..664: note = hyper
  source 1..664: mol_type = genomic DNA
cgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgc

SEQ ID NO: 1506 - DNA, 27 bp, Homo sapiens
  misc_feature 1..27: note = chr21:34400231-34400258
  misc_feature 1..27: note = hyper
  source 1..27: mol_type = genomic DNA
cgcgaggaggggcgcaggaccatggac

SEQ ID NO: 1507 - DNA, 382 bp, Homo sapiens
  misc_feature 1..382: note = chr21:34443981-34444363
  misc_feature 1..382: note = hyper
  source 1..382: mol_type = genomic DNA
cggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtac

SEQ ID NO: 1508 - DNA, 154 bp, Homo sapiens
  misc_feature 1..154: note = chr21:34444444-34444598
  misc_feature 1..154: note = hyper
  source 1..154: mol_type = genomic DNA
cgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttga

SEQ ID NO: 1509 - DNA, 96 bp, Homo sapiens
  misc_feature 1..96: note = chr21:36041933-36042029
  misc_feature 1..96: note = hyper
  source 1..96: mol_type = genomic DNA
actgaggccgaggagggagccccggagggtgccgaggtgccccaaggaggggaggagacaagcggcgcgcagcaggtggagggggcgagcccggga

SEQ ID NO: 1510 - DNA, 79 bp, Homo sapiens
  misc_feature 1..79: note = chr21:36042091-36042170
  misc_feature 1..79: note = hyper
  source 1..79: mol_type = genomic DNA
cgagaggcaggaggaggcggagcagaggcctgaggtcccggaaggtagcgcgtccggggaggcgggggacagcgtagac

SEQ ID NO: 1511 - DNA, 144 bp, Homo sapiens
  misc_feature 1..144: note = chr21:36042171-36042315
  misc_feature 1..144: note = hyper
  source 1..144: mol_type = genomic DNA
cggagggcccgctgggggacaacatagaagcggagggcccggcgggcgacagcgtagaggcggagggccgggtgggggacagcgtagacgcggaaggtccggcgggggacagcgtagacgcggagggcccgctgggggacaaca

SEQ ID NO: 1512 - DNA, 38 bp, Homo sapiens
  misc_feature 1..38: note = chr21:44494740-44494778
  misc_feature 1..38: note = hyper
  source 1..38: mol_type = genomic DNA
aatcttccagaaagccgtggacccgaggccccggcaga

SEQ ID NO: 1513 - DNA, 57 bp, Homo sapiens
  misc_feature 1..57: note = chr21:44494940-44494997
  misc_feature 1..57: note = hyper
  source 1..57: mol_type = genomic DNA
cgggctccccaagacaacagcgccgggcggccggatgcacgtgcgtcccgggaaggc

SEQ ID NO: 1514 - DNA, 122 bp, Homo sapiens
  misc_feature 1..122: note = chr21:44494998-44495120
  misc_feature 1..122: note = hyper
  source 1..122: mol_type = genomic DNA
ggttcagctggcatcgcctggccggttccgttcgctccttaaaccacaagacccccttggggtcacgacgttcccggggcacccctgcactcgcgcgccagcactcccggaggggcctgggg

SEQ ID NO: 1515 - DNA, 73 bp, Homo sapiens
  misc_feature 1..73: note = chr21:47010408-47010481
  misc_feature 1..73: note = hyper
  source 1..73: mol_type = genomic DNA
gccccgggagttcgaagggtgctggggccgaggggaaggctctggtcggcggcgtcagcggcagctcccagac

SEQ ID NO: 1516 - DNA, 15 bp, Homo sapiens
  misc_feature 1..15: note = chr22:19510932-19510947
  misc_feature 1..15: note = hyper
  source 1..15: mol_type = genomic DNA
ggagaaggtcagctg

SEQ ID NO: 1517 - DNA, 315 bp, Homo sapiens
  misc_feature 1..315: note = chr22:19511141-19511456
  misc_feature 1..315: note = hyper
  source 1..315: mol_type = genomic DNA
cgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggcca

SEQ ID NO: 1518 - DNA, 335 bp, Homo sapiens
  misc_feature 1..335: note = chr22:19511541-19511876
  misc_feature 1..335: note = hyper
  source 1..335: mol_type = genomic DNA
cgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcc

SEQ ID NO: 1519 - DNA, 67 bp, Homo sapiens
  misc_feature 1..67: note = chr22:19512252-19512319
  misc_feature 1..67: note = hyper
  source 1..67: mol_type = genomic DNA
cgacccccagtctgcaccacccagtccactcccacatccccgactgagccgggtggtctcttccact

SEQ ID NO: 1520 - DNA, 15 bp, Homo sapiens
  misc_feature 1..15: note = chr22:19512376-19512391
  misc_feature 1..15: note = hyper
  source 1..15: mol_type = genomic DNA
cgtagaggccctcgt

SEQ ID NO: 1521 - DNA, 198 bp, Homo sapiens
  misc_feature 1..198: note = chr22:33453877-33454075
  misc_feature 1..198: note = hyper
  source 1..198: mol_type = genomic DNA
gcaggtcctaggagccggcgcagagcagaggtccggccgctgcggttcctggtttcccgcaagctcttccccgggccgggcgctgggtggaggcagtcttaggatccacagtcttgcgcgcccccggctcccgggcccggcagacggcccccgcacgccgatctgtctgtcccagggaccggcccagggccccggcag

SEQ ID NO: 1522 - DNA, 66 bp, Homo sapiens
  misc_feature 1..66: note = chr22:33454193-33454259
  misc_feature 1..66: note = hyper
  source 1..66: mol_type = genomic DNA
cgcaccagcagcccccgctcgaggtggggtctcccggctgtcagaaaccccacaaagtctactttg

SEQ ID NO: 1523 - DNA, 90 bp, Homo sapiens
  misc_feature 1..90: note = chr22:33454345-33454435
  misc_feature 1..90: note = hyper
  source 1..90: mol_type = genomic DNA
gggtcccgggagctcagcctctgcccctcaacgcgcgcgagcgcccccgcccggcggcccggcctccccgcgccgcggcgccccattggc

SEQ ID NO: 1524 - DNA, 148 bp, Homo sapiens
  misc_feature 1..148: note = chr22:48971532-48971680
  misc_feature 1..148: note = hyper
  source 1..148: mol_type = genomic DNA
ggcaccgtccggtggggaccggcccgccagccccgggccgcgcaagttcgatcgccgcgggctcggccgggccgcgcggaccccggcggcggcgatggtgcggcagccccgcgcccggcgcgcagccccggccccgagcctggcccgc

SEQ ID NO: 1525 - DNA, 201 bp, Homo sapiens
  misc_feature 1..201: note = chr22:48971758-48971959
  misc_feature 1..201: note = hyper
  source 1..201: mol_type = genomic DNA
cggcggcggaggaagaggaggaggaggaaggcgacgccgagcagcgggcggtgggggccgacaggcggaggagggggccggggccgcgccggaccccccccccccccgcgccgcccggccgttgcgcaatccgcggcccgccgtccgggccctgctggcggtgcggctccgggggcggcggcggggctgattcatggggcc

SEQ ID NO: 1526 - DNA, 176 bp, Homo sapiens
  misc_feature 1..176: note = chr22:48971960-48972136
  misc_feature 1..176: note = hyper
  source 1..176: mol_type = genomic DNA
cggcggccgccccccggcgccccgcagccagcgatggtggccgagtggtcggagcggcggccgccgcggcccgagactttctgctaacctccccgcccccgcccgccccctccgcggcgcccccctccccccgcccgctcccctcccccctgcccagaaagacacaaatcgcctcc

SEQ ID NO: 1527 - DNA, 88 bp, Homo sapiens
  misc_feature 1..88: note = chr22:51042317-51042405
  misc_feature 1..88: note = hyper
  source 1..88: mol_type = genomic DNA
agtcgccagtgcgcccgggttgcgactgcgaagggaaccggcctgcggaaccccctgcgccaggggggacttcgccctcctcagatcc

SEQ ID NO: 1528 - DNA, 109 bp, Homo sapiens
  misc_feature 1..109: note = chr22:51042457-51042566
  misc_feature 1..109: note = hyper
  source 1..109: mol_type = genomic DNA
cgcagcagccaggagctgtcctcgcccggctccgactcggaggacgcgggcggcgccgcctggggcgcatgatctcgtccatctcggagacggagctggagctgagcag

SEQ ID NO: 1529 - DNA, 420 bp, Homo sapiens
  misc_feature 1..420: note = AC241851.2_88-34049:15130-15550
  misc_feature 1..420: note = hyper
  source 1..420: mol_type = genomic DNA
cttgcccccaccgcccgggctttttgcgccgcggctttttgctgctatttgtccctgccaccgcggcgttttgcccccgcagccgcggctccttgccccctacgcggcttcctgcctccgccaccgtggctttttatcaccccagccgctttttgaaccccccgccgcgggtttttgccgccgcggcttcttgcccccctcgccgcggctttttacccccacagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggtttttcccgcc

SEQ ID NO: 1530 - DNA, 146 bp, Homo sapiens
  misc_feature 1..146: note = chr1:1235932-1236078
  misc_feature 1..146: note = hypo
  source 1..146: mol_type = genomic DNA
tgagggtgagggccccggtggcttcctccacctcgtggggccggtgcctcggggcctgggcgttcctcaccagggacagctccaggtcctcccgcaccttgtcaaactgcttctttgtctccttgaacttccgcacatccctggag

SEQ ID NO: 1531 - DNA, 692 bp, Homo sapiens
  misc_feature 1..692: note = chr1:1267466-1268158
  misc_feature 1..692: note = hypo
  source 1..692: mol_type = genomic DNA
accgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccc

SEQ ID NO: 1532 - DNA, 128 bp, Homo sapiens
  misc_feature 1..128: note = chr1:6166321-6166449
  misc_feature 1..128: note = hypo
  source 1..128: mol_type = genomic DNA
gggaagtctcgaggacggctagatatctgtcaaaaaaagaggagagccgggcttgcctgacgttggcagcagcaggcaggccgggcccggcgggcacccgtgtgcatgctgcccggagcggacgggca

SEQ ID NO: 1533 - DNA, 156 bp, Homo sapiens
  misc_feature 1..156: note = chr1:39416821-39416977
  misc_feature 1..156: note = hypo
  source 1..156: mol_type = genomic DNA
tgctgtatatcataacgctgccttataaaatcacagcacatgtcagcgtcatgaagtctctaaccttctaagaagtccttcaacaaacaagtctgttcaatgttgcttcacctagcacttcccaaacttgtctgacttcttttcttttcttttttt

SEQ ID NO: 1534 - DNA, 37 bp, Homo sapiens
  misc_feature 1..37: note = chr1:45645619-45645656
  misc_feature 1..37: note = hypo
  source 1..37: mol_type = genomic DNA
aggagccaagatggccgaataggaacagctctggtct

SEQ ID NO: 1535 - DNA, 98 bp, Homo sapiens
  misc_feature 1..98: note = chr1:86860851-86860949
  misc_feature 1..98: note = hypo
  source 1..98: mol_type = genomic DNA
gttgcacttaaaactccaagaacctcattcattcaaaaacacttgaaaccgtactatgcgttgcgtgatgaggaaactgtcttcgaaatagattttat

SEQ ID NO: 1536 - DNA, 28 bp, Homo sapiens
  misc_feature 1..28: note = chr1:94343568-94343596
  misc_feature 1..28: note = hypo
  source 1..28: mol_type = genomic DNA
aaatcaaaatttggccgggcgcggtggc

SEQ ID NO: 1537 - DNA, 79 bp, Homo sapiens
  misc_feature 1..79: note = chr1:151170062-151170141
  misc_feature 1..79: note = hypo
  source 1..79: mol_type = genomic DNA
tgttttaatggagttatttcatgggccatgagtttgagaggatctatctgaccgactcttaccccgaatgttttaccat

SEQ ID NO: 1538 - DNA, 102 bp, Homo sapiens
  misc_feature 1..102: note = chr1:151252684-151252786
  misc_feature 1..102: note = hypo
  source 1..102: mol_type = genomic DNA
gaaactctccgggtgcgccggggagtcctggttccggtgtcctgggactcctgggcagggtaacgaaaccacttttaaaaactttgccgggcccggtgggtc

SEQ ID NO: 1539 - DNA, 45 bp, Homo sapiens
  misc_feature 1..45: note = chr1:153937124-153937169
  misc_feature 1..45: note = hypo
  source 1..45: mol_type = genomic DNA
gacttcttaaggggccgggcgcggtggttcacgcctgtaatccaa

SEQ ID NO: 1540 - DNA, 40 bp, Homo sapiens
  misc_feature 1..40: note = chr1:156030121-156030161
  misc_feature 1..40: note = hypo
  source 1..40: mol_type = genomic DNA
ccttcaggatggtctcgatctcctgaccttgtgatccgcc

SEQ ID NO: 1541 - DNA, 16 bp, Homo sapiens
  misc_feature 1..16: note = chr1:158591676-158591692
  misc_feature 1..16: note = hypo
  source 1..16: mol_type = genomic DNA
ggagtcttgctctgtc

SEQ ID NO: 1542 - DNA, 15 bp, Homo sapiens
  misc_feature 1..15: note = chr1:158591932-158591947
  misc_feature 1..15: note = hypo
  source 1..15: mol_type = genomic DNA
cgtgagccactgcac

SEQ ID NO: 1543 - DNA, 199 bp, Homo sapiens
  misc_feature 1..199: note = chr1:195732322-195732521
  misc_feature 1..199: note = hypo
  source 1..199: mol_type = genomic DNA
tgagattttggtggccgcggaaagtaggaacgagagagctggagcacgccccctacctctttggcctctgtggttgctggcgtctcactcaggtttttgggtgccactgtgttcccctcatccagaccctggtacttgcagcggaagccgcctgtggtacacctggtccagctgcagcctcgcaaggagctggtgccgg

SEQ ID NO: 1544 - DNA, 80 bp, Homo sapiens
  misc_feature 1..80: note = chr2:10156306-10156386
  misc_feature 1..80: note = hypo
  source 1..80: mol_type = genomic DNA
ggtggacaggcgtgtgtatgggtgagtcaggtggaccactgtgtgtacgggcgagtcaggtggaccggcgtgcatatggg

SEQ ID NO: 1545 - DNA, 39 bp, Homo sapiens
  misc_feature 1..39: note = chr2:20642609-20642648
  misc_feature 1..39: note = hypo
  source 1..39: mol_type = genomic DNA
acaggcgtgagccaccgcgcccggcggaaatatttttaa

SEQ ID NO: 1546 - DNA, 240 bp, Homo sapiens
  misc_feature 1..240: note = chr2:47598278-47598518
  misc_feature 1..240: note = hypo
  source 1..240: mol_type = genomic DNA
cggccttaaaaacaagatttaaaatggtgactggtatgttgcaccgttattcaaatgttagacatgtagtttgatttcagtttctcttaactgtggaataaacaacttggctgccgtctctctctctctcttttttttggaaacagtgtctccgtctgtcgttcagcctggagtgcagtggcacatttacatgtcactgcgtcctccatttcccaggctcaagcgatgctcttacttgga

SEQ ID NO: 1547 - DNA, 42 bp, Homo sapiens
  misc_feature 1..42: note = chr2:47598578-47598620
  misc_feature 1..42: note = hypo
  source 1..42: mol_type = genomic DNA
gtaagatggtgcctagaagtggagtggcgtttgccaaaggtc

SEQ ID NO: 1548 - DNA, 24 bp, Homo sapiens
  misc_feature 1..24: note = chr2:67625740-67625764
  misc_feature 1..24: note = hypo
  source 1..24: mol_type = genomic DNA
tacagccaccgcgcccggccacct

SEQ ID NO: 1549 - DNA, 160 bp, Homo sapiens
  misc_feature 1..160: note = chr2:74454159-74454319
  misc_feature 1..160: note = hypo
  source 1..160: mol_type = genomic DNA
gtgaagaggtggatccggcgcagcggcacgtgccgcaggaaggcatggtccggctggtgcttggctggcatcaggaagagcttgcagcgttcccagaactagggggacagcgggggctcagccaggcagccagaccccgagggcccgctgggtcctggga

SEQ ID NO: 1550 - DNA, 92 bp, Homo sapiens
  misc_feature 1..92: note = chr2:97427763-97427855
  misc_feature 1..92: note = hypo
  source 1..92: mol_type = genomic DNA
agatgttgaaggtgacggagccctataatgacctcgtgaaagaggagctcaatatgatccagggtgccctggaactacggaccaaaactgta

SEQ ID NO: 1551 - DNA, 100 bp, Homo sapiens
  misc_feature 1..100: note = chr2:99798646-99798746
  misc_feature 1..100: note = hypo
  source 1..100: mol_type = genomic DNA
ttttacagaagacagcgtaattgtttcagggtccaggagttacgtgcctaattattaacagtaacttttactttattaaaacgtattccttgccgggcgt

SEQ ID NO: 1552 - DNA, 21 bp, Homo sapiens
  misc_feature 1..21: note = chr2:128616617-128616638
  misc_feature 1..21: note = hypo
  source 1..21: mol_type = genomic DNA
aaaaatgaattgtgccgggca

SEQ ID NO: 1553 - DNA, 39 bp, Homo sapiens
  misc_feature 1..39: note = chr2:128847684-128847723
  misc_feature 1..39: note = hypo
  source 1..39: mol_type = genomic DNA
atcctcagcgtgagccaccgcgcccggcctccatcagtg

SEQ ID NO: 1554 - DNA, 27 bp, Homo sapiens
  misc_feature 1..27: note = chr2:170681885-170681912
  misc_feature 1..27: note = hypo
  source 1..27: mol_type = genomic DNA
agaggcagggcgcggcggctcacgcct

SEQ ID NO: 1555 - DNA, 27 bp, Homo sapiens
  misc_feature 1..27: note = chr2:170682152-170682179
  misc_feature 1..27: note = hypo
  source 1..27: mol_type = genomic DNA
agagcgagactccgtctcaaaaaaaaa

SEQ ID NO: 1556 - DNA, 143 bp, Homo sapiens
  misc_feature 1..143: note = chr3:101230961-101231104
  misc_feature 1..143: note = hypo
  source 1..143: mol_type = genomic DNA
ccaataaatctgtaattgttaactgtctctgcagaaaccaacggtaccatcagaaacagaaaaatgaaatgaaataattgattcattgggcgttcgtttgtgtactggactgtaagcatatgagtcctcgtcctctcctccta

SEQ ID NO: 1557 - DNA, 235 bp, Homo sapiens
  misc_feature 1..235: note = chr3:169540374-169540609
  misc_feature 1..235: note = hypo
  source 1..235: mol_type = genomic DNA
ccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcagg

SEQ ID NO: 1558 - DNA, 90 bp, Homo sapiens
  misc_feature 1..90: note = chr3:185271296-185271386
  misc_feature 1..90: note = hypo
  source 1..90: mol_type = genomic DNA
taattccctttctggcgagagtgcttgcaacactaactcaggcttctagtggtctgatgagcttaaaaatcaattaataagccgggcgcg

SEQ ID NO: 1559 - DNA, 86 bp, Homo sapiens
  misc_feature 1..86: note = chr4:95127609-95127695
  misc_feature 1..86: note = hypo
  source 1..86: mol_type = genomic DNA
tgagaaacggtagaacgatggctaccagaggctgggaagggtagtgtggggcgggggaggaccccggtggtcggtgagcatggtta

SEQ ID NO: 1560 - DNA, 836 bp, Homo sapiens; identical to SEQ ID NO: 409
  misc_feature 1..836: note = chr5:1294607-1295443
  misc_feature 1..836: note = hypo
  source 1..836: mol_type = genomic DNA

SEQ ID NO: 1561 - DNA, 33 bp, Homo sapiens
  misc_feature 1..33: note = chr5:43402630-43402663
  misc_feature 1..33: note = hypo
  source 1..33: mol_type = genomic DNA
aaaattggtgtgtgccggttccaagatggccga

SEQ ID NO: 1562 - DNA, 30 bp, Homo sapiens
  misc_feature 1..30: note = chr5:154209957-154209987
  misc_feature 1..30: note = hypo
  source 1..30: mol_type = genomic DNA
gttatccattgttttcgcagctgtctccct

SEQ ID NO: 1563 - DNA, 19 bp, Homo sapiens
  misc_feature 1..19: note = chr5:154318148-154318167
  misc_feature 1..19: note = hypo
  source 1..19: mol_type = genomic DNA
atatgcacaagaggccggg

SEQ ID NO: 1564 - DNA, 30 bp, Homo sapiens
  misc_feature 1..30: note = chr6:4951289-4951319
  misc_feature 1..30: note = hypo
  source 1..30: mol_type = genomic DNA
gtgctctccaagctgcgggtttcacatgca

SEQ ID NO: 1565 - DNA, 186 bp, Homo sapiens
  misc_feature 1..186: note = chr6:12288517-12288703
  misc_feature 1..186: note = hypo
  source 1..186: mol_type = genomic DNA
aggccacctttcttccgcgggagtgttgggggggaggcgctgcttggaacctgtgaatgtgacatcagctctcctctcctctcccaaggtcggctttggagagggaggtcagggcacccttgcctggcacaggcggcagcgctggcttccggctcagtgccgcctgtcctccgggagctgtggcct

SEQ ID NO: 1566 - DNA, 97 bp, Homo sapiens
  misc_feature 1..97: note = chr6:86302345-86302442
  misc_feature 1..97: note = hypo
  source 1..97: mol_type = genomic DNA
tcaattttaacctttcggaatatttcaggtttttttggggagggtggcatcaagtcctcttaagaatattatagggatgtggccgggtgcggtggct

SEQ ID NO: 1567 - DNA, 24 bp, Homo sapiens
  misc_feature 1..24: note = chr6:134067447-134067471
  misc_feature 1..24: note = hypo
  source 1..24: mol_type = genomic DNA
gagccaccgcgcccagcctgcctg

SEQ ID NO: 1568 - DNA, 104 bp, Homo sapiens
  misc_feature 1..104: note = chr6:134589500-134589604
  misc_feature 1..104: note = hypo
  source 1..104: mol_type = genomic DNA
caactgtttgtgaagcgcattgtaaacaaacatagacggggtgagacatcctctttatcctgaataaatcaagaattcccaggccgggcgctgtggctcatgcc

SEQ ID NO: 1569 - DNA, 89 bp, Homo sapiens
  misc_feature 1..89: note = chr7:1641847-1641936
  misc_feature 1..89: note = hypo
  source 1..89: mol_type = genomic DNA
ttgtctgtgccatttcggtgccttttgtccttgcttcccgccgctccttgaggatgtttaccggctgctggggccgtgccttccaggtg

SEQ ID NO: 1570 - DNA, 164 bp, Homo sapiens
  misc_feature 1..164: note = chr7:1733214-1733378
  misc_feature 1..164: note = hypo
  source 1..164: mol_type = genomic DNA
catctgcagaggggtcggtgtacaccgctgtgtgaacacctccggcggtgcccagtccgtgtgaacacatgcaggtgagcacagacacatgcgtgcatgccctctgtgtgtctacagacagctgtgtgcgccacactcaccctcccgctcgtccccatggcaac

SEQ ID NO: 1571 - DNA, 85 bp, Homo sapiens
  misc_feature 1..85: note = chr7:6124629-6124714
  misc_feature 1..85: note = hypo
  source 1..85: mol_type = genomic DNA
gcgagccaccgcacccagccaaggactcttaagtgtaactgatccaccctacttttctccctggcatgaacgactgtgcccagcc

SEQ ID NO: 1572 - DNA, 273 bp, Homo sapiens
  misc_feature 1..273: note = chr7:7605157-7605430
  misc_feature 1..273: note = hypo
  source 1..273: mol_type = genomic DNA
cctcgaggtcagactcgtgacacctgaggcagcaccattcactcagttttgggaacaaaaaacttggaatcctctttcaccgtcattcacttggtcagtcaccaagctctgttcatcccgccttctaagtattccccagggcccccacttctctccatgcccactctccgtgccactggtaacctgcgtttctatcatccctcattctgatactctatccctccagctctctgcgcaaaaactgatcatactggccgggcacagtggctcatg

SEQ ID NO: 1573 - DNA, 152 bp, Homo sapiens
  misc_feature 1..152: note = chr7:7605670-7605822
  misc_feature 1..152: note = hypo
  source 1..152: mol_type = genomic DNA
atagccagactccgtctcaaaaaaaacaaaacaaaacaaaaaactgatcataccacttgcctgattaaaaactttcgatgactctaacattgcctttaggtaaatgccatccaaactcactaaactggtttccaacccgtttctgaaagcac

SEQ ID NO: 1574 - DNA, 264 bp, Homo sapiens
  misc_feature 1..264: note = chr7:44835120-44835384
  misc_feature 1..264: note = hypo
  source 1..264: mol_type = genomic DNA
ctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtg

SEQ ID NO: 1575 - DNA, 30 bp, Homo sapiens
  misc_feature 1..30: note = chr7:128097589-128097619
  misc_feature 1..30: note = hypo
  source 1..30: mol_type = genomic DNA
agacaagctgagcaccgttgtaaccagaga

SEQ ID NO: 1576 - DNA, 223 bp, Homo sapiens
  misc_feature 1..223: note = chr7:155581330-155581553
  misc_feature 1..223: note = hypo
  source 1..223: mol_type = genomic DNA
ggtccactgcccagccggggatgcaaggacggccatggggctccagcacagggaccgggccccgcgggctttgagtgacgcggtaggccaggacgagccccatccacacttggacaatgagcaaccgcagccggccgcgcagcctgggggccgtctccctctccagcccccgtgtcctctggtccacgactggctcttgccctcattccgttggggctgagtc

SEQ ID NO: 1577 - DNA, 22 bp, Homo sapiens
  misc_feature 1..22: note = chr8:66560523-66560545
  misc_feature 1..22: note = hypo
  source 1..22: mol_type = genomic DNA
ttacaggcgtgagtcaccatgc

SEQ ID NO: 1578 - DNA, 137 bp, Homo sapiens
  misc_feature 1..137: note = chr8:90913516-90913653
  misc_feature 1..137: note = hypo
  source 1..137: mol_type = genomic DNA
gtccgcctcggccttccaaaaggaatttaggtactttaaaatgctgttatgtatgttaacggaaaagtaactacatgcttcattttcagaaccaacattcaaatgaaatgaacgtgtcaaatcgacaaaagctcaaa

SEQ ID NO: 1579 - DNA, 16 bp, Homo sapiens
  misc_feature 1..16: note = chr8:103629866-103629882
  misc_feature 1..16: note = hypo
  source 1..16: mol_type = genomic DNA
acgtagacctaacaaa

SEQ ID NO: 1580 - DNA, 91 bp, Homo sapiens
  misc_feature 1..91: note = chr8:133686745-133686836
  misc_feature 1..91: note = hypo
  source 1..91: mol_type = genomic DNA
tggggagctcaaaaacgttgtcgatatcaaaatggttcatacaatataaataacttacccgcatcaccttgcagtttgttagtatattctt

SEQ ID NO: 1581 - DNA, 105 bp, Homo sapiens
  misc_feature 1..105: note = chr9:6756353-6756458
  misc_feature 1..105: note = hypo
  source 1..105: mol_type = genomic DNA
tggttgggatcctgacgttacatgcacacatttggaaaattcccagttgagtatacgttagccaagttcagaattgtgtgtggccgggtgaagtggctcacgcct

SEQ ID NO: 1582 - DNA, 22 bp, Homo sapiens
  misc_feature 1..22: note = chr9:131580093-131580115
  misc_feature 1..22: note = hypo
  source 1..22: mol_type = genomic DNA
tttgccaatctgggccgggcgc

SEQ ID NO: 1583 - DNA, 121 bp, Homo sapiens
  misc_feature 1..121: note = chr9:139012272-139012393
  misc_feature 1..121: note = hypo
  source 1..121: mol_type = genomic DNA
ccctcccatgtggctcgtgctgggacgccggcaccgtgagatggcgcccgtggccagatagagggtggcgtgtaaagcaggtggtcacccgtcactcgacttttcgcgtgctggtgagggt

SEQ ID NO: 1584 - DNA, 17 bp, Homo sapiens
  misc_feature 1..17: note = chr9:139703929-139703946
  misc_feature 1..17: note = hypo
  source 1..17: mol_type = genomic DNA
atgaaagttggtgtccg

SEQ ID NO: 1585 - DNA, 136 bp, Homo sapiens
  misc_feature 1..136: note = chr9:139704066-139704202
  misc_feature 1..136: note = hypo
  source 1..136: mol_type = genomic DNA
aaatacgaaaaaaaaatttaaaagaaagttgatgtccgaaccaagggccgtattggcttttcttatactctagaacatacgacgacaaagaagattttgatgaagttcaaattagagtcagcgtgctcatcagaaa

SEQ ID NO: 1586 - DNA, 37 bp, Homo sapiens
  misc_feature 1..37: note = chr10:5875322-5875359
  misc_feature 1..37: note = hypo
  source 1..37: mol_type = genomic DNA
aaagagaaaaggggccgggcgcagtggctcacgcctg

SEQ ID NO: 1587 - DNA, 226 bp, Homo sapiens
  misc_feature 1..226: note = chr10:98129781-98130007
  misc_feature 1..226: note = hypo
  source 1..226: mol_type = genomic DNA
catcacactctgccccggccccagcgtctccgggacttaccccagagccacagaagcggccgagcctgggcgctgagctgtcgtagccgtcgtaggcttccatgtagtcgtagccgcagtcggcctcctcctcaacctcaaaggtccggaatgtcagctccacgccgtagccgtcctctgccacgatcacccagtcacagcgggcctcgctcgggtagttgttgtc

SEQ ID NO: 1588 - DNA, 22 bp, Homo sapiens
  misc_feature 1..22: note = chr10:98528164-98528186
  misc_feature 1..22: note = hypo
  source 1..22: mol_type = genomic DNA
cagaccacggactgatacaggt

SEQ ID NO: 1589 - DNA, 421 bp, Homo sapiens
  misc_feature 1..421: note = chr10:133951502-133951923
  misc_feature 1..421: note = hypo
  source 1..421: mol_type = genomic DNA
agccagcccagacaccgtcttccctgtcatccaaatgatggcacacgggcagtaaaccgtggactgaaaccggtggagctgctctaccacttacacaacctcttcaactggcttccgcaggagcgggacaagctgttaagattccggaagcaaagaaagaaaatggcaaaacttcccaaggtaaggaacagcacaccggcacgtgcggagagtacgccgggtgtgtgcggagaggaccacgcccgcgtgtgtggagagcgctggtgtgtgcggagaggggtgcgccggtgtacgtggagggcgctgggtgtgtgtgccgaggaccgcgcccacgtgtgtggagagtatgccgggtgcgtgtggagaggaccgcgcccgcgtgtgtggagagtacgccgggtgtgtgcggagaggggtgcgc

SEQ ID NO: 1590 - DNA, 212 bp, Homo sapiens
  misc_feature 1..212: note = chr10:134095580-134095792
  misc_feature 1..212: note = hypo
  source 1..212: mol_type = genomic DNA
ctccgggggtgggggcgacaggtgctgggcggggaggcgctacattgtgtaacactcagcagccacgctacacttgggaagagcggatgtgctgaaaatgcccagtgcaggaccaaggtgcgccaaccagcccgcaccacgcccgagaggcttcgcagccgcccaccccggctctcacagcgcccatccctgccacacgccctgccagctgc

SEQ ID NO: 1591 - DNA, 163 bp, Homo sapiens
  misc_feature 1..163: note = chr11:9405392-9405555
  misc_feature 1..163: note = hypo
  source 1..163: mol_type = genomic DNA
tggtaattactaatacgtaatgtgataaaaacctttcacacataaagttcatttaatcttccgtgttattgccttaggataaagtctcataagtggaattactgggtcagagtttaaacatttcgtttcgttttgtttttttgagacggagtttcgctcttgt

SEQ ID NO: 1592 - DNA, 82 bp, Homo sapiens
  misc_feature 1..82: note = chr11:66513182-66513264
  misc_feature 1..82: note = hypo
  source 1..82: mol_type = genomic DNA
ggctagaacccagggcgctgactcataggccagtgttcttttcccaactgcgctgtcataccgacatgagaatatctttagg

SEQ ID NO: 1593 - DNA, 82 bp, Homo sapiens
  misc_feature 1..82: note = chr11:66513564-66513646
  misc_feature 1..82: note = hypo
  source 1..82: mol_type = genomic DNA
caccgtgcccggcccgatatgggaatatcgtaacagaggacgtgtgaaggaatagttagactctacacgtacctggaaacca

SEQ ID NO: 1594 - DNA, 157 bp, Homo sapiens
  misc_feature 1..157: note = chr11:67072239-67072396
  misc_feature 1..157: note = hypo
  source 1..157: mol_type = genomic DNA
ccaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatccca

SEQ ID NO: 1595 - DNA, 72 bp, Homo sapiens
  misc_feature 1..72: note = chr11:69280561-69280633
  misc_feature 1..72: note = hypo
  source 1..72: mol_type = genomic DNA
gagaacactgactcccggggaggtggattacctgtcctcccggcaaagcgcaggactcgcagtttggcaagc

SEQ ID NO: 1596 - DNA, 45 bp, Homo sapiens
  misc_feature 1..45: note = chr11:102961347-102961392
  misc_feature 1..45: note = hypo
  source 1..45: mol_type = genomic DNA
aaagcatttctcagtcgggcgaggtggctcactcctgtaatccca

SEQ ID NO: 1597 - DNA, 89 bp, Homo sapiens
  misc_feature 1..89: note = chr12:12848467-12848556
  misc_feature 1..89: note = hypo
  source 1..89: mol_type = genomic DNA
attggtcagatccctcgagacagttcccaaattcctgacttctgttaccgcgactgttcttcgcaattccacctcggcctgtgttcagg

SEQ ID NO: 1598 - DNA, 147 bp, Homo sapiens
  misc_feature 1..147: note = chr12:49657607-49657754
  misc_feature 1..147: note = hypo
  source 1..147: mol_type = genomic DNA
aagggtttaattcctcggagctctactttcctcatctgtaaactagggataataattcatagagtttgtcatatggatgaaatgtgatcatgtgatatgaaaagccaactactcggccaggcgcggtggctcacgcctgtattccca

SEQ ID NO: 1599 - DNA, 97 bp, Homo sapiens
  misc_feature 1..97: note = chr12:54720206-54720303
  misc_feature 1..97: note = hypo
  source 1..97: mol_type = genomic DNA
agccactgcgccgggccaggaattcttattgtatgatctaggatgctaatttctccctctctggttacatgagaattgtggtcgctaaagggctgta

SEQ ID NO: 1600 - DNA, 23 bp, Homo sapiens
  misc_feature 1..23: note = chr12:96881015-96881038
  misc_feature 1..23: note = hypo
  source 1..23: mol_type = genomic DNA
gtgagccacgacacccagccaat

SEQ ID NO: 1601 - DNA, 101 bp, Homo sapiens
  misc_feature 1..101: note = chr12:122278479-122278580
  misc_feature 1..101: note = hypo
  source 1..101: mol_type = genomic DNA
acaggcgtgagccaccatgacctgctgcgggatcttttaaaagtcggatcatgtcattcccctgtttaaaatcctccagtggaaatcggaaccctcatgta

SEQ ID NO: 1602 - DNA, 522 bp, Homo sapiens
  misc_feature 1..522: note = chr12:132221602-132222124
  misc_feature 1..522: note = hypo
  source 1..522: mol_type = genomic DNA
agcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgtatcggcacctaaaagggcaggtaagaaggaccagtggccagcacagagaggggaactggaaggacgaggtcgcagacaggagtggctgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccg

SEQ ID NO: 1603 - DNA, 528 bp, Homo sapiens
  misc_feature 1..528: note = chr13:114780555-114781083
  misc_feature 1..528: note = hypo
  source 1..528: mol_type = genomic DNA
cggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgt

SEQ ID NO: 1604 - DNA, 85 bp, Homo sapiens
  misc_feature 1..85: note = chr15:78596048-78596133
  misc_feature 1..85: note = hypo
  source 1..85: mol_type = genomic DNA
caggcgtgagccaccgcgcccggccactgtttacactattgttgcagtagctgctgccatcaccgggctgcggcagggaggcaca

SEQ ID NO: 1605 - DNA, 283 bp, Homo sapiens
  misc_feature 1..283: note = chr16:726729-727012
  misc_feature 1..283: note = hypo
  source 1..283: mol_type = genomic DNA
tgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccaggtgggccccccggccgctgccccgggagcctcccgcgctcctggccatgaccagcctaacactcgtgtccccagatcatcgtgttcctgtgttacggggcccgcctcaacaagtgg

SEQ ID NO: 1606 - DNA, 205 bp, Homo sapiens
  misc_feature 1..205: note = chr16:845955-846160
  misc_feature 1..205: note = hypo
  source 1..205: mol_type = genomic DNA
cagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccagga

SEQ ID NO: 1607 - DNA, 28 bp, Homo sapiens
  misc_feature 1..28: note = chr16:1407453-1407481
  misc_feature 1..28: note = hypo
  source 1..28: mol_type = genomic DNA
agtcacccagcacctcgtgtgtatttcg

SEQ ID NO: 1608 - DNA, 336 bp, Homo sapiens
  misc_feature 1..336: note = chr16:2234684-2235020
  misc_feature 1..336: note = hypo
  source 1..336: mol_type = genomic DNA
ccaggccaggcaggccgtgtaagcacccatcagcccatcggccttacagcctctccccggagcccacgctgagaacacccccaagccctgtaccttgccctccgatgctggctccagcttcttgggcggctgctccccatagacctgcccggcgtgggccactggaggctgggaccgggccacacctgaggacgagagtgggtgggggacaagggctgtcgggctgctttcctccatcgggctgcgtggcagcacccttgctcttacctgcagagccttccggaggcttggcggggctgtcccccgggccggactcagagacggacttctgggaaa

SEQ ID NO: 1609 - DNA, 197 bp, Homo sapiens
  misc_feature 1..197: note = chr16:31446899-31447096
  misc_feature 1..197: note = hypo
  source 1..197: mol_type = genomic DNA
cgcccgcagccgcacctgcctaaatcccttaatgtataagggaaaggagcgagaattcaggggaaaaaaaacaaacaaaatagcccccagcacttctgagaaagatctgccatacagaaaagccgtcctgagcgggtctgtgtggagggaggggactgcatctcagatccacagtccaccggcggctgcaacaattc

SEQ ID NO: 1610 - DNA, 18 bp, Homo sapiens
  misc_feature 1..18: note = chr16:68876852-68876870
  misc_feature 1..18: note = hypo
  source 1..18: mol_type = genomic DNA
tttgagatggagtctcgc

SEQ ID NO: 1611 - DNA, 465 bp, Homo sapiens
  misc_feature 1..465: note = chr16:87723648-87724113
  misc_feature 1..465: note = hypo
  source 1..465: mol_type = genomic DNA
gggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatgggga

SEQ ID NO: 1612 - DNA, 312 bp, Homo sapiens
  misc_feature 1..312: note = chr16:88943712-88944024
  misc_feature 1..312: note = hypo
  source 1..312: mol_type = genomic DNA
ctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggc

SEQ ID NO: 1613 - DNA, 71 bp, Homo sapiens
  misc_feature 1..71: note = chr16:89220327-89220398
  misc_feature 1..71: note = hypo
  source 1..71: mol_type = genomic DNA
gggcagagacagctgcggtggcccggtgcacctgcctggcctcaggatggccgaggcgcctggcaaggctg

SEQ ID NO: 1614 - DNA, 120 bp, Homo sapiens
  misc_feature 1..120: note = chr17:2207818-2207938
  misc_feature 1..120: note = hypo
  source 1..120: mol_type = genomic DNA
gagccaccgcgcccggccgccccctgacttttaaaaactagatacgatatagttggaatcgtgtggaaggaagtacatcaggaggcatataagtccatttgggacctgtaatcccggcga

SEQ ID NO: 1615 - DNA, 30 bp, Homo sapiens
  misc_feature 1..30: note = chr17:3658849-3658879
  misc_feature 1..30: note = hypo
  source 1..30: mol_type = genomic DNA
gcacacagaaaaaagcgacctcctgtcatc

SEQ ID NO: 1616 - DNA, 142 bp, Homo sapiens
  misc_feature 1..142: note = chr17:25620573-25620715
  misc_feature 1..142: note = hypo
  source 1..142: mol_type = genomic DNA
agtccagagaggccccgcggcgcggtgcggcgcgatcacgcccgagtctccttctcgttcccctcggcccttcctaaaacctgctggctcaggtctgaacaatcgcagctggacaggtggtgcacaacgatgttaattttca

SEQ ID NO: 1617 - DNA, 33 bp, Homo sapiens
  misc_feature 1..33: note = chr17:26927180-26927213
  misc_feature 1..33: note = hypo
  source 1..33: mol_type = genomic DNA
aaatatcgccaggtgcggtggctcatgcctgta

SEQ ID NO: 1618 - DNA, 146 bp, Homo sapiens
  misc_feature 1..146: note = chr17:39682499-39682645
  misc_feature 1..146: note = hypo
  source 1..146: mol_type = genomic DNA
acaggcatgagccaccgcgcccggccgattgtgtagttttttaatgcaacagaataggctacaaaatatcagaggggatttctcttagtatggtgagaattgtgtcacccatttgtgtgtgtgcatgtgcacgcacacacacacac

SEQ ID NO: 1619 - DNA, 102 bp, Homo sapiens
  misc_feature 1..102: note = chr17:42331669-42331771
  misc_feature 1..102: note = hypo
  source 1..102: mol_type = genomic DNA
ctccaaattatacaacttctggtcccacaaaacctggaactgcccctggcttttcactattcctgctagtcgggagggccacacacccgcagggactagctt

SEQ ID NO: 1620 - DNA, 120 bp, Homo sapiens
  misc_feature 1..120: note = chr17:49229470-49229590
  misc_feature 1..120: note = hypo
  source 1..120: mol_type = genomic DNA
gtcacgagaatcgcttgaacccggatggcggagtttgcaatgaaccgacatcgtgcaactgcgctccggcctgggcgccaaagcgatactcggtctcaaaaagaaaaaaaagaaaacagg

SEQ ID NO: 1621 - DNA, 37 bp, Homo sapiens
  misc_feature 1..37: note = chr17:57297023-57297060
  misc_feature 1..37: note = hypo
  source 1..37: mol_type = genomic DNA
ggattacaggcgtgggccaccgcgcccggctgaatca

SEQ ID NO: 1622 - DNA, 19 bp, Homo sapiens
  misc_feature 1..19: note = chr17:73031621-73031640
  misc_feature 1..19: note = hypo
  source 1..19: mol_type = genomic DNA
actccagtctctggccggg

SEQ ID NO: 1623 - DNA, 31 bp, Homo sapiens
  misc_feature 1..31: note = chr17:76211256-76211287
  misc_feature 1..31: note = hypo
  source 1..31: mol_type = genomic DNA
ggaggctgaggcgggcggatcacctgaggtc

SEQ ID NO: 1624 - DNA, 91 bp, Homo sapiens
  misc_feature 1..91: note = chr17:76211527-76211618
  misc_feature 1..91: note = hypo
  source 1..91: mol_type = genomic DNA
agaaagcatatacttcagtgttgttctggatttttttcttcaagatgcctagttaatgacaatgaaattctgtactcggatggtatctgtc

SEQ ID NO: 1625 - DNA, 309 bp, Homo sapiens
  misc_feature 1..309: note = chr17:79769384-79769693
  misc_feature 1..309: note = hypo
  source 1..309: mol_type = genomic DNA
cagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtg

SEQ ID NO: 1626 - DNA, 67 bp, Homo sapiens
  misc_feature 1..67: note = chr17:80797692-80797759
  misc_feature 1..67: note = hypo
  source 1..67: mol_type = genomic DNA
aaggcagagcagacacggagcaaacgctgcgttcagctgggtattttagatacgtctgagaagagtt

SEQ ID NO: 1627 - DNA, 723 bp, Homo sapiens
  misc_feature 1..723: note = chr17:80797997-80798720
  misc_feature 1..723: note = hypo
  source 1..723: mol_type = genomic DNA
tgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgg

SEQ ID NO: 1628 - DNA, 30 bp, Homo sapiens
  misc_feature 1..30: note = chr18:77329727-77329757
  misc_feature 1..30: note = hypo
  source 1..30: mol_type = genomic DNA
cagtacaacaggacacgctctcaccttcac

SEQ ID NO: 1629 - DNA, 632 bp, Homo sapiens
  misc_feature 1..632: note = chr19:883582-884214
  misc_feature 1..632: note = hypo
  source 1..632: mol_type = genomic DNA
ggcatgtgtgtgagacgtggctctcgggcgggtaacagctgggccagcaggtgaggacggctgcaggagacgaggaggagtgtcggagcccaggactgcccagtggcttggctgtgggcagatggtagacacagacgtgcccagcgggggcaccgggcagtgaaggtgcaggtctgtgcagccacacggggtggcgccaggtgctgctgcaggagccagcgcagcccaaactgcctggtgactcaccacgaggcccaggggaaggaatgaggcccaacaaggccctggggaccgggcgaaggaacgagccctgggagaaggaatggcagcagccctcttcacctgcctggtgactcactacaagccctgggggaaggaatggcagtggccctcttcacctttactgcctctgcggccacaatgggcagttgacataaccacctgcaggccccgggagccatcggggcctcttgacacgtgctcattagtggcttctgaggagcgcctgccccacctgccccacgtgcccccacgtctggccactccagggtccattagcgctaatcggcaaatgcctgtgctctcatctaccgggaaaacatctcccttctccagagcggaggccagcctaa

SEQ ID NO: 1630 - DNA, 460 bp, Homo sapiens
  misc_feature 1..460: note = chr19:1004981-1005441
  misc_feature 1..460: note = hypo
  source 1..460: mol_type = genomic DNA
cttcgagctgtacctcgtgggtgacggcaagtacggcgccctgcgggacggccgctggaccggcctggtcggggacctgctggccggccgggcccacatggcggtcaccagcttcagtatcaactccgcccgctcacaggtggtggacttcaccagccccttcttctccaccagcctgggcatcatggtgcgggcacgggacacggcctcacccatcggtgcctttatgtggcccctgcactggtccacgtggctgggcgtctttgcggccctgcacctcaccgcgctcttcctcaccgtgtacgagtggcgtagcccctacggcctcacgccacgtggccgcaaccgcagcaccgtcttctcctactcctcagccctcaacctgtgctacgccatcctcttcagacgcaccgtgtccagcaagacgcccaagtgccccacgggccgcctgctcatgaac

SEQ ID NO: 1631 - DNA, 261 bp, Homo sapiens
  misc_feature 1..261: note = chr19:1808152-1808413
  misc_feature 1..261: note = hypo
  source 1..261: mol_type = genomic DNA
cacagacaaacacatcgatgctgccaggtggctaggggggacttcctggaggaggcaacacgcctcacctgcaggatgatgatgatgaggaagaacaggttggacacgcggtggaactgctcgtacaggttcagcggcaggaacgagtagaagttgtacttggccgtgcggatgacattggtctggaacgagagccgcgggctgcctggcagaggggtgccatccaggccaggggatgggggtgcccgaggccagacctgc

SEQ ID NO: 1632 - DNA, 216 bp, Homo sapiens
  misc_feature 1..216: note = chr19:4555896-4556112
  misc_feature 1..216: note = hypo
  source 1..216: mol_type = genomic DNA
ctggaggaggtgacacggcctggggaaaagccatggccagcggaggtcgggcgagcagaggcctggaggttggacctggggcgcagggagtctgaagactcacgctgtagttggcgcacaccgggttgaaggcgttggaaccgcacacaaagagcgtggactcgtcccgaaggagcagcacctttacgaagtttcgacactcgccctgaggtgggg

SEQ ID NO: 1633 - DNA, 41 bp, Homo sapiens
  misc_feature 1..41: note = chr19:10231201-10231242
  misc_feature 1..41: note = hypo
  source 1..41: mol_type = genomic DNA
cagcctggggctgcagagtgagactccgtctcagaaaaata

SEQ ID NO: 1634 - DNA, 557 bp, Homo sapiens
  misc_feature 1..557: note = chr19:18989724-18990281
  misc_feature 1..557: note = hypo
  source 1..557: mol_type = genomic DNA
ccctccacactcactcggctttgctgggcttcaggctctgggcctcggctgtgtcatactcccgcaggtccttcagctcgtgcacctggcctgtcaacaccttggctgcaaacgccacgatgtactgcgagaggggaggggaggtgccagtgagaagaaagcccccacgccactgccctgctgacagccatgtgctcctgtcccgggccctccacacgggctgtctgccacctaacgtgcccctccccgggactgcctgaggaggggacagggattgggacgaggacgggaccgccactgtggaggagagccggggccgactcaccaggaaccagtagaggttcataagggtgagcagcagcaggagcgcattgaagaagaagtagaaggggatgtcaggcaccgtgcgcagactgcagtgactggtggcatacaggaccttgagcgggaaccagtagaggcggaaccagaacctgcggtgggaggagtcaggaggccgtgggtggagggggacggtgccctacccagtccctgtcctatcccgtcctagacccacc

SEQ ID NO: 1635 - DNA, 120 bp, Homo sapiens
  misc_feature 1..120: note = chr19:41881475-41881595
  misc_feature 1..120: note = hypo
  source 1..120: mol_type = genomic DNA
cccggcccgtgagcccgtttctttatctgcaaaacagggattaaaaacaagccaacaccccttcagcactcctccgcaaaaaaacaccccaaaacaaaataggccaggcgcggtgactca

SEQ ID NO: 1636 - DNA, 43 bp, Homo sapiens
  misc_feature 1..43: note = chr20:3027758-3027801
  misc_feature 1..43: note = hypo
  source 1..43: mol_type = genomic DNA
aagggtggctgggagcggtggttcacgcctgtaatcccagtac

SEQ ID NO: 1637 - DNA, 102 bp, Homo sapiens
  misc_feature 1..102: note = chr20:42218592-42218694
  misc_feature 1..102: note = hypo
  source 1..102: mol_type = genomic DNA
cgcccggcccgtctccacttttaaaatttccagtgacagaaattgtggaaagcaacacgagttgtatgtgttttaatatcctagattcgaagacaaacataa

SEQ ID NO: 1638 - DNA, 343 bp, Homo sapiens
  misc_feature 1..343: note = chr20:49261761-49262104
  misc_feature 1..343: note = hypo
  source 1..343: mol_type = genomic DNA
gagcccaggcagggacggccaaaagctcgctacccctgcccaggaaggcaggagcaccgttgtgtcccgttcctatccctcaaaaataaatcacagccagctcatgtcataggacagagcctgttcgcaatccatcctgtgtctgcggattctcccaggtctgtaaggcagcagggagatgcggcctctcccactccacccaacacgtagccagggcgaggtggggccgggggagaggctgacattcaaaggcatctgagtggtaagaggtgagcgagtgaggtgaatggggactacgttagaaggaccctacgttagaagggtgaggcgctagggccatagc

SEQ ID NO: 1639 - DNA, 212 bp, Homo sapiens
  misc_feature 1..212: note = chr20:49346547-49346759
  misc_feature 1..212: note = hypo
  source 1..212: mol_type = genomic DNA
acccatctgagtacccgctgggagtcgggttctgtgccactcaatgccagcaaagcacaagccgtccctgcgccttcgggagctttcattctaggctggtggcagattactcacaaaactcagatgcacacaaaaatgggaaacctgtaacttgtaacaagtgctgggcaacaggggtacaagtgttaggaggcctccgaggtgggcaggga

SEQ ID NO: 1640 - DNA, 26 bp, Homo sapiens
  misc_feature 1..26: note = chr20:49350870-49350896
  misc_feature 1..26: note = hypo
  source 1..26: mol_type = genomic DNA
aactaggtagtgtgccggtccttttt

SEQ ID NO: 1641 - DNA, 309 bp, Homo sapiens
  misc_feature 1..309: note = chr20:62046201-62046510
  misc_feature 1..309: note = hypo
  source 1..309: mol_type = genomic DNA
caccacatccatccccggagaggatggaccaggagaggatgcggccacacccaccttctgagttctgccgtgacgcggcacccttgatgcggaaagcctggcgtgcccggctgcggtccccgaagctccagctcttgggcaccttgctggggctgtcctcgaggctctggtcggcgctgggtgaccgcctcacagtctgggcctgcggggaccccttccccttggcagccacgcctcgggggctggagaagacacgatctttcaaactgaccttctggctgctcccacgggaaccgacagacagacaga

SEQ ID NO: 1642 - DNA, 86 bp, Homo sapiens
  misc_feature 1..86: note = chr20:62115180-62115266
  misc_feature 1..86: note = hypo
  source 1..86: mol_type = genomic DNA
tgggcgacagagcgagactcaaaaaaaaaaaaaaaaattattcaccaacccaagtagggtggagctccttccgccacccatgccct

SEQ ID NO: 1643 - DNA, 16 bp, Homo sapiens
  misc_feature 1..16: note = chr22:18110631-18110647
  misc_feature 1..16: note = hypo
  source 1..16: mol_type = genomic DNA
acgaccttgtcaaaac

SEQ ID NO: 1644 - DNA, 410 bp, Homo sapiens
  misc_feature 1..410: note = chr22:50899279-50899689
  misc_feature 1..410: note = hypo
  source 1..410: mol_type = genomic DNA
tcacacgaaggcaagcgcttgtgtaaactcgaaatctcagtggctgtgagctgaggcctgggtttgcaaggcacacccaagacacggacttgagggccggcgccccaaggaaaggacaaggacccaaagaccgcacatcaaacagtggacatcaactcaagagccacagtgagggccccagacatgcaagcgtaacaacagggccactgctggagactggcctaaaaatggttcatacaagaaagaccggtttgcaggagaaagaccagggcgggggatgagagccccacccgcgcaccgcgccccacctggaatgtgcaggagcgcagctggagcccgtcctgcaggagctggtccacaggggtctggacgctgatgcgcttctccttggtcagcgcagccaccgggaa

SEQ ID NO: 1645 - DNA, 107 bp, Homo sapiens
  misc_feature 1..107: note = chr1:1475537-1475644
  misc_feature 1..107: note = hyper
  source 1..107: mol_type = genomic DNA
ggccggggaggggagcgcaggccggggaggggagcgcaggccgcacgggcggtaaacaaggcgcgggaggtgggccaggcggcgcgcgcgggcggggagcagggggc

SEQ ID NO: 1646 - DNA, 611 bp, Homo sapiens
  misc_feature 1..611: note = chr1:2374994-2375605
  misc_feature 1..611: note = hyper
  source 1..611: mol_type = genomic DNA
aaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgag

SEQ ID NO: 1647 - DNA, 98 bp, Homo sapiens; identical to SEQ ID NO: 1
  misc_feature 1..98: note = chr1:3567247-3567345
  misc_feature 1..98: note = hyper
  source 1..98: mol_type = genomic DNA

SEQ ID NO: 1648 - DNA, 114 bp, Homo sapiens; identical to SEQ ID NO: 2
  misc_feature 1..114: note = chr1:3567737-3567851
  misc_feature 1..114: note = hyper
  source 1..114: mol_type = genomic DNA

SEQ ID NO: 1649 - DNA, 395 bp, Homo sapiens; identical to SEQ ID NO: 3
  misc_feature 1..395: note = chr1:3567882-3568277
  misc_feature 1..395: note = hyper
  source 1..395: mol_type = genomic DNA

SEQ ID NO: 1650 - DNA, 113 bp, Homo sapiens; identical to SEQ ID NO: 4
  misc_feature 1..113: note = chr1:4715427-4715540
  misc_feature 1..113: note = hyper
  source 1..113: mol_type = genomic DNA

SEQ ID NO: 1651 - DNA, 528 bp, Homo sapiens; identical to SEQ ID NO: 5
  misc_feature 1..528: note = chr1:4715574-4716102
  misc_feature 1..528: note = hyper
  source 1..528: mol_type = genomic DNA

SEQ ID NO: 1652 - DNA, 517 bp, Homo sapiens; identical to SEQ ID NO: 6
  misc_feature 1..517: note = chr1:6480368-6480885
  misc_feature 1..517: note = hyper
  source 1..517: mol_type = genomic DNA

SEQ ID NO: 1653 - DNA, 15 bp, Homo sapiens
  misc_feature 1..15: note = chr1:6500973-6500988
  misc_feature 1..15: note = hyper
  source 1..15: mol_type = genomic DNA
ctcactgcgtgcccc

SEQ ID NO: 1654 - DNA, 125 bp, Homo sapiens; identical to SEQ ID NO: 8
  misc_feature 1..125: note = chr1:6501054-6501179
  misc_feature 1..125: note = hyper
  source 1..125: mol_type = genomic DNA

SEQ ID NO: 1655 - DNA, 30 bp, Homo sapiens; identical to SEQ ID NO: 9
  misc_feature 1..30: note = chr1:8277113-8277143
  misc_feature 1..30: note = hyper
  source 1..30: mol_type = genomic DNA

SEQ ID NO: 1656 - DNA, 50 bp, Homo sapiens; identical to SEQ ID NO: 10
  misc_feature 1..50: note = chr1:11540129-11540179
  misc_feature 1..50: note = hyper
  source 1..50: mol_type = genomic DNA

SEQ ID NO: 1657 - DNA, 133 bp, Homo sapiens; identical to SEQ ID NO: 11
  misc_feature 1..133: note = chr1:12123421-12123554
  misc_feature 1..133: note = hyper
  source 1..133: mol_type = genomic DNA

SEQ ID NO: 1658 - DNA, 15 bp, Homo sapiens
  misc_feature 1..15: note = chr1:12123787-12123802
  misc_feature 1..15: note = hyper
  source 1..15: mol_type = genomic DNA
cgcaagggaggacac

SEQ ID NO: 1659 - DNA, 368 bp, Homo sapiens
  misc_feature 1..368: note = chr1:13910330-13910698
  misc_feature 1..368: note = hyper
  source 1..368: mol_type = genomic DNA
gcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggtaagacccagcgcaagtggcttcctgccgtcgctgatggggacgagcgagcagagacttgctggaatgcccgggcctggtattcgaggttgtccaggggagc

SEQ ID NO: 1660 - DNA, 13 bp, Homo sapiens
  misc_feature 1..13: note = chr1:13910699-13910712
  misc_feature 1..13: note = hyper
  source 1..13: mol_type = genomic DNA
cgggggagctgag

SEQ ID NO: 1661 - DNA, 127 bp, Homo sapiens
  misc_feature 1..127: note = chr1:14925923-14926050
  misc_feature 1..127: note = hyper
  source 1..127: mol_type = genomic DNA
gtgcacggggtcacacggtcacaccggccccggccagcctgagcgaggcgcagccggcgggtcccttccggcatcagaaagtgccctttccgtggcaccagccccctagctccgtgcaaacttttca

SEQ ID NO: 1662 - DNA, 229 bp, Homo sapiens; identical to SEQ ID NO: 13
  misc_feature 1..229: note = chr1:18437202-18437431
  misc_feature 1..229: note = hyper
  source 1..229: mol_type = genomic DNA

SEQ ID NO: 1663 - DNA, 94 bp, Homo sapiens; identical to SEQ ID NO: 14
  misc_feature 1..94: note = chr1:18437432-18437526
  misc_feature 1..94: note = hyper
  source 1..94: mol_type = genomic DNA

SEQ ID NO: 1664 - DNA, 476 bp, Homo sapiens; identical to SEQ ID NO: 15
  misc_feature 1..476: note = chr1:18956811-18957287
  misc_feature 1..476: note = hyper
  source 1..476: mol_type = genomic DNA

SEQ ID NO: 1665 - DNA, 93 bp, Homo sapiens; identical to SEQ ID NO: 16
  misc_feature 1..93: note = chr1:18960897-18960990
  misc_feature 1..93: note = hyper
  source 1..93: mol_type = genomic DNA

SEQ ID NO: 1666 - DNA, 331 bp, Homo sapiens; identical to SEQ ID NO: 17
  misc_feature 1..331: note = chr1:22140683-22141014
  misc_feature 1..331: note = hyper
  source 1..331: mol_type = genomic DNA

SEQ ID NO: 1667 - DNA, 287 bp, Homo sapiens; identical to SEQ ID NO: 18
  misc_feature 1..287: note = chr1:22141015-22141302
  misc_feature 1..287: note = hyper
  source 1..287: mol_type = genomic DNA

SEQ ID NO: 1668 - DNA, 425 bp, Homo sapiens
  misc_feature 1..425: note = chr1:29586066-29586491
  misc_feature 1..425: note = hyper
  source 1..425: mol_type = genomic DNA
cctcttgcaagtgagcgggagcggtgatcttggctgggggcggggtgggagggggttggtggctgcttctggccctgactccccccagattgctgagtccctgcttcatactccagcactgcgcacagcgtcccggccctcccctagctctgctctgcgctttcttgggtcccccattcccccaggttagagcgcggctccaggaacctatgtccgcgcggtgtagtagggacggctaaatggggcccgggtcagagcgagatcgggacccctcgctccgaggcgcccctgaccccctcactctcttccctgcagcggcagagcggggcgctggtgccggcggcgggcgtgcggcacatcagccaccggcgcttcctggccactttcccgctggctgccgtgagccgcgccgagcaggacctgta

SEQ ID NO: 1669 - DNA, 124 bp, Homo sapiens
  misc_feature 1..124: note = chr1:30815454-30815578
  misc_feature 1..124: note = hyper
  source 1..124: mol_type = genomic DNA
cggcaggtccttgcagaggaggggctcttcccaggagggcgctccagccgaggcccctctgccttcacctgcgccatgaccacttccctcggccctctcccctcctccacgcctcctggggccg

SEQ ID NO: 1670 - DNA, 15 bp, Homo sapiens
  misc_feature 1..15: note = chr1:32237531-32237546
  misc_feature 1..15: note = hyper
  source 1..15: mol_type = genomic DNA
cccaccgccggaagc

SEQ ID NO: 1671 - DNA, 1008 bp, Homo sapiens; identical to SEQ ID NO: 20
  misc_feature 1..1008: note = chr1:32237638-32238646
  misc_feature 1..1008: note = hyper
  source 1..1008: mol_type = genomic DNA

SEQ ID NO: 1672 - DNA, 741 bp, Homo sapiens
  misc_feature 1..741: note = chr1:34630245-34630986
  misc_feature 1..741: note = hyper
  source 1..741: mol_type = genomic DNA
cccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgc

SEQ ID NO: 1673 - DNA, 940 bp, Homo sapiens; identical to SEQ ID NO: 21
  misc_feature 1..940: note = chr1:36042549-36043489
  misc_feature 1..940: note = hyper
  source 1..940: mol_type = genomic DNA

SEQ ID NO: 1674 - DNA, 92 bp, Homo sapiens
  misc_feature 1..92: note = chr1:37498753-37498845
  misc_feature 1..92: note = hyper
  source 1..92: mol_type = genomic DNA
aacaaagttaaagaccggagtaagagtctccggcgagaagagacgcggagaagccggagccccggaaagccgcgcgcagccccgccagccgc

SEQ ID NO: 1675 - DNA, 200 bp, Homo sapiens
  misc_feature 1..200: note = chr1:37498888-37499088
  misc_feature 1..200: note = hyper
  source 1..200: mol_type = genomic DNA
cgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagag

SEQ ID NO: 1676 - DNA, 223 bp, Homo sapiens
  misc_feature 1..223: note = chr1:37499460-37499683
  misc_feature 1..223: note = hyper
  source 1..223: mol_type = genomic DNA
gctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactc

SEQ ID NO: 1677 - DNA, 142 bp, Homo sapiens
  misc_feature 1..142: note = chr1:37500013-37500155
  misc_feature 1..142: note = hyper
  source 1..142: mol_type = genomic DNA
gggctcccacctgccccggctgccgggctctggcgggcgggctgcacgcgtctccggccgctcctcctccagccgccgccgatgctatcgcccgggctcgcacaaagccccggagtggagttgcacgcgcgcacactctccc

SEQ ID NO: 1678 - DNA, 162 bp, Homo sapiens; identical to SEQ ID NO: 22
  misc_feature 1..162: note = chr1:38510087-38510249
  misc_feature 1..162: note = hyper
  source 1..162: mol_type = genomic DNA

SEQ ID NO: 1679 - DNA, 425 bp, Homo sapiens; identical to SEQ ID NO: 23
  misc_feature 1..425: note = chr1:38510309-38510734
  misc_feature 1..425: note = hyper
  source 1..425: mol_type = genomic DNA

SEQ ID NO: 1680 - DNA, 160 bp, Homo sapiens; identical to SEQ ID NO: 24
  misc_feature 1..160: note = chr1:38510773-38510933
  misc_feature 1..160: note = hyper
  source 1..160: mol_type = genomic DNA

SEQ ID NO: 1681 - DNA, 866 bp, Homo sapiens; identical to SEQ ID NO: 25
  misc_feature 1..866: note = chr1:38510934-38511800
  misc_feature 1..866: note = hyper
  source 1..866: mol_type = genomic DNA

SEQ ID NO: 1682 - DNA, 269 bp, Homo sapiens; identical to SEQ ID NO: 26
  misc_feature 1..269: note = chr1:38511821-38512090
  misc_feature 1..269: note = hyper
  source 1..269: mol_type = genomic DNA

SEQ ID NO: 1683 - DNA, 478 bp, Homo sapiens
  misc_feature 1..478: note = chr1:39269643-39270121
  misc_feature 1..478: note = hyper
  source 1..478: mol_type = genomic DNA
ccgactagcattgatcgctttttgatcttaaaagaaatactttttaattcgaaagttaatagaaatgcggagtcaggggcaggcctcggcggcgtccgggctgggggcgaggcgcccacgccccaccctcccgctgtggccgctggcgccggcccgagcgcgcgcagcccggtgcgcttcggcgcccgctgagcccgcgaacctctccgccgcgccatcagcgcagccatcagccgcgccgcgtgctgtcccgcgccccgctgctcgcggccgcgggccaccggcggtaataatgaggcacagcgccatgaccgcggccctcggctgcgccgccggcagcagcgcgggcgccgcattagcatctccgaagccttcctgtgtgttcttttgtgctcattttccagcccgaatgctcggcacatcccggaccgcggacggagccgcaggagccaccgcggccgaacgtagctgccctggt

SEQ ID NO: 1684 - DNA, 120 bp, Homo sapiens
  misc_feature 1..120: note = chr1:40237083-40237203
  misc_feature 1..120: note = hyper
  source 1..120: mol_type = genomic DNA
caacagggagggggccggctccgccctgggctgggggcccccgagtcagtcctccgtgtccagcgcacaggcccgggcgcaggacagagctgaggtcaggctccgcgagaagggcacagg

SEQ ID NO: 1685 - DNA, 428 bp, Homo sapiens
  misc_feature 1..428: note = chr1:41284168-41284596
  misc_feature 1..428: note = hyper
  source 1..428: mol_type = genomic DNA
ccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaagccgcgcgcggagacccgagggcgtgtctggggcacgaccagagcgggcagggcggagagggcgaggtcagaggggctgtctccgtgctgggaaggggtgtggcctgcgggggttggagccctagcaggaggcgaggtctaagcgggtggggcgaagtggattctgaattaggtaggggcgggcctaggagtccggaccggatcagggggcggggccggagaggcggggct

SEQ ID NO: 1686 - DNA, 141 bp, Homo sapiens; identical to SEQ ID NO: 27
  misc_feature 1..141: note = chr1:44872582-44872723
  misc_feature 1..141: note = hyper
  source 1..141: mol_type = genomic DNA

SEQ ID NO: 1687 - DNA, 141 bp, Homo sapiens; identical to SEQ ID NO: 28
  misc_feature 1..141: note = chr1:44872923-44873064
  misc_feature 1..141: note = hyper
  source 1..141: mol_type = genomic DNA

SEQ ID NO: 1688 - DNA, 108 bp, Homo sapiens; identical to SEQ ID NO: 29
  misc_feature 1..108: note = chr1:44873065-44873173
  misc_feature 1..108: note = hyper
  source 1..108: mol_type = genomic DNA

SEQ ID NO: 1689 - DNA, 281 bp, Homo sapiens; identical to SEQ ID NO: 30
  misc_feature 1..281: note = chr1:44873509-44873790
  misc_feature 1..281: note = hyper
  source 1..281: mol_type = genomic DNA

SEQ ID NO: 1690 - DNA, 94 bp, Homo sapiens; identical to SEQ ID NO: 31
  misc_feature 1..94: note = chr1:44883121-44883215
  misc_feature 1..94: note = hyper
  source 1..94: mol_type = genomic DNA

SEQ ID NO: 1691 - DNA, 95 bp, Homo sapiens; identical to SEQ ID NO: 32
  misc_feature 1..95: note = chr1:44883751-44883846
  misc_feature 1..95: note = hyper
  source 1..95: mol_type = genomic DNA

SEQ ID NO: 1692 - DNA, 40 bp, Homo sapiens
  misc_feature 1..40: note = chr1:46913837-46913877
  misc_feature 1..40: note = hyper
  source 1..40: mol_type = genomic DNA
accgcccggcctttgcgtccggcccagctcaagccccttc

SEQ ID NO: 1693 - DNA, 360 bp, Homo sapiens
  misc_feature 1..360: note = chr1:46913886-46914246
  misc_feature 1..360: note = hyper
  source 1..360: mol_type = genomic DNA
cggcctcgggagcgctgggcaggcagcccgggtgggagcgcccacgtctcccgcggacacggacggacggatggacgggcggccgcgcaggcccgcgccccgctcccgccccgcctgccgcgcctcccggggcgcccgcattaaagcgcatatgcaagccatgaattatcaactgaaaggagtcaattaccggctctaaaaacgagtgtctgcgctcgcagcgccccgggccatccgcctatttacggagcgatctaccccgcccggctggggagggggcctcgggagggagagagacggagaaacggagcccgagaccgggagagagccggagaggcagggactggagagtctgggaca

SEQ ID NO: 1694 - DNA, 137 bp, Homo sapiens
  misc_feature 1..137: note = chr1:46914285-46914422
  misc_feature 1..137: note = hyper
  source 1..137: mol_type = genomic DNA
cgcggagggccggacgggagccaaggcggctcagttcctcttctcccccgagcaggcgaggagaggtggggtctcaggacctccaaggccctgttccccttccattggcatttgtgtaaggacgcaggccctccgca

SEQ ID NO: 1695 - DNA, 122 bp, Homo sapiens
  misc_feature 1..122: note = chr1:46951196-46951318
  misc_feature 1..122: note = hyper
  source 1..122: mol_type = genomic DNA
gtagccgtcggagggcggggacagagcggtagctgccttgcgctgggattgggggtgggggtgggagtggggagggctctttaagcggcggccgcgctaataacctgtccaggagatggctc

SEQ ID NO: 1696 - DNA, 95 bp, Homo sapiens
  misc_feature 1..95: note = chr1:46951644-46951739
  misc_feature 1..95: note = hyper
  source 1..95: mol_type = genomic DNA
cgcccggaaggggcggggaggggccccggccctcaagccgcacagccaggtgttcccgctcttcgaggacatcccctgcccgcctggaggttgag

SEQ ID NO: 1697 - DNA, 229 bp, Homo sapiens; identical to SEQ ID NO: 33
  misc_feature 1..229: note = chr1:46956387-46956616
  misc_feature 1..229: note = hyper
  source 1..229: mol_type = genomic DNA

SEQ ID NO: 1698 - DNA, 155 bp, Homo sapiens; identical to SEQ ID NO: 34
  misc_feature 1..155: note = chr1:46956684-46956839
  misc_feature 1..155: note = hyper
  source 1..155: mol_type = genomic DNA

SEQ ID NO: 1699 - DNA, 314 bp, Homo sapiens; identical to SEQ ID NO: 35
  misc_feature 1..314: note = chr1:46956840-46957154
  misc_feature 1..314: note = hyper
  source 1..314: mol_type = genomic DNA

SEQ ID NO: 1700 - DNA, 326 bp, Homo sapiens; identical to SEQ ID NO: 36
  misc_feature 1..326: note = chr1:47009560-47009886
  misc_feature 1..326: note = hyper
  source 1..326: mol_type = genomic DNA

SEQ ID NO: 1701 - DNA, 126 bp, Homo sapiens; identical to SEQ ID NO: 37
  misc_feature 1..126: note = chr1:47009910-47010036
  misc_feature 1..126: note = hyper
  source 1..126: mol_type = genomic DNA

SEQ ID NO: 1702 - DNA, 28 bp, Homo sapiens
  misc_feature 1..28: note = chr1:47010104-47010132
  misc_feature 1..28: note = hyper
  source 1..28: mol_type = genomic DNA
cgtccgcactttccgagagccaggcacg

SEQ ID NO: 1703 - DNA, 226 bp, Homo sapiens; identical to SEQ ID NO: 39
  misc_feature 1..226: note = chr1:47696295-47696521
  misc_feature 1..226: note = hyper
  source 1..226: mol_type = genomic DNA

SEQ ID NO: 1704 - DNA, 345 bp, Homo sapiens; identical to SEQ ID NO: 40
  misc_feature 1..345: note = chr1:47696620-47696965
  misc_feature 1..345: note = hyper
  source 1..345: mol_type = genomic DNA

SEQ ID NO: 1705 - DNA, 44 bp, Homo sapiens; identical to SEQ ID NO: 41
  misc_feature 1..44: note = chr1:47696986-47697030
  misc_feature 1..44: note = hyper
  source 1..44: mol_type = genomic DNA

SEQ ID NO: 1706 - DNA, 606 bp, Homo sapiens; identical to SEQ ID NO: 42
  misc_feature 1..606: note = chr1:47697341-47697947
  misc_feature 1..606: note = hyper
  source 1..606: mol_type = genomic DNA

SEQ ID NO: 1707 - DNA, 89 bp, Homo sapiens; identical to SEQ ID NO: 43
  misc_feature 1..89: note = chr1:47698006-47698095
  misc_feature 1..89: note = hyper
  source 1..89: mol_type = genomic DNA

SEQ ID NO: 1708 - DNA, 370 bp, Homo sapiens
  misc_feature 1..370: note = chr1:47909575-47909945
  misc_feature 1..370: note = hyper
  source 1..370: mol_type = genomic DNA
ttgctcttgccacagcgggcgcgtcttcgtggttacaaagcgctttttccctgatgacttttttccccttttcaaaaacacttctttctccccccttcaactagcaaccctccccaggcccacccctcctccctctccgctccggtttatttaaacttcgcctcctccagcgccgccgcagcgcgcacttaatgaagttgaaggctcggtgagcccgggtgaagagggtttggaatctgttgaaaggggcgttttgtgacactgattggggcgggggcgggggcagtcgcggaccagacaatgaccgaccaggcgggttttcctgcgcacagggtcaggcgaataaaggcgccgacgctgtttaaacgaa

SEQ ID NO: 1709 - DNA, 222 bp, Homo sapiens
  misc_feature 1..222: note = chr1:48059057-48059279
  misc_feature 1..222: note = hyper
  source 1..222: mol_type = genomic DNA
gggctagggggaggccgggcggaaacccaaaacctccgcagctgtttccagtttgccgccctggctggaccgcggtggctgcgtgcagagcgagcaaggctgcgcgggcctggagcgcccacggggcgcgggacctctctctgtctccccccgccccgcggggctctctctcgtcctctctgtcttggtggggctcagtctgtctctcgttttctctccctg

SEQ ID NO: 1710 - DNA, 665 bp, Homo sapiens
  misc_feature 1..665: note = chr1:50798652-50799317
  misc_feature 1..665: note = hyper
  source 1..665: mol_type = genomic DNA
aaaggccagctggggcgccagacgactcgccctgccccgtcgacgccccagacggtgttgccgacctccgccccgcagcgctggtgtgggcgcggccggacctcactcagcctgcactgccccgcgccgctcgccgcgtccacactgtccttgggaggacgcgcggggaagccgcgcacgatgcggcagcgccccctgccgggctccgggcgctccgctcccagccggctcggcgagtgctccgggaaaggggtccggaccccacacgcactgggttccaggacaggctctcgctcgggctgggccgactctggcccgcctaggccccgggcacgctgcagtgaaggcggtaccctcaccacagtcacagaacgtgtcggctgcccgcgcgtcctcccaaggacagtggacgggagctggggctggagagggtaacgacctgcccaaggtcacacagcaccgcagtggcacagccaggactggcacccacacctcccgcggaaccttgcaggggcccaaaccacctgggttctagagctccttgaactggcctcttgggctttagggaagagctggggacgagggaatggggtggggccacaccacattagcacggacccttgggtgacttgggcggaagacggggcgtcagggccgcctgcgcg

SEQ ID NO: 1711 - DNA, 127 bp, Homo sapiens
  misc_feature 1..127: note = chr1:50799393-50799520
  misc_feature 1..127: note = hyper
  source 1..127: mol_type = genomic DNA
cggcggcagccgcggctgccccctactggcggaaggaagagtcgccgctccggggcccttggcggccgccgctcttcgcgcctccttggcctggctgccacccttccaccctcgggggagaccccgc

SEQ ID NO: 1712 - DNA, 302 bp, Homo sapiens
  misc_feature 1..302: note = chr1:50880931-50881233
  misc_feature 1..302: note = hyper
  source 1..302: mol_type = genomic DNA
cggcccgggttcgcatcctcccactgctcagaccgagtcggctccagcttgctttgggaagcattcaggaataaacgtggacagtagcggtcaggaaggagattcccgtttccccttctcccaggaggaaaagaggtaacgctgccgccactgccctctctttccagggtgggaacgccgcccgagaccggggtaccccacactcctccctagcgctgatcccagcggagctcaggccgcagtcccctcctgccggctgcggaagctcccagaagcggagactcaatcgcccccctgcccct

SEQ ID NO: 1713 - DNA, 88 bp, Homo sapiens
  misc_feature 1..88: note = chr1:50881869-50881957
  misc_feature 1..88: note = hyper
  source 1..88: mol_type = genomic DNA
cttgggaatgagtaacgcgggtccacaggccgccccctcgggtccggccagagcatcggcaggaaccgaggagcctcgggggacccag

SEQ ID NO: 1714 - DNA, 119 bp, Homo sapiens
  misc_feature 1..119: note = chr1:50882143-50882262
  misc_feature 1..119: note = hyper
  source 1..119: mol_type = genomic DNA
cgctttctcccgcctgcctcttttctttctaactcttccctctcctgtctcctctcgccctcttttttctccttttttatccccttttcgtccatcgctcttgccggcatctttcttct

SEQ ID NO: 1715 - DNA, 600 bp, Homo sapiens; identical to SEQ ID NO: 44
  misc_feature 1..600: note = chr1:50882808-50883408
  misc_feature 1..600: note = hyper
  source 1..600: mol_type = genomic DNA

SEQ ID NO: 1716 - DNA, 15 bp, Homo sapiens
  misc_feature 1..15: note = chr1:50883962-50883977
  misc_feature 1..15: note = hyper
  source 1..15: mol_type = genomic DNA
ccatccactgagagc

SEQ ID NO: 1717 - DNA, 333 bp, Homo sapiens; identical to SEQ ID NO: 46
  misc_feature 1..333: note = chr1:50884020-50884353
  misc_feature 1..333: note = hyper
  source 1..333: mol_type = genomic DNA

SEQ ID NO: 1718 - DNA, 198 bp, Homo sapiens; identical to SEQ ID NO: 47
  misc_feature 1..198: note = chr1:50884690-50884888
  misc_feature 1..198: note = hyper
  source 1..198: mol_type = genomic DNA

SEQ ID NO: 1719 - DNA, 634 bp, Homo sapiens; identical to SEQ ID NO: 48
  misc_feature 1..634: note = chr1:50886451-50887085
  misc_feature 1..634: note = hyper
  source 1..634: mol_type = genomic DNA

SEQ ID NO: 1720 - DNA, 60 bp, Homo sapiens; identical to SEQ ID NO: 49
  misc_feature 1..60: note = chr1:50887175-50887235
  misc_feature 1..60: note = hyper
  source 1..60: mol_type = genomic DNA

SEQ ID NO: 1721 - DNA, 727 bp, Homo sapiens
  misc_feature 1..727: note = chr1:50889123-50889850
  misc_feature 1..727: note = hyper
  source 1..727: mol_type = genomic DNA
cgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaa

SEQ ID NO: 1722 - DNA, 307 bp, Homo sapiens
  misc_feature 1..307: note = chr1:50890061-50890368
  misc_feature 1..307: note = hyper
  source 1..307: mol_type = genomic DNA
tttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggt

SEQ ID NO: 1723 - DNA, 152 bp, Homo sapiens
  misc_feature 1..152: note = chr1:50890795-50890947
  misc_feature 1..152: note = hyper
  source 1..152: mol_type = genomic DNA
cgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatg

SEQ ID NO: 1724 - DNA, 322 bp, Homo sapiens; identical to SEQ ID NO: 50
  misc_feature 1..322: note = chr1:50891148-50891470
  misc_feature 1..322: note = hyper
  source 1..322: mol_type = genomic DNA

SEQ ID NO: 1725 - DNA, 131 bp, Homo sapiens
  misc_feature 1..131: note = chr1:50892153-50892284
  misc_feature 1..131: note = hyper
  source 1..131: mol_type = genomic DNA
cacagatttccacctcggtgatagcacacgccgacaggagcacattcttacgcaggtatgccctggtttatgcgcggagctccagtcttacttctacagttgggccccgggcagaaaaagccaaaaccctc

SEQ ID NO: 1726 - DNA, 525 bp, Homo sapiens
  misc_feature 1..525: note = chr1:50892336-50892861
  misc_feature 1..525: note = hyper
  source 1..525: mol_type = genomic DNA
cgtactcttagctcagaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccaggggcgccgatgggggacccgggaggcattgacttttgcgctgtttgcccgcggcctcggagcaagcagacgccatctgtttgccggctgcgacgcgtcccgtttaattaccctcccggcagcctaatagagatgatattaaactaaatctttctgacattaaaagtaattatccccaaaccggtggctccgggacggaatggcccctcccgcacccaccccttccctggccgcgccggattccgttagtttggctga

SEQ ID NO: 1727 - DNA, 49 bp, Homo sapiens
  misc_feature 1..49: note = chr1:53308559-53308608
  misc_feature 1..49: note = hyper
  source 1..49: mol_type = genomic DNA
ttcatttcttgcacccgggccacacgccccggaacatcgtccctcctga

SEQ ID NO: 1728 - DNA, 368 bp, Homo sapiens
  misc_feature 1..368: note = chr1:53308907-53309275
  misc_feature 1..368: note = hyper
  source 1..368: mol_type = genomic DNA
cggcgagagcccagtcccagagaccggggcgagcctcctcaggattcctcgccccagtgcgggctgctgtgagcttagacgtaggtgcagggcatggcactcggcttggcccgtagtggacggtgtttttgcagtcatgaacccaaacgccgcaaaccttgaccgtttccccacccgtgttgtggacgcagcgccccgcggaggcggtgaccctttggccgttaccacctgaggcctttgggcccggggccgggcgagtagcttagtccggctgggggaactggaacccgaagtctgagattctttcagttccgcgcgtccgcccccgtccccgtcccgtccccagcctttgccgaatgcctgttact

SEQ ID NO: 1729 - DNA, 504 bp, Homo sapiens; identical to SEQ ID NO: 51
  misc_feature 1..504: note = chr1:54203828-54204332
  misc_feature 1..504: note = hyper
  source 1..504: mol_type = genomic DNA

SEQ ID NO: 1730 - DNA, 29 bp, Homo sapiens
  misc_feature 1..29: note = chr1:58715503-58715532
  misc_feature 1..29: note = hyper
  source 1..29: mol_type = genomic DNA
cggccacaacttgggcggctctgtgcggc

SEQ ID NO: 1731 - DNA, 322 bp, Homo sapiens; identical to SEQ ID NO: 53
  misc_feature 1..322: note = chr1:58715533-58715855
  misc_feature 1..322: note = hyper
  source 1..322: mol_type = genomic DNA

SEQ ID NO: 1732 - DNA, 15 bp, Homo sapiens
  misc_feature 1..15: note = chr1:58715978-58715993
  misc_feature 1..15: note = hyper
  source 1..15: mol_type = genomic DNA
cgagcgggctccgct

SEQ ID NO: 1733 - DNA, 342 bp, Homo sapiens; identical to SEQ ID NO: 55
  misc_feature 1..342: note = chr1:63539509-63539851
  misc_feature 1..342: note = hyper
  source 1..342: mol_type = genomic DNA

SEQ ID NO: 1734 - DNA, 306 bp, Homo sapiens; identical to SEQ ID NO: 56
  misc_feature 1..306: note = chr1:63784987-63785293
  misc_feature 1..306: note = hyper
  source 1..306: mol_type = genomic DNA

SEQ ID NO: 1735 - DNA, 149 bp, Homo sapiens; identical to SEQ ID NO: 57
  misc_feature 1..149: note = chr1:63785618-63785767
  misc_feature 1..149: note = hyper
  source 1..149: mol_type = genomic DNA

SEQ ID NO: 1736 - DNA, 251 bp, Homo sapiens; identical to SEQ ID NO: 58
  misc_feature 1..251: note = chr1:63786078-63786329
  misc_feature 1..251: note = hyper
  source 1..251: mol_type = genomic DNA

SEQ ID NO: 1737 - DNA, 102 bp, Homo sapiens
  misc_feature 1..102: note = chr1:63786656-63786758
  misc_feature 1..102: note = hyper
  source 1..102: mol_type = genomic DNA
gcaccactgtccatccggaattaaatccacatcccagcatcttctgcaaatatttcactaattatttcctctcggaactcctcccctcgtgctccttcctct

SEQ ID NO: 1738 - DNA, 32 bp, Homo sapiens
  misc_feature 1..32: note = chr1:63787031-63787063
  misc_feature 1..32: note = hyper
  source 1..32: mol_type = genomic DNA
acttgccttgcactccgcgtgcattggccaca

SEQ ID NO: 1739 - DNA, 280 bp, Homo sapiens; identical to SEQ ID NO: 59
  misc_feature 1..280: note = chr1:63789217-63789497
  misc_feature 1..280: note = hyper
  source 1..280: mol_type = genomic DNA

SEQ ID NO: 1740 - DNA, 31 bp, Homo sapiens; identical to SEQ ID NO: 60
  misc_feature 1..31: note = chr1:63789728-63789759
  misc_feature 1..31: note = hyper
  source 1..31: mol_type = genomic DNA

SEQ ID NO: 1741 - DNA, 26 bp, Homo sapiens
  misc_feature 1..26: note = chr1:63790252-63790278
  misc_feature 1..26: note = hyper
  source 1..26: mol_type = genomic DNA
ggtcccggtcccgctgcccaatcctg

SEQ ID NO: 1742 - DNA, 584 bp, Homo sapiens; identical to SEQ ID NO: 61
  misc_feature 1..584: note = chr1:63795350-63795934
  misc_feature 1..584: note = hyper
  source 1..584: mol_type = genomic DNA

SEQ ID NO: 1743 - DNA, 218 bp, Homo sapiens; identical to SEQ ID NO: 62
  misc_feature 1..218: note = chr1:63795935-63796153
  misc_feature 1..218: note = hyper
  source 1..218: mol_type = genomic DNA

SEQ ID NO: 1744 - DNA, 462 bp, Homo sapiens; identical to SEQ ID NO: 63
  misc_feature 1..462: note = chr1:66998790-66999252
  misc_feature 1..462: note = hyper
  source 1..462: mol_type = genomic DNA

SEQ ID NO: 1745 - DNA, 378 bp, Homo sapiens; identical to SEQ ID NO: 64
  misc_feature 1..378: note = chr1:67217965-67218343
  misc_feature 1..378: note = hyper
  source 1..378: mol_type = genomic DNA

SEQ ID NO: 1746 - DNA, 621 bp, Homo sapiens
  misc_feature 1..621: note = chr1:67773159-67773780
  misc_feature 1..621: note = hyper
  source 1..621: mol_type = genomic DNA
atcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtgagtgaccagtgactcggggtcggggacagagagagccccaggatcccggaccagcggggtgtctgcgtgcccgggattccgtgtctcgcgtctcccgagggggcttcggcgacggcttctctcttta

SEQ ID NO: 1747 - DNA, 502 bp, Homo sapiens
  misc_feature 1..502: note = chr1:70033989-70034491
  misc_feature 1..502: note = hyper
  source 1..502: mol_type = genomic DNA
cggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggc

SEQ ID NO: 1748 - DNA, 13 bp, Homo sapiens
  misc_feature 1..13: note = chr1:70034492-70034505
  misc_feature 1..13: note = hyper
  source 1..13: mol_type = genomic DNA
gcgaagatgtggt

SEQ ID NO: 1749 - DNA, 151 bp, Homo sapiens; identical to SEQ ID NO: 65
  misc_feature 1..151: note = chr1:75596708-75596859
  misc_feature 1..151: note = hyper
  source 1..151: mol_type = genomic DNA

SEQ ID NO: 1750 - DNA, 418 bp, Homo sapiens; identical to SEQ ID NO: 66
  misc_feature 1..418: note = chr1:75596929-75597347
  misc_feature 1..418: note = hyper
  source 1..418: mol_type = genomic DNA

SEQ ID NO: 1751 - DNA, 369 bp, Homo sapiens
  misc_feature 1..369: note = chr1:75601983-75602352
  misc_feature 1..369: note = hyper
  source 1..369: mol_type = genomic DNA
ttaacttgttatccccggcgggggggcggggaaccgacgtgcccgggtgagcgccggagacccggagcccggggagcgcgggacgagctaccagcgctcgggtggcggccgccagcggccagcgaaggaggctgcgcgccagcccgcccgcggcgcccgggctcaggcgccgtgacggctgcacgcgctgccccgcactctgagggccttcattagctcgctccccgcgccgaggctggggcgggcagcacgctcggaacttctgatctgtttctccatactttctccccctcctactccgcagtgtcaggggctcatgtcagaggagtgcgggcggactacagccctggcggccgggaggactcgcaa

SEQ ID NO: 1752 - DNA, 218 bp, Homo sapiens; identical to SEQ ID NO: 67
  misc_feature 1..218: note = chr1:77334168-77334386
  misc_feature 1..218: note = hyper
  source 1..218: mol_type = genomic DNA

SEQ ID NO: 1753 - DNA, 119 bp, Homo sapiens; identical to SEQ ID NO: 68
  misc_feature 1..119: note = chr1:77334408-77334527
  misc_feature 1..119: note = hyper
  source 1..119: mol_type = genomic DNA

SEQ ID NO: 1754 - DNA, 267 bp, Homo sapiens
  misc_feature 1..267: note = chr1:78957231-78957498
  misc_feature 1..267: note = hyper
  source 1..267: mol_type = genomic DNA
cacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctg

SEQ ID NO: 1755 - DNA, 590 bp, Homo sapiens
  misc_feature 1..590: note = chr1:91172087-91172677
  misc_feature 1..590: note = hyper
  source 1..590: mol_type = genomic DNA
catgcctccctgaagcgctgtctgtacccgggcgcaggaactcgtggcggccgggcggtcctgaaggtggaggagcgcggggcccagctggggtacgcgccgagcaagaacccgcacggagccggcgcgccgcggctgggcttcaaggccgccgcgccaaatccctggctgcgacgtgtatgcgaatcgttaggaggaggcgggaggacagccacactgagggcctcttcactaaagaatgaagtctgacggcgggaatgggggtgggtgggggcgggaatccatcagctccacaaagtgacagggcccttttatcgtaaatcaagttcaatctcgctctcgcgaaggtcctcttttttcggcggagctcccgcaggggcgactcgctgtcccagaccagatagtagcaagagctgggagagacccaaatctgcagggagagggcgcgggctgagagccgcggtggggagcagggcctgggcccagcgcgacctgcagggctgctgcctcgggagcgcttctgctctgcctgcggtggccgaggcggcggctcgccgagcgcgctccgagctgtgcgaacagaggaagta

SEQ ID NO: 1756 - DNA, 417 bp, Homo sapiens; identical to SEQ ID NO: 69
  misc_feature 1..417: note = chr1:91177840-91178257
  misc_feature 1..417: note = hyper
  source 1..417: mol_type = genomic DNA

SEQ ID NO: 1757 - DNA, 241 bp, Homo sapiens; identical to SEQ ID NO: 70
  misc_feature 1..241: note = chr1:91181807-91182048
  misc_feature 1..241: note = hyper
  source 1..241: mol_type = genomic DNA

SEQ ID NO: 1758 - DNA, 162 bp, Homo sapiens
  misc_feature 1..162: note = chr1:91182320-91182482
  misc_feature 1..162: note = hyper
  source 1..162: mol_type = genomic DNA
aattaaaaaagaagacgtggaagtcctgggggccgaggcggccgagcccagctgctgggggggcggcggcggcggctgctgtggcggcagcggctgctgctgttggggcaaaggctgcaaactttgcgtcggggccgcggccggcggcggcggctgctggct

SEQ ID NO: 1759 - DNA, 139 bp, Homo sapiens
  misc_feature 1..139: note = chr1:91184274-91184413
  misc_feature 1..139: note = hyper
  source 1..139: mol_type = genomic DNA
aaatgcctggccagacgctttctcccgaacgggggagctaatgcccgaggcgttctctggtggcgagggcagccacggttcactgcggtgtcgggcgggcgcggggctcaggacccatagcggctggtctgcagcccgc

SEQ ID NO: 1760 - DNA, 73 bp, Homo sapiens
  misc_feature 1..73: note = chr1:91184414-91184487
  misc_feature 1..73: note = hyper
  source 1..73: mol_type = genomic DNA
cccctgccgcgccccgcggcagtccgtccacctctgtcccccggcccctttcggcgagcgctcatttggaaag

SEQ ID NO: 1761 - DNA, 119 bp, Homo sapiens
  misc_feature 1..119: note = chr1:91185190-91185309
  misc_feature 1..119: note = hyper
  source 1..119: mol_type = genomic DNA
aggagatgcacaatccgggcagctctcgctcttctcggaaggcgaagggagtttggcggagaagacggggttggtgagccgaggcggggactccggacgtgctccatcccggcaggggc

SEQ ID NO: 1762 - DNA, 230 bp, Homo sapiens
  misc_feature 1..230: note = chr1:91185347-91185577
  misc_feature 1..230: note = hyper
  source 1..230: mol_type = genomic DNA
cgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcg

SEQ ID NO: 1763 - DNA, 481 bp, Homo sapiens; identical to SEQ ID NO: 71
  misc_feature 1..481: note = chr1:91188983-91189464
  misc_feature 1..481: note = hyper
  source 1..481: mol_type = genomic DNA

SEQ ID NO: 1764 - DNA, 269 bp, Homo sapiens; identical to SEQ ID NO: 72
  misc_feature 1..269: note = chr1:91190137-91190406
  misc_feature 1..269: note = hyper
  source 1..269: mol_type = genomic DNA

SEQ ID NO: 1765 - DNA, 80 bp, Homo sapiens
  misc_feature 1..80: note = chr1:91190869-91190949
  misc_feature 1..80: note = hyper
  source 1..80: mol_type = genomic DNA
tgggcttgtaaaagacgcttccgcagagcaggtcccgtcagggtctttttcctgttcctggtgccagcggtcggcccggg

SEQ ID NO: 1766 - DNA, 17 bp, Homo sapiens
  misc_feature 1..17: note = chr1:91190984-91191001
  misc_feature 1..17: note = hyper
  source 1..17: mol_type = genomic DNA
cggagagtgcccctccc

SEQ ID NO: 1767 - DNA, 233 bp, Homo sapiens
  misc_feature 1..233: note = chr1:91191002-91191235
  misc_feature 1..233: note = hyper
  source 1..233: mol_type = genomic DNA
caggcgccgtggcgagatcactctgaatatgtaacatatttgtaacgtgcgccgaggtgtgatgtgtgtgctgaaatagggggatgggggaattcgaagccggattgggaaggcgggggggaggcgcacagaactcacaatgtacttcgcaatctaacaatctgaacattcatttattaaaagctgctgcgtgacatttacactgagccaccagtctctgcctctaatccggg

SEQ ID NO: 1768 - DNA, 249 bp, Homo sapiens
  misc_feature 1..249: note = chr1:91191289-91191538
  misc_feature 1..249: note = hyper
  source 1..249: mol_type = genomic DNA
cgcggccggacagagcccatcagctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctg

SEQ ID NO: 1769 - DNA, 233 bp, Homo sapiens; identical to SEQ ID NO: 73
  misc_feature 1..233: note = chr1:91192344-91192577
  misc_feature 1..233: note = hyper
  source 1..233: mol_type = genomic DNA

SEQ ID NO: 1770 - DNA, 54 bp, Homo sapiens; identical to SEQ ID NO: 74
  misc_feature 1..54: note = chr1:91192681-91192735
  misc_feature 1..54: note = hyper
  source 1..54: mol_type = genomic DNA

SEQ ID NO: 1771 - DNA, 242 bp, Homo sapiens; identical to SEQ ID NO: 75
  misc_feature 1..242: note = chr1:91195148-91195390
  misc_feature 1..242: note = hyper
  source 1..242: mol_type = genomic DNA

SEQ ID NO: 1772 - DNA, 71 bp, Homo sapiens
  misc_feature 1..71: note = chr1:91316261-91316332
  misc_feature 1..71: note = hyper
  source 1..71: mol_type = genomic DNA
gccggctttgggcaccgggggtgggggctacgctacgcgtgaagggcctcagtcctcgggctttagttcag

SEQ ID NO: 1773 - DNA, 146 bp, Homo sapiens
  misc_feature 1..146: note = chr1:92948451-92948597
  misc_feature 1..146: note = hyper
  source 1..146: mol_type = genomic DNA
gaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaag

SEQ ID NO: 1774 - DNA, 135 bp, Homo sapiens
  misc_feature 1..135: note = chr1:92952304-92952439
  misc_feature 1..135: note = hyper
  source 1..135: mol_type = genomic DNA
ttgctcatttcccttcggatttaggtaatggttaaatttggaagaggtgggcgagcgccgagcccccggcggagagggccctggcggcgcgtcccgcgggcgcccggcgggaccggtgggcgcaccctccctgcg

SEQ ID NO: 1775 - DNA, 307 bp, Homo sapiens
  misc_feature 1..307: note = chr1:98511359-98511666
  misc_feature 1..307: note = hyper
  source 1..307: mol_type = genomic DNA
ggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaa

SEQ ID NO: 1776 - DNA, 361 bp, Homo sapiens
  misc_feature 1..361: note = chr1:101004456-101004817
  misc_feature 1..361: note = hyper
  source 1..361: mol_type = genomic DNA
agtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctg

SEQ ID NO: 1777 - DNA, 653 bp, Homo sapiens
  misc_feature 1..653: note = chr1:101005071-101005724
  misc_feature 1..653: note = hyper
  source 1..653: mol_type = genomic DNA
ggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtcc

SEQ ID NO: 1778 - DNA, 604 bp, Homo sapiens
  misc_feature 1..604: note = chr1:107683171-107683775
  misc_feature 1..604: note = hyper
  source 1..604: mol_type = genomic DNA
ttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctcagtaaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggc

SEQ ID NO: 1779 - DNA, 13 bp, Homo sapiens
  misc_feature 1..13: note = chr1:107683776-107683789
  misc_feature 1..13: note = hyper
  source 1..13: mol_type = genomic DNA
gggagtggcgggc

SEQ ID NO: 1780 - DNA, 450 bp, Homo sapiens; identical to SEQ ID NO: 76
  misc_feature 1..450: note = chr1:108506627-108507077
  misc_feature 1..450: note = hyper
  source 1..450: mol_type = genomic DNA

SEQ ID NO: 1781 - DNA, 228 bp, Homo sapiens; identical to SEQ ID NO: 77
  misc_feature 1..228: note = chr1:108507148-108507376
  misc_feature 1..228: note = hyper
  source 1..228: mol_type = genomic DNA

SEQ ID NO: 1782 - DNA, 113 bp, Homo sapiens; identical to SEQ ID NO: 78
  misc_feature 1..113: note = chr1:108507494-108507607
  misc_feature 1..113: note = hyper
  source 1..113: mol_type = genomic DNA

SEQ ID NO: 1783 - DNA, 550 bp, Homo sapiens; identical to SEQ ID NO: 79
  misc_feature 1..550: note = chr1:108507657-108508207
  misc_feature 1..550: note = hyper
  source 1..550: mol_type = genomic DNA

SEQ ID NO: 1784 - DNA, 340 bp, Homo sapiens; identical to SEQ ID NO: 80
  misc_feature 1..340: note = chr1:108508208-108508548
  misc_feature 1..340: note = hyper
  source 1..340: mol_type = genomic DNA

SEQ ID NO: 1785 - DNA, 38 bp, Homo sapiens; identical to SEQ ID NO: 81
  misc_feature 1..38: note = chr1:108508549-108508587
  misc_feature 1..38: note = hyper
  source 1..38: mol_type = genomic DNA

SEQ ID NO: 1786 - DNA, 312 bp, Homo sapiens; identical to SEQ ID NO: 82
  misc_feature 1..312: note = chr1:110610586-110610898
  misc_feature 1..312: note = hyper
  source 1..312: mol_type = genomic DNA

SEQ ID NO: 1787 - DNA, 232 bp, Homo sapiens; identical to SEQ ID NO: 83
  misc_feature 1..232: note = chr1:110611045-110611277
  misc_feature 1..232: note = hyper
  source 1..232: mol_type = genomic DNA

SEQ ID NO: 1788 - DNA, 80 bp, Homo sapiens; identical to SEQ ID NO: 84
  misc_feature 1..80: note = chr1:110611434-110611514
  misc_feature 1..80: note = hyper
  source 1..80: mol_type = genomic DNA

SEQ ID NO: 1789 - DNA, 141 bp, Homo sapiens; identical to SEQ ID NO: 85
  misc_feature 1..141: note = chr1:110611653-110611794
  misc_feature 1..141: note = hyper
  source 1..141: mol_type = genomic DNA

SEQ ID NO: 1790 - DNA, 128 bp, Homo sapiens
  misc_feature 1..128: note = chr1:110626790-110626918
  misc_feature 1..128: note = hyper
  source 1..128: mol_type = genomic DNA
ccctcgcgtggccgggcgcagatccccgtgcacgggtcctccgcacacccttgccagcccgcagggattgttcgccgcgttggtgactccttcccaaaatgggaataaaagatcgaaatagctagtaa

SEQ ID NO: 1791 - DNA, 480 bp, Homo sapiens
  misc_feature 1..480: note = chr1:110627133-110627613
  misc_feature 1..480: note = hyper
  source 1..480: mol_type = genomic DNA
aatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcag

SEQ ID NO: 1792 - DNA, 595 bp, Homo sapiens; identical to SEQ ID NO: 86
  misc_feature 1..595: note = chr1:110692902-110693497
  misc_feature 1..595: note = hyper
  source 1..595: mol_type = genomic DNA

SEQ ID NO: 1793 - DNA, 433 bp, Homo sapiens; identical to SEQ ID NO: 87
  misc_feature 1..433: note = chr1:110693736-110694169
  misc_feature 1..433: note = hyper
  source 1..433: mol_type = genomic DNA

SEQ ID NO: 1794 - DNA, 295 bp, Homo sapiens
  misc_feature 1..295: note = chr1:111097952-111098247
  misc_feature 1..295: note = hyper
  source 1..295: mol_type = genomic DNA
ataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgcaaccaaagggaggcccgggtgccagtgggcggccgccgcggtgtggagggc

SEQ ID NO: 1795 - DNA, 239 bp, Homo sapiens; identical to SEQ ID NO: 88
  misc_feature 1..239: note = chr1:111216734-111216973
  misc_feature 1..239: note = hyper
  source 1..239: mol_type = genomic DNA

SEQ ID NO: 1796 - DNA, 381 bp, Homo sapiens; identical to SEQ ID NO: 89
  misc_feature 1..381: note = chr1:111217194-111217575
  misc_feature 1..381: note = hyper
  source 1..381: mol_type = genomic DNA

SEQ ID NO: 1797 - DNA, 136 bp, Homo sapiens; identical to SEQ ID NO: 90
  misc_feature 1..136: note = chr1:111217576-111217712
  misc_feature 1..136: note = hyper
  source 1..136: mol_type = genomic DNA

SEQ ID NO: 1798 - DNA, 179 bp, Homo sapiens; identical to SEQ ID NO: 91
  misc_feature 1..179: note = chr1:111217713-111217892
  misc_feature 1..179: note = hyper
  source 1..179: mol_type = genomic DNA

SEQ ID NO: 1799 - DNA, 93 bp, Homo sapiens; identical to SEQ ID NO: 92
  misc_feature 1..93: note = chr1:111217923-111218016
  misc_feature 1..93: note = hyper
  source 1..93: mol_type = genomic DNA

SEQ ID NO: 1800 - DNA, 366 bp, Homo sapiens
  misc_feature 1..366: note = chr1:114695329-114695695
  misc_feature 1..366: note = hyper
  source 1..366: mol_type = genomic DNA
gagacgccgcagctgcgcgccagggtccagcccggcggggatcgggctcgggactcacccgctccggcgagctcgactcagctcgggctcccgcctcggctaggcagccgcctggggctgcgtcccgcgcagggtcagcgcggatcgggcaggaggcgccctcttggcaaagtcggctagaggcgccagctcagtcgcgcaccggccccgagtccgagtccgagagggacggagggagcgagttataggggcgagagggggtgggggaaggacgccgcaacaccctcataccctcccccaccccgccccctgtcccccgccccccagcggagacgcggaaaaccactcgcagccggagagacaccc

SEQ ID NO: 1801 - DNA, 41 bp, Homo sapiens
  misc_feature 1..41: note = chr1:114695696-114695737
  misc_feature 1..41: note = hyper
  source 1..41: mol_type = genomic DNA
gacacaaagacctcgtgccagccgcagacccaagtttctcc

SEQ ID NO: 1802 - DNA, 310 bp, Homo sapiens
  misc_feature 1..310: note = chr1:114695799-114696109
  misc_feature 1..310: note = hyper
  source 1..310: mol_type = genomic DNA
cgcacggacccggggacctcgacactcgctaggaggcaagccctattcctcagccgggcgcccctcgtctcccgctctctccatggacccctctcctggcaaatcgcccgcagagcgagcttggagatgcgagggaaactgaagccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctccca

SEQ ID NO: 1803 - DNA, 138 bp, Homo sapiens
  misc_feature 1..138: note = chr1:116371049-116371187
  misc_feature 1..138: note = hyper
  source 1..138: mol_type = genomic DNA
ggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacac

SEQ ID NO: 1804 - DNA, 13 bp, Homo sapiens
  misc_feature 1..13: note = chr1:116371188-116371201
  misc_feature 1..13: note = hyper
  source 1..13: mol_type = genomic DNA
tcagtcaattcag

SEQ ID NO: 1805 - DNA, 144 bp, Homo sapiens
  misc_feature 1..144: note = chr1:119530005-119530149
  misc_feature 1..144: note = hyper
  source 1..144: mol_type = genomic DNA
cgacgaaaatgcaaggctcagtccagccccaaaaattggttccggtgaatttagggaggctcagggcatttgcgcgaagaaacagaaacctatgttggggcaaggcagggcgtcaatggcagggcctagctcctcacccgcgac

SEQ ID NO: 1806 - DNA, 307 bp, Homo sapiens
  misc_feature 1..307: note = chr1:119530201-119530508
  misc_feature 1..307: note = hyper
  source 1..307: mol_type = genomic DNA
cgacgcactcacccgggtgaggctccaggccgtgtgccgccgcgtcctccgtgtctccgagtgggcccgcggggctcagcgcctccatagacaggtccagccccttctcctcccagtctcgcagtttccgttttttatttgagccgatcaaggcttcaacggagaaggcatgtgctcgcgagctcagggcgactgcagatcttctcctttcactcattttagccgcccacacccctgcctccgcttgcccccgctaccgagggagcagccggcgccctcaagctctgagcgcccaccgggcccggcc

SEQ ID NO: 1807 - DNA, 47 bp, Homo sapiens
  misc_feature 1..47: note = chr1:119530553-119530600
  misc_feature 1..47: note = hyper
  source 1..47: mol_type = genomic DNA
cgggtctctccaccctccccctgcgtcctcctccgccctcctctgcc

SEQ ID NO: 1808 - DNA, 124 bp, Homo sapiens
  misc_feature 1..124: note = chr1:119530601-119530725
  misc_feature 1..124: note = hyper
  source 1..124: mol_type = genomic DNA
gatccgacctgcgcccctacgctggcccagctgctaggaactagcgccccgagcgccgcccgctcgctgcatgagcgcccgagtcctgcttcccacccaccggggcaggcgctcacagactgtg

SEQ ID NO: 1809 - DNA, 93 bp, Homo sapiens
  misc_feature 1..93: note = chr1:119531021-119531114
  misc_feature 1..93: note = hyper
  source 1..93: mol_type = genomic DNA
gaacaagagaaactccgagagcgcgaaccaatgagaggaagggagagactgaggcccgggccaaagcgcagcgccagtcgtcccctggatgct

SEQ ID NO: 1810 - DNA, 487 bp, Homo sapiens
  misc_feature 1..487: note = chr1:119543532-119544019
  misc_feature 1..487: note = hyper
  source 1..487: mol_type = genomic DNA
taaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgaggggg

SEQ ID NO: 1811 - DNA, 606 bp, Homo sapiens
  misc_feature 1..606: note = chr1:119549129-119549735
  misc_feature 1..606: note = hyper
  source 1..606: mol_type = genomic DNA
agcctcaatcttaaccgcgtatgatcgtttccactgcacctgtgcgggagagacaggcgcatatccccgtggcgtcggatctctaaattatctaatctggcggctgcgtacgactcagggaaagccctggccgcgagctttttcaccaggcttgagctcagcagccgggcccgcagtgttgccgccagtggggaggcagggaggctgtcggcgcgccggagccaggcgggaaagggactacagccgcccgccgttgtagcgcaggaagcgggcggtgccaacacacacctcgcagctctgcacgttcttcgtgtcttggaggagagtagagcctccgtgtgaagctccgtccgcacctgacgaagaggagggcgtcttgcgccactccagcgactctgcgatgttaagacgcagacccgctgctgcgcctgcctttgtcggggcgggcgggcagccgccgctcggagcaaggtggggctgcggggagggagagccgcggggcagatccctggccaaggtcctctagaaagcccgctctgcgcccaaacgcgccgctcggtccgtgggccacttcggacctgacgctgccggtgaattcacgcgctc

SEQ ID NO: 1812 - DNA, 15 bp, Homo sapiens
  misc_feature 1..15: note = chr1:119549914-119549929
  misc_feature 1..15: note = hyper
  source 1..15: mol_type = genomic DNA
cgtctaccccaaccc

SEQ ID NO: 1813 - DNA, 285 bp, Homo sapiens; identical to SEQ ID NO: 93
  misc_feature 1..285: note = chr1:119551013-119551298
  misc_feature 1..285: note = hyper
  source 1..285: mol_type = genomic DNA

SEQ ID NO: 1814 - DNA, 337 bp, Homo sapiens
  misc_feature 1..337: note = chr1:151694069-151694406
  misc_feature 1..337: note = hyper
  source 1..337: mol_type = genomic DNA
cagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatatt

SEQ ID NO: 1815 - DNA, 297 bp, Homo sapiens
  misc_feature 1..297: note = chr1:153651898-153652195
  misc_feature 1..297: note = hyper
  source 1..297: mol_type = genomic DNA
gtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgtt

SEQ ID NO: 1816 - DNA, 15 bp, Homo sapiens
  misc_feature 1..15: note = chr1:154474763-154474778
  misc_feature 1..15: note = hyper
  source 1..15: mol_type = genomic DNA
tgctctttcctcctg

SEQ ID NO: 1817 - DNA, 81 bp, Homo sapiens; identical to SEQ ID NO: 95
  misc_feature 1..81: note = chr1:154474987-154475068
  misc_feature 1..81: note = hyper
  source 1..81: mol_type = genomic DNA

SEQ ID NO: 1818 - DNA, 173 bp, Homo sapiens; identical to SEQ ID NO: 96
  misc_feature 1..173: note = chr1:154475371-154475544
  misc_feature 1..173: note = hyper
  source 1..173: mol_type = genomic DNA

SEQ ID NO: 1819 - DNA, 662 bp, Homo sapiens; identical to SEQ ID NO: 97
  misc_feature 1..662: note = chr1:156357865-156358527
  misc_feature 1..662: note = hyper
  source 1..662: mol_type = genomic DNA

SEQ ID NO: 1820 - DNA, 714 bp, Homo sapiens; identical to SEQ ID NO: 98
  misc_feature 1..714: note = chr1:156390135-156390849
  misc_feature 1..714: note = hyper
  source 1..714: mol_type = genomic DNA

SEQ ID NO: 1821 - DNA, 48 bp, Homo sapiens
  misc_feature 1..48: note = chr1:156405367-156405415
  misc_feature 1..48: note = hyper
  source 1..48: mol_type = genomic DNA
cgccggcagggcccccgaggcgcctctgcctgctctctccgttcttgc

SEQ ID NO: 1822 - DNA, 437 bp, Homo sapiens
  misc_feature 1..437: note = chr1:156405634-156406071
  misc_feature 1..437: note = hyper
  source 1..437: mol_type = genomic DNA
cgcgggctccggagctgaggtgagaagtgagcagaaagtgaaaagagaatccatcggaaacagataaaaaaggaaaaacaaaacccactcgaaaagaaagaaaacgttacaacaaaaaggataaagtaacgctaaatgaaataaaaaggagacatactaaaaacgttaaagttgttaaactaagtgatagaaaaggcgaagaaacaacagggctaggaaagggctccgaggcgcccgcagggaagggggccctagacggggcgatgaggcttttgggagcctccggccgcgggcgcggcggggtccggcgggtgcgcagcggccggggctcctccgcgcgctgcccgccgccggcacccggctcgggcgaagagccggctggacggtcagccagccccacccacagagagtcgcgggagcccgagggccgggagctg

SEQ ID NO: 1823 - DNA, 327 bp, Homo sapiens
  misc_feature 1..327: note = chr1:156406104-156406431
  misc_feature 1..327: note = hyper
  source 1..327: mol_type = genomic DNA
cgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaa

SEQ ID NO: 1824 - DNA, 20 bp, Homo sapiens
  misc_feature 1..20: note = chr1:156814933-156814953
  misc_feature 1..20: note = hyper
  source 1..20: mol_type = genomic DNA
tgcaggcatggatgtcgatc

SEQ ID NO: 1825 - DNA, 210 bp, Homo sapiens
  misc_feature 1..210: note = chr1:156815030-156815240
  misc_feature 1..210: note = hyper
  source 1..210: mol_type = genomic DNA
cgagctgttgccccccagccggaggggcccagctgcccggcggtgccgccctgagtccctggggagagcgagtcagagccaaggcccagcccccaaagccacgcccctcagcacctgccctagtcctgctcacctttgggggctcttgttgatggacgtcaccttccaaggggatctggggaggccaggagtagccctatcaggcctgtc

SEQ ID NO: 1826 - DNA, 425 bp, Homo sapiens; identical to SEQ ID NO: 99
  misc_feature 1..425: note = chr1:156863061-156863486
  misc_feature 1..425: note = hyper
  source 1..425: mol_type = genomic DNA

SEQ ID NO: 1827 - DNA, 69 bp, Homo sapiens; identical to SEQ ID NO: 100
  misc_feature 1..69: note = chr1:156863640-156863709
  misc_feature 1..69: note = hyper
  source 1..69: mol_type = genomic DNA

SEQ ID NO: 1828 - DNA, 44 bp, Homo sapiens
  misc_feature 1..44: note = chr1:158150605-158150649
  misc_feature 1..44: note = hyper
  source 1..44: mol_type = genomic DNA
caggaaattgagacacgccggttgtgaaacctactgaagtgagc

SEQ ID NO: 1829 - DNA, 147 bp, Homo sapiens
  misc_feature 1..147: note = chr1:158150650-158150797
  misc_feature 1..147: note = hyper
  source 1..147: mol_type = genomic DNA
gcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagc

SEQ ID NO: 1830 - DNA, 104 bp, Homo sapiens
  misc_feature 1..104: note = chr1:158150798-158150902
  misc_feature 1..104: note = hyper
  source 1..104: mol_type = genomic DNA
gaaagggacgtgagctgagcggcgggggagaagagtgcgcaggtcagagggcggcgcgcagcggcgctccgcgaggtccccacgccgggcgatatggggtgcct

SEQ ID NO: 1831 - DNA, 36 bp, Homo sapiens
  misc_feature 1..36: note = chr1:159158333-159158369
  misc_feature 1..36: note = hyper
  source 1..36: mol_type = genomic DNA
ctggcgaagttcacccgggactccaaagcccggaca

SEQ ID NO: 1832 - DNA, 40 bp, Homo sapiens
  misc_feature 1..40: note = chr1:159158471-159158511
  misc_feature 1..40: note = hyper
  source 1..40: mol_type = genomic DNA
cgcaaggccggtttctttgtccctccgcctcttcaggttg

SEQ ID NO: 1833 - DNA, 438 bp, Homo sapiens
  misc_feature 1..438: note = chr1:161275639-161276077
  misc_feature 1..438: note = hyper
  source 1..438: mol_type = genomic DNA
cgatcccccgcccggcccgctaaccgctatttcttatccttgcgagactcccccagccccttggccttcttctcactgacagctttggtgcttctgctgtggtccagcattgcatacagcactggcgtctgggggaggggcgcacacatcagtcaccgagcgactggggcttgactgttcccatcccacccctcactgctgcccggcggctcccagggttctccttcccatcttgtctaggccccaagtcccgctaacctgccgcccgcgcttcgacgcgtcctttcctggcttgtgcaatttccccttctccatagcactgcaagaagagagactgctgtacgtttggcctcgccggaaccccttgcaccgcggacacagcttcctcttccccttggccctcccacccactggagtagtctccgcccagatggggga

SEQ ID NO: 1834 - DNA, 56 bp, Homo sapiens
  misc_feature 1..56: note = chr1:165324488-165324544
  misc_feature 1..56: note = hyper
  source 1..56: mol_type = genomic DNA
cggctttggggaattcggtgcccagtgcgtgaggcctggggcggcttgttggattt

SEQ ID NO: 1835 - DNA, 489 bp, Homo sapiens
  misc_feature 1..489: note = chr1:165325716-165326205
  misc_feature 1..489: note = hyper
  source 1..489: mol_type = genomic DNA
cgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccc

SEQ ID NO: 1836 - DNA, 173 bp, Homo sapiens
  misc_feature 1..173: note = chr1:165326296-165326469
  misc_feature 1..173: note = hyper
  source 1..173: mol_type = genomic DNA
cgctgcaatccttacccgggccccgggaagcgctgagaagctgtttagcgccagtagatgtgggcccagcagctcctagctcctcaaacccctcatcacccgagggctcatgccagtttccaacttcctttaaggtcgaaccatattcactcatggggcgtacagaggccatg

SEQ ID NO: 1837 - DNA, 636 bp, Homo sapiens
  misc_feature 1..636: note = chr1:167599216-167599852
  misc_feature 1..636: note = hyper
  source 1..636: mol_type = genomic DNA
gagaaggactgagaccgtggcaaagcccagggtcctgagaaacttcgcgagacagaggggcccggtggctgcccatccccatgtttgggcacatggagtcgtggctcccgctcttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggtaaaggaccccggagggagacgcggggctgagcggtgagcggtgtatcgggcgccccttccccgggcggctgcccctgccctgagcatggagcacgcggctcatcgctgctgccaactagaagggcaaatgcctgctgttccgacgcctccttgaccaactccgaaggatcgtccctggtcccac

SEQ ID NO: 1838 - DNA, 278 bp, Homo sapiens; identical to SEQ ID NO: 101
  misc_feature 1..278: note = chr1:169396357-169396635
  misc_feature 1..278: note = hyper
  source 1..278: mol_type = genomic DNA

SEQ ID NO: 1839 - DNA, 53 bp, Homo sapiens; identical to SEQ ID NO: 102
  misc_feature 1..53: note = chr1:169396636-169396689
  misc_feature 1..53: note = hyper
  source 1..53: mol_type = genomic DNA

SEQ ID NO: 1840 - DNA, 193 bp, Homo sapiens; identical to SEQ ID NO: 103
  misc_feature 1..193: note = chr1:169396730-169396923
  misc_feature 1..193: note = hyper
  source 1..193: mol_type = genomic DNA

SEQ ID NO: 1841 - DNA, 144 bp, Homo sapiens; identical to SEQ ID NO: 104
  misc_feature 1..144: note = chr1:170630458-170630602
  misc_feature 1..144: note = hyper
  source 1..144: mol_type = genomic DNA

SEQ ID NO: 1842 - DNA, 207 bp, Homo sapiens; identical to SEQ ID NO: 105
  misc_feature 1..207: note = chr1:170630603-170630810
  misc_feature 1..207: note = hyper
  source 1..207: mol_type = genomic DNA

SEQ ID NO: 1843 - DNA, 595 bp, Homo sapiens; identical to SEQ ID NO: 106
  misc_feature 1..595: note = chr1:171810200-171810795
  misc_feature 1..595: note = hyper
  source 1..595: mol_type = genomic DNA

SEQ ID NO: 1844 - DNA, 376 bp, Homo sapiens
  misc_feature 1..376: note = chr1:177140304-177140680
  misc_feature 1..376: note = hyper
  source 1..376: mol_type = genomic DNA
cgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacac

SEQ ID NO: 1845 - DNA, 499 bp, Homo sapiens
  misc_feature 1..499: note = chr1:180202658-180203157
  misc_feature 1..499: note = hyper
  source 1..499: mol_type = genomic DNA
ccaaaactctccccgcggacctcagcagtccctccacgcgtcggggccctgctggccggccatgccctctgaggagacgcggaaaagagcgaggcatataggaaggtggggcgttttatccgcctcggttttgacccatctgccatgtagtctccccaggcaccgagggaaaggacgacggaagcccgccgcccggatcgctggcgggagagagggcagcccgcacgggagaaggaggagccccgcggggtctccgctgggggtggtaattggaatgcaggcctgggggtctctgtccccctccttgtctcctaaaatgcttccggcaagctctggcgaaccccgaagctgtaggaaaaaggtattttattttgtgtttggtagggtcggggtaaaggttttccctgggacttcctctcctggggctcctccggggtgcgtggggtaatgtcccagcgcaggtcgagttgcagatccgagtccccggggttgttgactg

SEQ ID NO: 1846 - DNA, 243 bp, Homo sapiens
  misc_feature 1..243: note = chr1:180203365-180203608
  misc_feature 1..243: note = hyper
  source 1..243: mol_type = genomic DNA
gattctatcatattccgaacattccgatatagcagctgtaggcaccatagacctccctccctgcgtcgcgagaatatattctcaggcaggagacaatttttacagatgaggtcagctgtccccgccggccgattcgggcctgatgggttgggggttccgatgtcctaactgctaggatcccgttccagcccctggccagagctgtgtaccacaaagaagggagtttggagaaacccgggtaag

SEQ ID NO: 1847 - DNA, 588 bp, Homo sapiens
  misc_feature 1..588: note = chr1:180203633-180204221
  misc_feature 1..588: note = hyper
  source 1..588: mol_type = genomic DNA
cggatggctgaggactcccaaggggcgagagggctccggcctcctcctttccagggccttgttatctgagagggccgttagcacggagggaagcttggaaagccgctgtcccagtgcgctccgcatgcggaattaactgttaaagccggacacggagcacgcaggtgcagcaggtgaggggcaaaggtctgcattgagcagtccgcagtgtcccgggaagtcgtaaagtcgggactgagaagaagcaggacctaactcaagtttatttcctctcttggccgaggtccgggctcgtggaaaaccagagctaggcggggctacgcagggctgagcaggagtggcgtcctagggtctgggagcgcgacccacatgacctcgctacgaccggggcagggctcctccgccccgcgggcagatgccggcctgggtggcccggggaacagacgatgaattctttaaatgagcgtttgctgcgcacccatgggcggctcacgatcctgggcactcgcccgggaatcccgggcgtgctctgggttttgggggactcgccggtggaggtagatgtggacagggcggccggcccttcgc

SEQ ID NO: 1848 - DNA, 398 bp, Homo sapiens
  misc_feature 1..398: note = chr1:180204222-180204620
  misc_feature 1..398: note = hyper
  source 1..398: mol_type = genomic DNA
ggtagccggctttgcgcttactgcgtcccgcagcggtgggtaaaggtcgtagcccagaaggggacaagggagggaccgcctctctctccccggtgcgctgcaatagaggttcctgcgccttggcccttgcagtccatccgcccagaggttcgcgcccgttttcggagcttattatctcaggtagcccagaggtccgactgagctggaattagccaggcctgggacccctttgctgccctttagagtggtggcagggacttttccagcaaggataggcgcggcaggcgcgagtgcggacggcgcgcccattaggaggaggccgggtgaaaacctctcttcctctccagacccatttcgttccaagcatttggaatgacaaaattaaaccccaaccctgg

SEQ ID NO: 1849 - DNA, 18 bp, Homo sapiens
  misc_feature 1..18: note = chr1:180204897-180204915
  misc_feature 1..18: note = hyper
  source 1..18: mol_type = genomic DNA
cgccggggaaggcgaggt

SEQ ID NO: 1850 - DNA, 64 bp, Homo sapiens
  misc_feature 1..64: note = chr1:181288138-181288202
  misc_feature 1..64: note = hyper
  source 1..64: mol_type = genomic DNA
gagacactaacccaccgacgtctcccttgagatcgcggcttcctccttgcgcagaggactgagg

SEQ ID NO: 1851 - DNA, 978 bp, Homo sapiens
  misc_feature 1..978: note = chr1:181451381-181452359
  misc_feature 1..978: note = hyper
  source 1..978: mol_type = genomic DNA
gacaccttactagggcggcggcgggcccgtggcaccgctcccggcaccgaacagggcacagcactggggacacctctctgcagggacccaagacgcgcgtgcgtgtgcgccccacgccaggccctcgctctcttgcggagactccgccgcatcgctggctgcacctgcctctctcttctcggcattacttgggggaaaggggactcttcactggacctttgcagaggtggctgctaccctttggccacataaatcaagaaggcaagccagcctcaccttccaggaacctccagccttccggctgcgtccccgcccctcccgcctggccagctcctcccccgcttctcccagcgctcttgcgcgcctcgctgcgcctctgcgcgccgctcgctgtcctctgcctcgcctccccattctccttccgcatcttctccagtgctccgccgagggcgctgcctgcggggaagagggagactgagccgttagtgaggaagttcggtctgtggacaagtgtggtgccaggccgccgcgaggctcggctgcaacctgttcctcgcccgccggtgctcgccgcccgcccgctcgcactcccgccctctcggcggcgcagccgcggatcgctgttgcatgctgatccggggaggcggcggtggcgagcgctccgggcggatgctggcactcaggcttcgctgctctctggatgctgctcaacttctagcccaagcgcaggagctttgaagtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 1852 - DNA, 334 bp, Homo sapiens
  misc_feature 1..334: note = chr1:183387266-183387600
  misc_feature 1..334: note = hyper
  source 1..334: mol_type = genomic DNA
gggaaaggagaggagcggaagcggcttccagaggtgggcgggaggactcaccaaacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgt

SEQ ID NO: 1853 - DNA, 16 bp, Homo sapiens
  misc_feature 1..16: note = chr1:190445181-190445197
  misc_feature 1..16: note = hyper
  source 1..16: mol_type = genomic DNA
cacagtctcaaccccc

SEQ ID NO: 1854 - DNA, 23 bp, Homo sapiens
  misc_feature 1..23: note = chr1:190445198-190445221
  misc_feature 1..23: note = hyper
  source 1..23: mol_type = genomic DNA
ttccctctcggtgggagtcaagg

SEQ ID NO: 1855 - DNA, 62 bp, Homo sapiens; identical to SEQ ID NO: 107
  misc_feature 1..62: note = chr1:197879599-197879661
  misc_feature 1..62: note = hyper
  source 1..62: mol_type = genomic DNA

SEQ ID NO: 1856 - DNA, 508 bp, Homo sapiens; identical to SEQ ID NO: 108
  misc_feature 1..508: note = chr1:197879716-197880224
  misc_feature 1..508: note = hyper
  source 1..508: mol_type = genomic DNA

SEQ ID NO: 1857 - DNA, 160 bp, Homo sapiens; identical to SEQ ID NO: 109
  misc_feature 1..160: note = chr1:197886907-197887067
  misc_feature 1..160: note = hyper
  source 1..160: mol_type = genomic DNA

SEQ ID NO: 1858 - DNA, 311 bp, Homo sapiens; identical to SEQ ID NO: 110
  misc_feature 1..311: note = chr1:197887146-197887457
  misc_feature 1..311: note = hyper
  source 1..311: mol_type = genomic DNA

SEQ ID NO: 1859 - DNA, 416 bp, Homo sapiens; identical to SEQ ID NO: 111
  misc_feature 1..416: note = chr1:197887706-197888122
  misc_feature 1..416: note = hyper
  source 1..416: mol_type = genomic DNA

SEQ ID NO: 1860 - DNA, 45 bp, Homo sapiens; identical to SEQ ID NO: 112
  misc_feature 1..45: note = chr1:197888180-197888225
  misc_feature 1..45: note = hyper
  source 1..45: mol_type = genomic DNA

SEQ ID NO: 1861 - DNA, 299 bp, Homo sapiens; identical to SEQ ID NO: 113
  misc_feature 1..299: note = chr1:200009750-200010049
  misc_feature 1..299: note = hyper
  source 1..299: mol_type = genomic DNA

SEQ ID NO: 1862 - DNA, 361 bp, Homo sapiens
  misc_feature 1..361: note = chr1:200011323-200011684
  misc_feature 1..361: note = hyper
  source 1..361: mol_type = genomic DNA
tggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggtgggggctatttctctttcctttttggtaaacaaatcagaggaaacttctgcccggccgtggctttccatcccccacctgccccaccccctgcaaac

SEQ ID NO: 1863 - DNA, 383 bp, Homo sapiens
  misc_feature 1..383: note = chr1:200011685-200012068
  misc_feature 1..383: note = hyper
  source 1..383: mol_type = genomic DNA
ccactgattaacttaaaacaaactcggctgcgtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgt

SEQ ID NO: 1864 - DNA, 227 bp, Homo sapiens
  misc_feature 1..227: note = chr1:204653792-204654019
  misc_feature 1..227: note = hyper
  source 1..227: mol_type = genomic DNA
cgcttccccctgaccgagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgcc

SEQ ID NO: 1865 - DNA, 376 bp, Homo sapiens; identical to SEQ ID NO: 114
  misc_feature 1..376: note = chr1:205312536-205312912
  misc_feature 1..376: note = hyper
  source 1..376: mol_type = genomic DNA

SEQ ID NO: 1866 - DNA, 357 bp, Homo sapiens
  misc_feature 1..357: note = chr1:205424654-205425011
  misc_feature 1..357: note = hyper
  source 1..357: mol_type = genomic DNA
ggggtataaaggaaacggaggaggcactccaagcgggtttcactcagcggggacaggaggatcggctacctccggagccaaggctccctctcacactccccccaatcccaccagcggcaaaatcctttaaaaggaacaaaggcaatgggggcggggagggggcttcctctttggtcgacctagggcggcggctgacgcagcccgccgccggtcagctttcaggtgagtgcctgaacccgcatcccgcccatgccttagggacccctcttcgcccagccaagcccggggcggggaggaaagtccccctcagccgcactcgggcccccaacccggccaaggggtcgccaactcgcggca

SEQ ID NO: 1867 - DNA, 407 bp, Homo sapiens; identical to SEQ ID NO: 115
  misc_feature 1..407: note = chr1:207669381-207669788
  misc_feature 1..407: note = hyper
  source 1..407: mol_type = genomic DNA

SEQ ID NO: 1868 - DNA, 232 bp, Homo sapiens; identical to SEQ ID NO: 116
  misc_feature 1..232: note = chr1:207669828-207670060
  misc_feature 1..232: note = hyper
  source 1..232: mol_type = genomic DNA

SEQ ID NO: 1869 - DNA, 224 bp, Homo sapiens
  misc_feature 1..224: note = chr1:208084174-208084398
  misc_feature 1..224: note = hyper
  source 1..224: mol_type = genomic DNA
agctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccc

SEQ ID NO: 1870 - DNA, 239 bp, Homo sapiens
  misc_feature 1..239: note = chr1:214156419-214156658
  misc_feature 1..239: note = hyper
  source 1..239: mol_type = genomic DNA
ccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacac

SEQ ID NO: 1871 - DNA, 84 bp, Homo sapiens
  misc_feature 1..84: note = chr1:214158827-214158911
  misc_feature 1..84: note = hyper
  source 1..84: mol_type = genomic DNA
gctcctatttcaagtcgccgctcctgcgccctaatgcgggctgcgaaccgccgcggcagagcgtcgcgagccgggagcctctgc

SEQ ID NO: 1872 - DNA, 810 bp, Homo sapiens; identical to SEQ ID NO: 117
  misc_feature 1..810: note = chr1:215255060-215255870
  misc_feature 1..810: note = hyper
  source 1..810: mol_type = genomic DNA

SEQ ID NO: 1873 - DNA, 504 bp, Homo sapiens
  misc_feature 1..504: note = chr1:217307502-217308006
  misc_feature 1..504: note = hyper
  source 1..504: mol_type = genomic DNA
gagctgggaacagaccgcgctccagcccccatggtttgtgacggggaacttcgggcgcacacaccctggggagtaggtctcctccaaatggcaccgacacagactggcgctggatcttctctccctgctaatctatccgcaaagaccgcctgggcacttttgggggaatgtggccaaaaggggactctaactgcgacatctacagaggaaggagaaactggtggtgcctaagaagttgatctcgatgcgcgcagtgagggcacagggccctgcgcgccagagaagcgaagccagcggtctccacttacttgttcttaattcctccctacccccgctctggcctctcattttcggcctcatggatccaagacccgaggttattttcagtcacaactttctccacaccccgtacccccaaaagtgtacctcagctcaggcgggaaagggcactttgacccgccgtgcgcgagtttccagccagccgctgcgcgcctgagagaaaga

SEQ ID NO: 1874 - DNA, 94 bp, Homo sapiens
  misc_feature 1..94: note = chr1:220101117-220101211
  misc_feature 1..94: note = hyper
  source 1..94: mol_type = genomic DNA
tccaaaggatgcaaccgaaaggcacctgctacgtttgcgaacacggtcgcccccttctcccgcttcctttccaccgaggtcccccggagggtta

SEQ ID NO: 1875 - DNA, 239 bp, Homo sapiens
  misc_feature 1..239: note = chr1:220101370-220101609
  misc_feature 1..239: note = hyper
  source 1..239: mol_type = genomic DNA
cgcagtcctggaagatgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtag

SEQ ID NO: 1876 - DNA, 110 bp, Homo sapiens; identical to SEQ ID NO: 118
  misc_feature 1..110: note = chr1:223936643-223936753
  misc_feature 1..110: note = hyper
  source 1..110: mol_type = genomic DNA

SEQ ID NO: 1877 - DNA, 62 bp, Homo sapiens; identical to SEQ ID NO: 119
  misc_feature 1..62: note = chr1:223936995-223937057
  misc_feature 1..62: note = hyper
  source 1..62: mol_type = genomic DNA

SEQ ID NO: 1878 - DNA, 62 bp, Homo sapiens; identical to SEQ ID NO: 120
  misc_feature 1..62: note = chr1:224804625-224804687
  misc_feature 1..62: note = hyper
  source 1..62: mol_type = genomic DNA

SEQ ID NO: 1879 - DNA, 270 bp, Homo sapiens; identical to SEQ ID NO: 121
  misc_feature 1..270: note = chr1:224804846-224805116
  misc_feature 1..270: note = hyper
  source 1..270: mol_type = genomic DNA

SEQ ID NO: 1880 - DNA, 555 bp, Homo sapiens; identical to SEQ ID NO: 122
  misc_feature 1..555: note = chr1:224805197-224805752
  misc_feature 1..555: note = hyper
  source 1..555: mol_type = genomic DNA

SEQ ID NO: 1881 - DNA, 18 bp, Homo sapiens
  misc_feature 1..18: note = chr1:224805848-224805866
  misc_feature 1..18: note = hyper
  source 1..18: mol_type = genomic DNA
cgccggtcctctcaaaga

SEQ ID NO: 1882 - DNA, 1554 bp, Homo sapiens; identical to SEQ ID NO: 124
  misc_feature 1..1554: note = chr1:228194949-228196503
  misc_feature 1..1554: note = hyper
  source 1..1554: mol_type = genomic DNA

SEQ ID NO: 1883 - DNA, 107 bp, Homo sapiens; identical to SEQ ID NO: 125
  misc_feature 1..107: note = chr1:228633813-228633920
  misc_feature 1..107: note = hyper
  source 1..107: mol_type = genomic DNA

SEQ ID NO: 1884 - DNA, 29 bp, Homo sapiens
  misc_feature 1..29: note = chr1:228633921-228633950
  misc_feature 1..29: note = hyper
  source 1..29: mol_type = genomic DNA
gcttctctgcagctgtacaccctgcactg

SEQ ID NO: 1885 - DNA, 157 bp, Homo sapiens; identical to SEQ ID NO: 127
  misc_feature 1..157: note = chr1:228633983-228634140
  misc_feature 1..157: note = hyper
  source 1..157: mol_type = genomic DNA

SEQ ID NO: 1886 - DNA, 470 bp, Homo sapiens; identical to SEQ ID NO: 128
  misc_feature 1..470: note = chr1:228651432-228651902
  misc_feature 1..470: note = hyper
  source 1..470: mol_type = genomic DNA

SEQ ID NO: 1887 - DNA, 247 bp, Homo sapiens; identical to SEQ ID NO: 129
  misc_feature 1..247: note = chr1:228652206-228652453
  misc_feature 1..247: note = hyper
  source 1..247: mol_type = genomic DNA

SEQ ID NO: 1888 - DNA, 34 bp, Homo sapiens; identical to SEQ ID NO: 130
  misc_feature 1..34: note = chr1:228652508-228652542
  misc_feature 1..34: note = hyper
  source 1..34: mol_type = genomic DNA

SEQ ID NO: 1889 - DNA, 140 bp, Homo sapiens; identical to SEQ ID NO: 131
  misc_feature 1..140: note = chr1:229542813-229542953
  misc_feature 1..140: note = hyper
  source 1..140: mol_type = genomic DNA

SEQ ID NO: 1890 - DNA, 124 bp, Homo sapiens; identical to SEQ ID NO: 132
  misc_feature 1..124: note = chr1:229543220-229543344
  misc_feature 1..124: note = hyper
  source 1..124: mol_type = genomic DNA

SEQ ID NO: 1891 - DNA, 86 bp, Homo sapiens; identical to SEQ ID NO: 133
  misc_feature 1..86: note = chr1:229567191-229567277
  misc_feature 1..86: note = hyper
  source 1..86: mol_type = genomic DNA

SEQ ID NO: 1892 - DNA, 624 bp, Homo sapiens; identical to SEQ ID NO: 134
  misc_feature 1..624: note = chr1:229567369-229567993
  misc_feature 1..624: note = hyper
  source 1..624: mol_type = genomic DNA

SEQ ID NO: 1893 - DNA, 193 bp, Homo sapiens; identical to SEQ ID NO: 135
  misc_feature 1..193: note = chr1:229568157-229568350
  misc_feature 1..193: note = hyper
  source 1..193: mol_type = genomic DNA

SEQ ID NO: 1894 - DNA, 59 bp, Homo sapiens
  misc_feature 1..59: note = chr1:231297044-231297103
  misc_feature 1..59: note = hyper
  source 1..59: mol_type = genomic DNA
gcggggaagaacagccgagcagaccaaacagccggggccgcgggtgggaggctgttccc

SEQ ID NO: 1895 - DNA, 29 bp, Homo sapiens
  misc_feature 1..29: note = chr1:231297104-231297133
  misc_feature 1..29: note = hyper
  source 1..29: mol_type = genomic DNA
cagctcgtggctggcgttggagaatgtgg

SEQ ID NO: 1896 - skipped

SEQ ID NO: 1897 - DNA, 213 bp, Homo sapiens
  misc_feature 1..213: note = chr1:234041148-234041361
  misc_feature 1..213: note = hyper
  source 1..213: mol_type = genomic DNA
cgctcgcccccggagggccccggccgcgctcttgctctcgccctgggatctgctcctcacgaatcccctcctctctgtccatgctccccctgcccacccacctgcccgtggcgcctgcgaccgcagtggcatgaggaggtcaccggacgtcagcccccggagactgtccgacatcagcccccagctccggcagctcaagtacttggtggtgga

SEQ ID NO: 1898 - DNA, 55 bp, Homo sapiens
  misc_feature 1..55: note = chr1:234041415-234041470
  misc_feature 1..55: note = hyper
  source 1..55: mol_type = genomic DNA
cgggccggtggggctcacgtccatcgaggagcggatcctgcgcatcactggctac

SEQ ID NO: 1899 - DNA, 130 bp, Homo sapiens
  misc_feature 1..130: note = chr1:235813667-235813797
  misc_feature 1..130: note = hyper
  source 1..130: mol_type = genomic DNA
ggaggggtctggggacggggccgcggtcagcgcgggctccccgaagcctcaggtaccgccctcgctcggggtgagctccagcgcctgggccgttggggcgcgggccgcttcccaccctgcaccaagggac

SEQ ID NO: 1900 - DNA, 26 bp, Homo sapiens
  misc_feature 1..26: note = chr1:235814009-235814035
  misc_feature 1..26: note = hyper
  source 1..26: mol_type = genomic DNA
ggttctaggagcgactgctctccagg

SEQ ID NO: 1901 - DNA, 79 bp, Homo sapiens
  misc_feature 1..79: note = chr1:236227842-236227921
  misc_feature 1..79: note = hyper
  source 1..79: mol_type = genomic DNA
ctgacctccctgcggcgatgcagcccacagccgccggggaggaagctccgcggggtccatgggtgccggggtcacggcc

SEQ ID NO: 1902 - DNA, 187 bp, Homo sapiens
  misc_feature 1..187: note = chr1:236228021-236228208
  misc_feature 1..187: note = hyper
  source 1..187: mol_type = genomic DNA
cgccgtgcccggtgccccggcggccagcgggtccgggtccccgcctgctacgcccaagtccgtccggctccacgggcgcccccggcccgccgcgccctgcagcccctcgcccgccctcccggggctcactcacgtagactgcgtcgatgtcggatctgtcgtagaagcggagcgccccactcagctc

SEQ ID NO: 1903 - DNA, 18 bp, Homo sapiens
  misc_feature 1..18: note = chr1:236228606-236228624
  misc_feature 1..18: note = hyper
  source 1..18: mol_type = genomic DNA
acctcccgccttgggcgc

SEQ ID NO: 1904 - DNA, 50 bp, Homo sapiens
  misc_feature 1..50: note = chr1:236228705-236228755
  misc_feature 1..50: note = hyper
  source 1..50: mol_type = genomic DNA
cgtggtcctctgattagggttgggtcgtggagagccggcgacgtggaaac

SEQ ID NO: 1905 - DNA, 49 bp, Homo sapiens; identical to SEQ ID NO: 136
  misc_feature 1..49: note = chr1:236849457-236849506
  misc_feature 1..49: note = hyper
  source 1..49: mol_type = genomic DNA

SEQ ID NO: 1906 - DNA, 224 bp, Homo sapiens; identical to SEQ ID NO: 137
  misc_feature 1..224: note = chr1:237206511-237206735
  misc_feature 1..224: note = hyper
  source 1..224: mol_type = genomic DNA

SEQ ID NO: 1907 - DNA, 626 bp, Homo sapiens; identical to SEQ ID NO: 138
  misc_feature 1..626: note = chr1:240254860-240255486
  misc_feature 1..626: note = hyper
  source 1..626: mol_type = genomic DNA

SEQ ID NO: 1908 - DNA, 672 bp, Homo sapiens; identical to SEQ ID NO: 139
  misc_feature 1..672: note = chr1:240255487-240256159
  misc_feature 1..672: note = hyper
  source 1..672: mol_type = genomic DNA

SEQ ID NO: 1909 - DNA, 117 bp, Homo sapiens
  misc_feature 1..117: note = chr1:240256663-240256780
  misc_feature 1..117: note = hyper
  source 1..117: mol_type = genomic DNA
atcaagaccaccacccggcagctcagctcgcccaatcactccccgtctcagtcccctaatcagagccccaggatcaagaggcggccggaaccctccctgagccgagggtccagaact

SEQ ID NO: 1910 - DNA, 63 bp, Homo sapiens
  misc_feature 1..63: note = chr1:241587546-241587609
  misc_feature 1..63: note = hyper
  source 1..63: mol_type = genomic DNA
tgccgcacttgcacacggagtgtggggggccaggcctgggaccaggagctggggccgggcttc

SEQ ID NO: 1911 - DNA, 268 bp, Homo sapiens
  misc_feature 1..268: note = chr1:241587610-241587878
  misc_feature 1..268: note = hyper
  source 1..268: mol_type = genomic DNA
gcgcagaggcaggaagaggaagcggcacccgcttcggggacccagccggcggccaggccaccgcgcccacccggccgatggcaccgtgttcctgcgcctcgggagggaggaggctctgcgcgggactgcaggttctgccccgcatcggagtgatcgctgagcctgacgctctcgaaggctgggcctggggcccgcaatctactccggaggctttcccactgggcagggtcgctagcagggtgagagaaagccccgggccatccccgag

SEQ ID NO: 1912 - DNA, 530 bp, Homo sapiens
  misc_feature 1..530: note = chr1:242686734-242687264
  misc_feature 1..530: note = hyper
  source 1..530: mol_type = genomic DNA
gaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctagg

SEQ ID NO: 1913 - DNA, 114 bp, Homo sapiens
  misc_feature 1..114: note = chr1:242687574-242687688
  misc_feature 1..114: note = hyper
  source 1..114: mol_type = genomic DNA
ccatcctgacatgaccgggcggccgccggcgagcagcggactcgggacgggcgcgcggggagccgggcgcggagggcgagcgggaggcccagcgggagccggaggtggagctgg

SEQ ID NO: 1914 - DNA, 150 bp, Homo sapiens
  misc_feature 1..150: note = chr1:242688094-242688244
  misc_feature 1..150: note = hyper
  source 1..150: mol_type = genomic DNA
ggtgcagtgaggagccgccgccgcccctcccgccgcgcccaggcccgggcggccgcgctcccgctccgcacccgcctttcccgagcaggctacacctctccctggcgcatctttactggaaagccggcaggcgaggggagaagtgagcgc

SEQ ID NO: 1915 - DNA, 119 bp, Homo sapiens
  misc_feature 1..119: note = chr1:242688277-242688396
  misc_feature 1..119: note = hyper
  source 1..119: mol_type = genomic DNA
cgcggggatggctccggagggagacactcaggaaaccacctccgcccttcccccatctctatccagcggcgccccctcaccctgcccccggctcgcttgggctgcgccttcccccattc

SEQ ID NO: 1916 - DNA, 116 bp, Homo sapiens; identical to SEQ ID NO: 140
  misc_feature 1..116: note = chr1:248020515-248020631
  misc_feature 1..116: note = hyper
  source 1..116: mol_type = genomic DNA

SEQ ID NO: 1917 - DNA, 341 bp, Homo sapiens; identical to SEQ ID NO: 141
  misc_feature 1..341: note = chr1:248020956-248021297
  misc_feature 1..341: note = hyper
  source 1..341: mol_type = genomic DNA

SEQ ID NO: 1918 - DNA, 127 bp, Homo sapiens
  misc_feature 1..127: note = chr2:288404-288531
  misc_feature 1..127: note = hyper
  source 1..127: mol_type = genomic DNA
gcccacggaggaggccgggtgcggaccctcgcgctggccccggccgcgccacgtgctggaagcccctccacctcccggccatggcgccctcccgcacctgcccggcgccacccgggagccacctgcg

SEQ ID NO: 1919 - DNA, 249 bp, Homo sapiens; identical to SEQ ID NO: 142
  misc_feature 1..249: note = chr2:468423-468672
  misc_feature 1..249: note = hyper
  source 1..249: mol_type = genomic DNA

SEQ ID NO: 1920 - DNA, 165 bp, Homo sapiens
  misc_feature 1..165: note = chr2:945845-946010
  misc_feature 1..165: note = hyper
  source 1..165: mol_type = genomic DNA
cccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggcc

SEQ ID NO: 1921 - DNA, 207 bp, Homo sapiens
  misc_feature 1..207: note = chr2:946011-946218
  misc_feature 1..207: note = hyper
  source 1..207: mol_type = genomic DNA
gctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgcca

SEQ ID NO: 1922 - DNA, 115 bp, Homo sapiens
  misc_feature 1..115: note = chr2:946289-946404
  misc_feature 1..115: note = hyper
  source 1..115: mol_type = genomic DNA
ggcccctgccccgccagccccgctatggtcccccatccacccccgcgggagcgcccctgtccccccatcctgcacttcccccagagtcgcgcgccagtttcccgccccgtggaag

SEQ ID NO: 1923 - DNA, 466 bp, Homo sapiens
  misc_feature 1..466: note = chr2:1746567-1747033
  misc_feature 1..466: note = hyper
  source 1..466: mol_type = genomic DNA
aggaggagaggaactcgggcccccgccccgccccagggcctccaggaagcagcctgcaaactcggcgacccctgggagccgtggtctgtcccagcactttgtttcggaggtaggcgcactggccgcccacttcctgaattgttcactcaatttttttacaacttttgcagactctttgctggtgccaaaaagtcctctggctcagctaagaaacgtgaaaactatttttggcatgcagaaaagtcgctacaggactaaattagagtcggcgcctgaaacgcagcccgcgttcacagatcccgaaaatgttgaatccgactcgcttcagaacacaggaggcctgcagcgaactctggcggcatctcggtacctggagccgcggggcggagggatggggattcctgctgtggagaccgtgacgcgggacggcccgcaggacagggtgtcaaccccaacgcaacgcatc

SEQ ID NO: 1924 - DNA, 259 bp, Homo sapiens
  misc_feature 1..259: note = chr2:5831789-5832048
  misc_feature 1..259: note = hyper
  source 1..259: mol_type = genomic DNA
ggggagggagctcaccgcctctcgagctttaaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagc

SEQ ID NO: 1925 - DNA, 116 bp, Homo sapiens
  misc_feature 1..116: note = chr2:5832731-5832847
  misc_feature 1..116: note = hyper
  source 1..116: mol_type = genomic DNA
gcgaaagcggggtgccgaggactttgcaacttgcccaggaaggtggaggggtgggagggggagggggacctccgcacgagacccagcggcccgggttggagcgtccagccctgcag

SEQ ID NO: 1926 - DNA, 151 bp, Homo sapiens
  misc_feature 1..151: note = chr2:5833282-5833433
  misc_feature 1..151: note = hyper
  source 1..151: mol_type = genomic DNA
ggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcg

SEQ ID NO: 1927 - DNA, 141 bp, Homo sapiens
  misc_feature 1..141: note = chr2:5833499-5833640
  misc_feature 1..141: note = hyper
  source 1..141: mol_type = genomic DNA
cggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagc

SEQ ID NO: 1928 - DNA, 75 bp, Homo sapiens
  misc_feature 1..75: note = chr2:5833953-5834028
  misc_feature 1..75: note = hyper
  source 1..75: mol_type = genomic DNA
gaatttctctcaaagcgcgcacagcgccagcgagcagcagctggggggcggcgcggcggccgggaacctgtccct

SEQ ID NO: 1929 - DNA, 87 bp, Homo sapiens
  misc_feature 1..87: note = chr2:5836085-5836172
  misc_feature 1..87: note = hyper
  source 1..87: mol_type = genomic DNA
ggctcgggagctggccggggaggggcggatggaggggcctgggttgccagctcccttggtcggggtcctgctcgctggggcttgtgt

SEQ ID NO: 1930 - DNA, 104 bp, Homo sapiens
  misc_feature 1..104: note = chr2:5866074-5866178
  misc_feature 1..104: note = hyper
  source 1..104: mol_type = genomic DNA
ctgggggcagcagagcgacgtgccagcgtccgtgttgggcgggtgtcggggggacccggacaccccgccctccttcctgcagagctctgcgggccctgtggcat

SEQ ID NO: 1931 - DNA, 133 bp, Homo sapiens
  misc_feature 1..133: note = chr2:20865714-20865847
  misc_feature 1..133: note = hyper
  source 1..133: mol_type = genomic DNA
taaaggaaaaggacccgcctgcccttcttcggcagttcgtttggcccaggccttcgatcagctgaaagtttccgatctagggggatgtccaggctgccggcggagcagagccgataacccccctctcctgcgc

SEQ ID NO: 1932 - DNA, 232 bp, Homo sapiens
  misc_feature 1..232: note = chr2:20865848-20866080
  misc_feature 1..232: note = hyper
  source 1..232: mol_type = genomic DNA
ttcccctgagacttggcctccgcaacctgtcccagccgcggagcaaactgctctgcggcccgcgcgagtgcgccccagggcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttc

SEQ ID NO: 1933 - DNA, 676 bp, Homo sapiens
  misc_feature 1..676: note = chr2:25391058-25391734
  misc_feature 1..676: note = hyper
  source 1..676: mol_type = genomic DNA
tcctagcaagctctcggagcctccggaccgccgcgagcccctgggggagaggaggccgccggctccctggagacagcgcctgcagcttcgcggccgtccgcccaggggccggacgtgggccctccagctcagctactggcggcttctcatgccgcagtcggcgcagaaagtttgtcgagaactcgggaccgcggagagccagaggcgcccaggtccgccttcggagccggagccggccgactgcatcgcgaggacggggacaggggatcccggggaaagagcacgggtcccccacgctgcgcccttacctgtctcgggaggctgctctctgagggcggggacgctcggcggcctctctcggtcgcggctcttcttcccctccttcgccgccgcttggtcccgcgctcctctgtccttatatacttgccgagctctcctggtgggcgcgggactttgaccttcccggcagcacaaggagcagctccccgggccaggggaaggggggccgcggggcgtgggaggggggcttccagacgggggacgagcgcggggagacgcgctggaaaggggctggaattagcactgtcctgccgaaggcgcacctggccgctcgccctcaggaagaacttaattatggatggcgttgggtctccgcttagaacgggcgggaggctta

SEQ ID NO: 1934 - DNA, 37 bp, Homo sapiens; identical to SEQ ID NO: 143
  misc_feature 1..37: note = chr2:25438835-25438872
  misc_feature 1..37: note = hyper
  source 1..37: mol_type = genomic DNA

SEQ ID NO: 1935 - DNA, 222 bp, Homo sapiens; identical to SEQ ID NO: 144
  misc_feature 1..222: note = chr2:25439138-25439360
  misc_feature 1..222: note = hyper
  source 1..222: mol_type = genomic DNA

SEQ ID NO: 1936 - DNA, 179 bp, Homo sapiens; identical to SEQ ID NO: 145
  misc_feature 1..179: note = chr2:26407743-26407922
  misc_feature 1..179: note = hyper
  source 1..179: mol_type = genomic DNA

SEQ ID NO: 1937 - DNA, 103 bp, Homo sapiens
  misc_feature 1..103: note = chr2:26522016-26522119
  misc_feature 1..103: note = hyper
  source 1..103: mol_type = genomic DNA
aaaccagacctagaacgttgtatacggctgataggaccaggtccaccgctgcagcaggctgtgagaggggaaggcacgttcctggctaagcagcgtccaaaac

SEQ ID NO: 1938 - DNA, 806 bp, Homo sapiens
  misc_feature 1..806: note = chr2:27070324-27071130
  misc_feature 1..806: note = hyper
  source 1..806: mol_type = genomic DNA
tctcagtggagagaacgcactccgggttcgagacctccccgggtgcagatgcgaactgcggtggccccaagtggccgtccactttgttcatgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtga

SEQ ID NO: 1939 - DNA, 170 bp, Homo sapiens
  misc_feature 1..170: note = chr2:29033528-29033698
  misc_feature 1..170: note = hyper
  source 1..170: mol_type = genomic DNA
cggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagag

SEQ ID NO: 1940 - DNA, 590 bp, Homo sapiens
  misc_feature 1..590: note = chr2:29338158-29338748
  misc_feature 1..590: note = hyper
  source 1..590: mol_type = genomic DNA
cgacaccccgcagacgctgtcagccggggtcgcggccccgcgtgcgcccgatcatctgactgctggggagtgcgggggcgcgggagccaggcgagccagcgcaggcgcgcgctgcctcctccgtccccaccgagtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtgggccgggggcgcgcggggcccccccgggccgcgggctggccggcggcggggttggggccggggtgggcggccctgggggcccgcggggaggtcagtggccccgggagggtcgcgcagaggcgctgggggctgtggaagccccgcggccgcctcccgtgggcaccggtgtcgctggccgcggggaggccttctcggggcggagcggcccacccgg

SEQ ID NO: 1941 - DNA, 281 bp, Homo sapiens
  misc_feature 1..281: note = chr2:29338809-29339090
  misc_feature 1..281: note = hyper
  source 1..281: mol_type = genomic DNA
cggggtgtgcgggacccggcggcggagctgggctctgggccacgaccgccagccgcggctgccccgagagtccccgcacgcgcagtggctttccaacgcggcctcttcccatttctcacttgactccccttgcgcattaaattgtcgagaaacctttggccagtgggtcttcaaagctaaaccaaatggctgtccttgcagtccttggctacctgagatcccttaattctgaaccatccgcacctgggaggggaagttgaaaggagcgctggagctgagcc

SEQ ID NO: 1942 - DNA, 279 bp, Homo sapiens; identical to SEQ ID NO: 146
  misc_feature 1..279: note = chr2:30453784-30454063
  misc_feature 1..279: note = hyper
  source 1..279: mol_type = genomic DNA

SEQ ID NO: 1943 - DNA, 158 bp, Homo sapiens; identical to SEQ ID NO: 147
  misc_feature 1..158: note = chr2:38302718-38302876
  misc_feature 1..158: note = hyper
  source 1..158: mol_type = genomic DNA

SEQ ID NO: 1944 - DNA, 38 bp, Homo sapiens; identical to SEQ ID NO: 148
  misc_feature 1..38: note = chr2:39187200-39187238
  misc_feature 1..38: note = hyper
  source 1..38: mol_type = genomic DNA

SEQ ID NO: 1945 - DNA, 63 bp, Homo sapiens; identical to SEQ ID NO: 149
  misc_feature 1..63: note = chr2:39187544-39187607
  misc_feature 1..63: note = hyper
  source 1..63: mol_type = genomic DNA

SEQ ID NO: 1946 - DNA, 392 bp, Homo sapiens; identical to SEQ ID NO: 150
  misc_feature 1..392: note = chr2:40678497-40678889
  misc_feature 1..392: note = hyper
  source 1..392: mol_type = genomic DNA

SEQ ID NO: 1947 - DNA, 137 bp, Homo sapiens; identical to SEQ ID NO: 151
  misc_feature 1..137: note = chr2:40678949-40679086
  misc_feature 1..137: note = hyper
  source 1..137: mol_type = genomic DNA

SEQ ID NO: 1948 - DNA, 432 bp, Homo sapiens; identical to SEQ ID NO: 152
  misc_feature 1..432: note = chr2:40679087-40679519
  misc_feature 1..432: note = hyper
  source 1..432: mol_type = genomic DNA

SEQ ID NO: 1949 - DNA, 85 bp, Homo sapiens; identical to SEQ ID NO: 153
  misc_feature 1..85: note = chr2:40679520-40679605
  misc_feature 1..85: note = hyper
  source 1..85: mol_type = genomic DNA

SEQ ID NO: 1950 - DNA, 177 bp, Homo sapiens
  misc_feature 1..177: note = chr2:42720270-42720447
  misc_feature 1..177: note = hyper
  source 1..177: mol_type = genomic DNA
taggtgtcggacatgcggtcgtcgaggcggcgctggcagcagtactcgaggtgcgcgccctccaggccccagtagatcatctcgttgtagaaggagagctcgcacatccgcggcgcgaagcgcagcttgccgtggccgcgcacgtagagcaggatgaagccgaaggcctccgagtgc

SEQ ID NO: 1951 - DNA, 119 bp, Homo sapiens; identical to SEQ ID NO: 154
  misc_feature 1..119: note = chr2:45028940-45029059
  misc_feature 1..119: note = hyper
  source 1..119: mol_type = genomic DNA

SEQ ID NO: 1952 - DNA, 184 bp, Homo sapiens; identical to SEQ ID NO: 155
  misc_feature 1..184: note = chr2:45029183-45029367
  misc_feature 1..184: note = hyper
  source 1..184: mol_type = genomic DNA

SEQ ID NO: 1953 - DNA, 86 bp, Homo sapiens; identical to SEQ ID NO: 156
  misc_feature 1..86: note = chr2:45155125-45155211
  misc_feature 1..86: note = hyper
  source 1..86: mol_type = genomic DNA

SEQ ID NO: 1954 - DNA, 636 bp, Homo sapiens; identical to SEQ ID NO: 157
  misc_feature 1..636: note = chr2:45155355-45155991
  misc_feature 1..636: note = hyper
  source 1..636: mol_type = genomic DNA

SEQ ID NO: 1955 - DNA, 820 bp, Homo sapiens; identical to SEQ ID NO: 158
  misc_feature 1..820: note = chr2:45155992-45156812
  misc_feature 1..820: note = hyper
  source 1..820: mol_type = genomic DNA

SEQ ID NO: 1956 - DNA, 89 bp, Homo sapiens; identical to SEQ ID NO: 159
  misc_feature 1..89: note = chr2:45156832-45156921
  misc_feature 1..89: note = hyper
  source 1..89: mol_type = genomic DNA

SEQ ID NO: 1957 - DNA, 96 bp, Homo sapiens; identical to SEQ ID NO: 160
  misc_feature 1..96: note = chr2:45157254-45157350
  misc_feature 1..96: note = hyper
  source 1..96: mol_type = genomic DNA

SEQ ID NO: 1958 - DNA, 38 bp, Homo sapiens
  misc_feature 1..38: note = chr2:45160596-45160634
  misc_feature 1..38: note = hyper
  source 1..38: mol_type = genomic DNA
tttgaaaagggagaacgtcagtccgatggtcggtggtt

SEQ ID NO: 1959 - DNA, 240 bp, Homo sapiens; identical to SEQ ID NO: 161
  misc_feature 1..240: note = chr2:45171324-45171564
  misc_feature 1..240: note = hyper
  source 1..240: mol_type = genomic DNA

SEQ ID NO: 1960 - DNA, 43 bp, Homo sapiens; identical to SEQ ID NO: 162
  misc_feature 1..43: note = chr2:45171836-45171879
  misc_feature 1..43: note = hyper
  source 1..43: mol_type = genomic DNA

SEQ ID NO: 1961 - DNA, 152 bp, Homo sapiens
  misc_feature 1..152: note = chr2:45181520-45181672
  misc_feature 1..152: note = hyper
  source 1..152: mol_type = genomic DNA
aggactgagctaagacgccagaatgggttaaaggcatttccaaggaggaatggtgaggacttgatgaccagctgcagaccttataggctgccctccgaccttcagcttcctgtgcgctcacaattcacgtgctcacacgtgctccttagagg

SEQ ID NO: 1962 - DNA, 15 bp, Homo sapiens
  misc_feature 1..15: note = chr2:45240616-45240631
  misc_feature 1..15: note = hyper
  source 1..15: mol_type = genomic DNA
cggtctgtcgggtcc

SEQ ID NO: 1963 - DNA, 406 bp, Homo sapiens
  misc_feature 1..406: note = chr2:45240763-45241169
  misc_feature 1..406: note = hyper
  source 1..406: mol_type = genomic DNA
cgagcccgggcaaggttgagaggcgctgggctccgggcggtcgcactcttggaaccgcgcgaaccgcggcgtcgcccgcgccgcacgtggctggggcagtcacaggccccgagagctggagcaacggggtcaccgccacccctctgccctccaggccttcaccttgagacccacgcggcagcctggagggcccacaagagcaaacggtttagaggccgcgggctcacgagggatcttgttcaaacgaaaagaacgagcacaggggctcggggccagcctggaggccggcacagaggcgagtcggcccgggtggcgccgggaccaggcgggatttggggcgggtatccgggcccgggcgctggcagcctccctgcgacccccggccctgcgtccccgcccgcggtcc

SEQ ID NO: 1964 - DNA, 215 bp, Homo sapiens
  misc_feature 1..215: note = chr2:45241232-45241447
  misc_feature 1..215: note = hyper
  source 1..215: mol_type = genomic DNA
cgggcagggccacggggcgaggggacgggctcgcggctttgggttcagggagccgcggagctccaccgccgggttgttttgcaatggggctttggagaggttgcgcgtcccgggccccatggctccgccgggtctgcacgccagcgcccccacgcggcgggcccagagttcaggccggcggggctgcgcgctcggctccccgcaggcctgtagcc

SEQ ID NO: 1965 - DNA, 723 bp, Homo sapiens
  misc_feature 1..723: note = chr2:47796765-47797488
  misc_feature 1..723: note = hyper
  source 1..723: mol_type = genomic DNA
cggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggcacagagaggaaagatgcgcgggggacgcgccgctcacctatggttgacaccacggtgcccacgaagtagaaggcgccggggaagtcccagcgcgggcgcagcgcgtcggcgcggacgccggcggccagcgcggcctcgtagtgccggaggaaggcgcgcagctctggctcggccacgccgtgcgcagcgctgaagttgcgcagcgtggcgccccagcgcgcccgcgcctccgcctcgccggggctctcgagcgccgagaagactgtggcacccgccaccaggtagaggccgatgagcgccgccagcagcacgaagcggccggtgtcctcgttgaggtgcgaacggcggcagcagcagcagcagcaggaggggcgcggcaggcggcggcggctacggcggggcgggggccgggggctgcgggaggacatggtccggagctcagcccc

SEQ ID NO: 1966 - DNA, 474 bp, Homo sapiens
  misc_feature 1..474: note = chr2:47797489-47797963
  misc_feature 1..474: note = hyper
  source 1..474: mol_type = genomic DNA
gggccggggcggcgctcggggcccgggccacgacatccccccggcgggagcaggagcgtgaggatggtggccaggggtccggggccgccgcggagcccctcgccgccttcgcagagcccctcgtcgccttcccagagcccggacagaggggcgcctccgcctcctccccggcgctcaggccacacgcgagtcccgtggcccagcgggtgcccgggcaggggcgctcctctgcgcgccccgacgcctcgccggctcccgcggctccttacccgccgctctcgggcgcggggctccgcagctaggcccctgccgcccggtggccggcgtccgcggggccccgggcctcatactcctctccagacaggccgcgggctgcgggcggggtgggccgtggatcccgggcgcctaggaccgggacgcggcagcaaggcgtggagagagcccccgggggcgtcccatgaggcgttcgggatc

SEQ ID NO: 1967 - DNA, 1069 bp, Homo sapiens
  misc_feature 1..1069: note = chr2:47797964-47799033
  misc_feature 1..1069: note = hyper
  source 1..1069: mol_type = genomic DNA
gcgcctcctaggtgcgggctgtgcgggcagtcctgctcccgcccccggggctgagctggcggcgtcggcttcagagcctcggagccgagccgagtccggggaagcgctcctttctcagctccagccgaagagccgcccggcagggagaggcggagtcactggcgcccggggcggggtgttggggaggggtgagtagggacaggagggagggggtggagagttgggctgctgcgacgcctcccggtggctctggcggcaccaatgcggggcaccggagcaggtgtccgactgcggtgcgggctaccactccgccggggaacctcgtcttgctcctccctgcgcttcgcctctggaatctctcccttatctcatgccgcggtgaaactttgctcaagttggtggtgctctgaggtctccagggctggaggccgcgcgacgcgaatcgccgacactggattctcgggcgttagtccgaagtttaagttcccttcgttcactcctttgccctggatcgaaccgcagccccaggacgcagcgggttccactggaaacggggaatcggggagaggcggtcgctgggctccgggcgacctgggaacgagggcgtttgctccccctcccgaccgagcgggcggccggcgtcagcaccgcggacagcgcatcggtgccgcagccgcgggcgggcgccgctagggctgccaggggtccgaggcgcgggcaaggctgctcaccccgctgtgctgtgcaccccaaaccttccctgttttcctttctacctcccgtgtgcacccccctacccgccacccgaggcaggtgcggtcgctgaagcaggctgctgacagggcggggacgctgcggaatagagacgggggaggagtcaagcgcgggtagggggccaaggtgccacagggagaaagagcccaggcccggcggactgccgggctcctcgcgccaccccagctcaccgacccctctagcccggggcggggaataacaccctgggtgcggtagagagtagaggaatagaggaggtgtaggggaagctcactggcagctcccctgaggccgg

SEQ ID NO: 1968 - DNA, 56 bp, Homo sapiens
  misc_feature 1..56: note = chr2:47799123-47799179
  misc_feature 1..56: note = hyper
  source 1..56: mol_type = genomic DNA
cggctgcgggtgctcctctgctggacacaagccggctttgccggggccacaaaagt

SEQ ID NO: 1969 - DNA, 132 bp, Homo sapiens
  misc_feature 1..132: note = chr2:50573507-50573639
  misc_feature 1..132: note = hyper
  source 1..132: mol_type = genomic DNA
ccttctggcaactgacgcccccttcccgcggggcccagccgcgcgaccagggctggtcctttagtaggtgtccacatctctctcccagtacctcgacaaggaacgcccctcccacccctcaccaccaacacc

SEQ ID NO: 1970 - DNA, 87 bp, Homo sapiens
  misc_feature 1..87: note = chr2:50573691-50573778
  misc_feature 1..87: note = hyper
  source 1..87: mol_type = genomic DNA
cgcaccaagcacacccaaatgcacctcccttttgtcgagctcccatttctctgagccttaggagcccaggagcgagtgcagggtaga

SEQ ID NO: 1971 - DNA, 95 bp, Homo sapiens
  misc_feature 1..95: note = chr2:50574218-50574313
  misc_feature 1..95: note = hyper
  source 1..95: mol_type = genomic DNA
atcctctccctccttcggacagtcttctcggggtcctggagtccgccgtgcctagcaccccaaacaatccgaaacatagccgaggcgaatgcagc

SEQ ID NO: 1972 - DNA, 54 bp, Homo sapiens; identical to SEQ ID NO: 163
  misc_feature 1..54: note = chr2:50574631-50574685
  misc_feature 1..54: note = hyper
  source 1..54: mol_type = genomic DNA

SEQ ID NO: 1973 - DNA, 121 bp, Homo sapiens; identical to SEQ ID NO: 164
  misc_feature 1..121: note = chr2:50574738-50574859
  misc_feature 1..121: note = hyper
  source 1..121: mol_type = genomic DNA

SEQ ID NO: 1974 - DNA, 147 bp, Homo sapiens; identical to SEQ ID NO: 165
  misc_feature 1..147: note = chr2:63275877-63276024
  misc_feature 1..147: note = hyper
  source 1..147: mol_type = genomic DNA

SEQ ID NO: 1975 - DNA, 699 bp, Homo sapiens; identical to SEQ ID NO: 166
  misc_feature 1..699: note = chr2:63280952-63281651
  misc_feature 1..699: note = hyper
  source 1..699: mol_type = genomic DNA

SEQ ID NO: 1976 - DNA, 493 bp, Homo sapiens; identical to SEQ ID NO: 167
  misc_feature 1..493: note = chr2:63285117-63285610
  misc_feature 1..493: note = hyper
  source 1..493: mol_type = genomic DNA

SEQ ID NO: 1977 - DNA, 227 bp, Homo sapiens; identical to SEQ ID NO: 168
  misc_feature 1..227: note = chr2:63286358-63286585
  misc_feature 1..227: note = hyper
  source 1..227: mol_type = genomic DNA

SEQ ID NO: 1978 - DNA, 55 bp, Homo sapiens; identical to SEQ ID NO: 169
  misc_feature 1..55: note = chr2:63286693-63286748
  misc_feature 1..55: note = hyper
  source 1..55: mol_type = genomic DNA

SEQ ID NO: 1979 - DNA, 236 bp, Homo sapiens; identical to SEQ ID NO: 170
  misc_feature 1..236: note = chr2:63287082-63287318
  misc_feature 1..236: note = hyper
  source 1..236: mol_type = genomic DNA

SEQ ID NO: 1980 - DNA, 58 bp, Homo sapiens; identical to SEQ ID NO: 171
  misc_feature 1..58: note = chr2:66808576-66808634
  misc_feature 1..58: note = hyper
  source 1..58: mol_type = genomic DNA

SEQ ID NO: 1981 - DNA, 665 bp, Homo sapiens; identical to SEQ ID NO: 172
  misc_feature 1..665: note = chr2:66808726-66809391
  misc_feature 1..665: note = hyper
  source 1..665: mol_type = genomic DNA

SEQ ID NO: 1982 - DNA, 268 bp, Homo sapiens; identical to SEQ ID NO: 173
  misc_feature 1..268: note = chr2:68546249-68546517
  misc_feature 1..268: note = hyper
  source 1..268: mol_type = genomic DNA

SEQ ID NO: 1983 - DNA, 361 bp, Homo sapiens; identical to SEQ ID NO: 174
  misc_feature 1..361: note = chr2:68546552-68546913
  misc_feature 1..361: note = hyper
  source 1..361: mol_type = genomic DNA

SEQ ID NO: 1984 - DNA, 856 bp, Homo sapiens
  misc_feature 1..856: note = chr2:71503452-71504308
  misc_feature 1..856: note = hyper
  source 1..856: mol_type = genomic DNA
ggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcggtgagctctgcctttgccctatatgccgcgctctcgcccgtgctctggggcagttggcagtgggtgggcaggaaggggcgggccggcagggcgtcgcacgttggcgtccccgcgtcgcgggaatggggttcggattccccccgtgaatgtcattccccaggctaccggtctttagcgctaagttgcatgggctggtgtgccagtcggtcagcgaatagcggcagaacgcctggccgggccggcgttttccgggacactcgtttcggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtc

SEQ ID NO: 1985 - DNA, 139 bp, Homo sapiens; identical to SEQ ID NO: 175
  misc_feature 1..139: note = chr2:73147389-73147528
  misc_feature 1..139: note = hyper
  source 1..139: mol_type = genomic DNA

SEQ ID NO: 1986 - DNA, 101 bp, Homo sapiens; identical to SEQ ID NO: 176
  misc_feature 1..101: note = chr2:73147966-73148067
  misc_feature 1..101: note = hyper
  source 1..101: mol_type = genomic DNA

SEQ ID NO: 1987 - DNA, 19 bp, Homo sapiens
  misc_feature 1..19: note = chr2:73148174-73148193
  misc_feature 1..19: note = hyper
  source 1..19: mol_type = genomic DNA
cgtccggccctgagcccct

SEQ ID NO: 1988 - DNA, 616 bp, Homo sapiens
  misc_feature 1..616: note = chr2:73151215-73151831
  misc_feature 1..616: note = hyper
  source 1..616: mol_type = genomic DNA
agtggctctcgagtgcggggaggtgttgcggaggggagtggacttagggaaggggcggcaaaagggcaaagggagaaatggcgtgtgtgtgcgtgtcaaggaatggagagggcagggcgcttgggagcagggcgcgaggccaggctctgttgggccccggctcacggcgccccttctctctgtctgtacctgcgtgtgttgccgtcggcggcggggccgcagccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtaatcacccccggtcgcggcctgccctgcgcccggagcccgggtggaggtgagggtgcgcgggtgcaggagaggccctgagcccgccccagcccagccctgctgggttccaaaaggcccccattccccgcggcgctgcggtcaagcccgtctttagagcctcttcctcgagactgcgtgcagcctgctgagcccgcaggacttttgtc

SEQ ID NO: 1989 - DNA, 271 bp, Homo sapiens; identical to SEQ ID NO: 178
  misc_feature 1..271: note = chr2:73430485-73430756
  misc_feature 1..271: note = hyper
  source 1..271: mol_type = genomic DNA

SEQ ID NO: 1990 - DNA, 731 bp, Homo sapiens; identical to SEQ ID NO: 179
  misc_feature 1..731: note = chr2:73518261-73518992
  misc_feature 1..731: note = hyper
  source 1..731: mol_type = genomic DNA

SEQ ID NO: 1991 - DNA, 252 bp, Homo sapiens
  misc_feature 1..252: note = chr2:73519523-73519775
  misc_feature 1..252: note = hyper
  source 1..252: mol_type = genomic DNA
ctcatacaggcactgcgagggggcacccgcgcaaggcgaggcctcccagaacgcctctgggaaaggggcagcgcccagatccggggagtaaaggtccggcggacccggcagcaaggcatcggaccccgcaggaaaaggggcatccagcggggatctggacgctgctgcctctggaccggggaagggtgccaggcctaagatgcccgacatgaggttgaagagtgcctccgggtcgtgcgggtgttcgggcac

SEQ ID NO: 1992 - DNA, 257 bp, Homo sapiens
  misc_feature 1..257: note = chr2:74740879-74741136
  misc_feature 1..257: note = hyper
  source 1..257: mol_type = genomic DNA
ccagccccaagaacccgccggcctgatttggcccgggttgagccatggtccgttttacacggattttggaaaatcgaaattctaggaaacacaggacaccaattaccggtgcgcatgaacagggctggggggacctacaggagaggccagaaggcgcaccacgatcgccagcccaaagcggccgttccccgcccttagcccctgccgtccccttcccacacctgttctcttcctgggcctgcagctcaccgggcgcc

SEQ ID NO: 1993 - DNA, 339 bp, Homo sapiens
  misc_feature 1..339: note = chr2:74741137-74741476
  misc_feature 1..339: note = hyper
  source 1..339: mol_type = genomic DNA
ttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcggtgagcatctccgctgactcagcggcccatgctcgggcccctcccgcgctgagcctggctcctaacaccctggccccctgtccccctccccgcacatctccgccagccagccttc

SEQ ID NO: 1994 - DNA, 70 bp, Homo sapiens
  misc_feature 1..70: note = chr2:74741775-74741845
  misc_feature 1..70: note = hyper
  source 1..70: mol_type = genomic DNA
gggatgctgctgtttcggggaccccggcgccctgccttggccagccccgcgggcccctgaggccactctc

SEQ ID NO: 1995 - DNA, 83 bp, Homo sapiens
  misc_feature 1..83: note = chr2:74741872-74741955
  misc_feature 1..83: note = hyper
  source 1..83: mol_type = genomic DNA
cgctgcctgaggcatcctccccaaccaccgaacctccggcggttctcctcggcccagaccgatggagccggggatgctgggtc

SEQ ID NO: 1996 - DNA, 324 bp, Homo sapiens; identical to SEQ ID NO: 180
  misc_feature 1..324: note = chr2:74742324-74742648
  misc_feature 1..324: note = hyper
  source 1..324: mol_type = genomic DNA

SEQ ID NO: 1997 - DNA, 452 bp, Homo sapiens; identical to SEQ ID NO: 181
  misc_feature 1..452: note = chr2:74742693-74743145
  misc_feature 1..452: note = hyper
  source 1..452: mol_type = genomic DNA

SEQ ID NO: 1998 - skipped

SEQ ID NO: 1999 - DNA, 270 bp, Homo sapiens
  misc_feature 1..270: note = chr2:80529985-80530255
  misc_feature 1..270: note = hyper
  source 1..270: mol_type = genomic DNA
cgcccgcaatcccacaggttcccggccagggtgatgcttgtcagggacttccaagagttgaggatccggggctcgatgtaggtgaggcggttggagtccagctgcagggactgcaggtgcggcacggtctcgaacacatggggctccatgtactcgatctcgttgcccgacaagtccattttctccaggttccaaacccagtccagcgagctgaccacaatggccaccttgttcctccgcaggcagagcgagtgcagggagatgaggcgc

SEQ ID NO: 2000 - DNA, 66 bp, Homo sapiens
  misc_feature 1..66: note = chr2:80530256-80530322
  misc_feature 1..66: note = hyper
  source 1..66: mol_type = genomic DNA
ggaagtgggcgaagttcaccttgaccaagtcgttgtgctcgaggtgcagctcggtgagcttaaaca

SEQ ID NO: 2001 - DNA, 52 bp, Homo sapiens
  misc_feature 1..52: note = chr2:85107454-85107506
  misc_feature 1..52: note = hyper
  source 1..52: mol_type = genomic DNA
tggacacgcaaggctcggacagtggtcactccgcgaacgcactctgtgacct

SEQ ID NO: 2002 - DNA, 187 bp, Homo sapiens
  misc_feature 1..187: note = chr2:87016593-87016780
  misc_feature 1..187: note = hyper
  source 1..187: mol_type = genomic DNA
ccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctg

SEQ ID NO: 2003 - DNA, 451 bp, Homo sapiens
  misc_feature 1..451: note = chr2:87017729-87018180
  misc_feature 1..451: note = hyper
  source 1..451: mol_type = genomic DNA
tcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgt

SEQ ID NO: 2004 - DNA, 139 bp, Homo sapiens
  misc_feature 1..139: note = chr2:88751281-88751420
  misc_feature 1..139: note = hyper
  source 1..139: mol_type = genomic DNA
ccatccgctcccacccgcagcctggacaagaagactcctggcagatcttccagccgcacaccgacccctgcgccggcccttgcgacccgcgtccgccctccccggctgggaagcacctgccagcggccctcacctgggt

SEQ ID NO: 2005 - DNA, 356 bp, Homo sapiens
  misc_feature 1..356: note = chr2:88751460-88751816
  misc_feature 1..356: note = hyper
  source 1..356: mol_type = genomic DNA
cgacaggttgtggcggatggagttctgccagccggccttgctgcgctggtagaaggggaagctatcggcgacgaactggtagatgtggctgagagtgagtttgcgctcgggcgcgctctgaatggccatggcgatgagcgccgaatacgagtagggcggccgcaccatcttcatcaggtcctcgcggctggccatggacagccagcccagctccccgggccccgcgggcgcggcgggcgaggcgggcgcggcgggcgcgggctgcgcgaagggccgctgagagcagccgaagtgccggcggcaggcggtggctgcagaaagggcccggccgcggccccggggggcggcggcggcgg

SEQ ID NO: 2006 - DNA, 498 bp, Homo sapiens
  misc_feature 1..498: note = chr2:88751942-88752440
  misc_feature 1..498: note = hyper
  source 1..498: mol_type = genomic DNA
gtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagc

SEQ ID NO: 2007 - DNA, 69 bp, Homo sapiens; identical to SEQ ID NO: 183
  misc_feature 1..69: note = chr2:88752716-88752785
  misc_feature 1..69: note = hyper
  source 1..69: mol_type = genomic DNA

SEQ ID NO: 2008 - DNA, 171 bp, Homo sapiens; identical to SEQ ID NO: 184
  misc_feature 1..171: note = chr2:89064805-89064976
  misc_feature 1..171: note = hyper
  source 1..171: mol_type = genomic DNA

SEQ ID NO: 2009 - DNA, 350 bp, Homo sapiens; identical to SEQ ID NO: 185
  misc_feature 1..350: note = chr2:89065128-89065478
  misc_feature 1..350: note = hyper
  source 1..350: mol_type = genomic DNA

SEQ ID NO: 2010 - DNA, 474 bp, Homo sapiens
  misc_feature 1..474: note = chr2:95691026-95691500
  misc_feature 1..474: note = hyper
  source 1..474: mol_type = genomic DNA
ggtcgcgcacattaacgcatccagcggaaaaatgaaggagacccaaattcaaagttaaagtaatggtgacccgagaggtgccttgatgagaaggtttggggtcccggttactgatggttatcattcttacgagatgctggtcacctacgaagggagaaaggcacgaggagcgcctgaccaaagtggttttgccctgcttcccgcaagaggtggcacccacggctggaacgcaggagtcagacccacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggc

SEQ ID NO: 2011 - DNA, 218 bp, Homo sapiens
  misc_feature 1..218: note = chr2:95691501-95691719
  misc_feature 1..218: note = hyper
  source 1..218: mol_type = genomic DNA
ctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgct

SEQ ID NO: 2012 - DNA, 418 bp, Homo sapiens
  misc_feature 1..418: note = chr2:96990898-96991316
  misc_feature 1..418: note = hyper
  source 1..418: mol_type = genomic DNA
gagagtgtgtggccacggcccctccactctcccagcaaacccacgggggcctcggtgcggacagagacccggtgtggggaggccgctgcccctgcacgctgggccacgggggtttgggcggggaggagcttgtactgggtgggcggggaggagcccggacggcgggagcggctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacggtgagtaacctgg

SEQ ID NO: 2013 - DNA, 15 bp, Homo sapiens
  misc_feature 1..15: note = chr2:97193049-97193064
  misc_feature 1..15: note = hyper
  source 1..15: mol_type = genomic DNA
cggcagcagagcctg

SEQ ID NO: 2014 - DNA, 386 bp, Homo sapiens; identical to SEQ ID NO: 187
  misc_feature 1..386: note = chr2:97193251-97193637
  misc_feature 1..386: note = hyper
  source 1..386: mol_type = genomic DNA

SEQ ID NO: 2015 - DNA, 71 bp, Homo sapiens; identical to SEQ ID NO: 188
  misc_feature 1..71: note = chr2:98963337-98963408
  misc_feature 1..71: note = hyper
  source 1..71: mol_type = genomic DNA

SEQ ID NO: 2016 - DNA, 417 bp, Homo sapiens; identical to SEQ ID NO: 189
  misc_feature 1..417: note = chr2:98963409-98963826
  misc_feature 1..417: note = hyper
  source 1..417: mol_type = genomic DNA

SEQ ID NO: 2017 - DNA, 325 bp, Homo sapiens; identical to SEQ ID NO: 190
  misc_feature 1..325: note = chr2:98963868-98964193
  misc_feature 1..325: note = hyper
  source 1..325: mol_type = genomic DNA

SEQ ID NO: 2018 - DNA, 139 bp, Homo sapiens; identical to SEQ ID NO: 191
  misc_feature 1..139: note = chr2:99439368-99439507
  misc_feature 1..139: note = hyper
  source 1..139: mol_type = genomic DNA

SEQ ID NO: 2019 - DNA, 178 bp, Homo sapiens; identical to SEQ ID NO: 192
  misc_feature 1..178: note = chr2:105458974-105459152
  misc_feature 1..178: note = hyper
  source 1..178: mol_type = genomic DNA

SEQ ID NO: 2020 - DNA, 361 bp, Homo sapiens; identical to SEQ ID NO: 193
  misc_feature 1..361: note = chr2:105459902-105460263
  misc_feature 1..361: note = hyper
  source 1..361: mol_type = genomic DNA

SEQ ID NO: 2021 - DNA, 247 bp, Homo sapiens; identical to SEQ ID NO: 194
  misc_feature 1..247: note = chr2:105460264-105460511
  misc_feature 1..247: note = hyper
  source 1..247: mol_type = genomic DNA

SEQ ID NO: 2022 - DNA, 113 bp, Homo sapiens
  misc_feature 1..113: note = chr2:105461555-105461668
  misc_feature 1..113: note = hyper
  source 1..113: mol_type = genomic DNA
cgcccgccgttgctcctctgttcccggtccctgtagtgcagtccccacccccaccgtccccagctcggggagggcggggacgcggcggtgcgaggggtcctgccctgctccgc

SEQ ID NO: 2023 - DNA, 84 bp, Homo sapiens
  misc_feature 1..84: note = chr2:105461699-105461783
  misc_feature 1..84: note = hyper
  source 1..84: mol_type = genomic DNA
cgcgcaccgaatcagtgacaaaggcaagcgggcggcgccgagctccaagccggcgctcctacggcttggcgggaaggaggccca

SEQ ID NO: 2024 - DNA, 212 bp, Homo sapiens
  misc_feature 1..212: note = chr2:105469645-105469857
  misc_feature 1..212: note = hyper
  source 1..212: mol_type = genomic DNA
tcacaagggcacgcacgctacttgcacgaatcccagaggagggaggagggaggaagggagggagagcgaaggagggagagagggggtggaggagccagggagcggcggcagcgagcggtccgtctcgcacgcgcgggcaccgcgctggtcctgggctgcaggtttcccagatgatggcatccgagaacttaaacaaagggggctgccgccgg

SEQ ID NO: 2025 - DNA, 681 bp, Homo sapiens
  misc_feature 1..681: note = chr2:105469880-105470561
  misc_feature 1..681: note = hyper
  source 1..681: mol_type = genomic DNA
cggtggcggatttccaaggagcgtggccacgaccagagctcttggcgatgcgagcccccgcttcccacccccgccgatcagagaagggggccggctggtgaagggaagaggaaactttgaaaccactggggacacatctgtctataggtattagcttgaatggtacatccgtgccgcgcgctttacaaatctctggcggggcgggggtaagggggtgagcaacccgacgcgtactaggtggggtgggcaggttgctatttttcatgtttcccccttcgttttccttctgattctcttcccccctctcgtccctccctcccttttatctcccctttcttccccccgcccagacctattgcgaacgcccagagccgccgagggaacgccaacgtctgggccggacactaagagttaagatgtggcggagggggcggcgggggaggggcggggaggggaaagtggtgagggggagggaggctggaggacgacagatttccagcttctacgacgctctgcctaaattaaaaagcaaccaatcggaacggccggaaggggggcctcgcgtcctgagccagtcattccgagcctgccaatcacccagcgggtagccaatcagcgggggccctggtgctcgacttccttgtatttgggaaagtgtggtggtgggtgcgcgctcgcggc

SEQ ID NO: 2026 - DNA, 246 bp, Homo sapiens
  misc_feature 1..246: note = chr2:105470562-105470808
  misc_feature 1..246: note = hyper
  source 1..246: mol_type = genomic DNA
gagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagt

SEQ ID NO: 2027 - DNA, 292 bp, Homo sapiens
  misc_feature 1..292: note = chr2:105478762-105479054
  misc_feature 1..292: note = hyper
  source 1..292: mol_type = genomic DNA
cagtcattctcttggcggcacgatgtgtgcgctagtgtgtgcgcgcgcgtgccgtgtgcatgtgggtgcgcgtgaggggagggggaagcggaaattcgcagtctggaccccgaagccctaggggtacaggcgacggggtcaggtgtaaggcctgcctccggtgaaaaccccggatcagaagaggcggagggggagggggacccgaggcagccgggcgtccaaagctcgcttctctccgggagggagggcagggctgggcgcggaggtggggcggtggcggtcgcggtggggc

SEQ ID NO: 2028 - DNA, 47 bp, Homo sapiens
  misc_feature 1..47: note = chr2:105479055-105479102
  misc_feature 1..47: note = hyper
  source 1..47: mol_type = genomic DNA
gccgggtccctgctcggcccggcacggccgggcggccagactgtggc

SEQ ID NO: 2029 - DNA, 111 bp, Homo sapiens
  misc_feature 1..111: note = chr2:107502619-107502730
  misc_feature 1..111: note = hyper
  source 1..111: mol_type = genomic DNA
cactggagtccaaggcgtgcgtgtcacattttattccccggcagccgctcgggtgcgcgcgctacgcgctcccacactcacgctggcgcccgctagagctgggaccctggc

SEQ ID NO: 2030 - DNA, 43 bp, Homo sapiens
  misc_feature 1..43: note = chr2:107502865-107502908
  misc_feature 1..43: note = hyper
  source 1..43: mol_type = genomic DNA
cggcctgcgggatcacctctccggggccagcgctgctccgcgc

SEQ ID NO: 2031 - DNA, 234 bp, Homo sapiens
  misc_feature 1..234: note = chr2:114256954-114257188
  misc_feature 1..234: note = hyper
  source 1..234: mol_type = genomic DNA
acgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatgg

SEQ ID NO: 2032 - DNA, 184 bp, Homo sapiens
  misc_feature 1..184: note = chr2:114261280-114261464
  misc_feature 1..184: note = hyper
  source 1..184: mol_type = genomic DNA
agcccaggcacccctcgactccccgggactccctgcgggcccgaagccgccttcccgaggcggcggagttgggcagctccgggccccgcgccgccccgcagagccggagtttctctccggagtctggatacagctctccgcttcgtcgccgcgcactggaccccggtagcgtggagcctgcccg

SEQ ID NO: 2033 - DNA, 683 bp, Homo sapiens; identical to SEQ ID NO: 195
  misc_feature 1..683: note = chr2:118981174-118981857
  misc_feature 1..683: note = hyper
  source 1..683: mol_type = genomic DNA

SEQ ID NO: 2034 - DNA, 203 bp, Homo sapiens; identical to SEQ ID NO: 196
  misc_feature 1..203: note = chr2:118981945-118982148
  misc_feature 1..203: note = hyper
  source 1..203: mol_type = genomic DNA

SEQ ID NO: 2035 - DNA, 244 bp, Homo sapiens; identical to SEQ ID NO: 197
  misc_feature 1..244: note = chr2:118982253-118982497
  misc_feature 1..244: note = hyper
  source 1..244: mol_type = genomic DNA

SEQ ID NO: 2036 - DNA, 402 bp, Homo sapiens
  misc_feature 1..402: note = chr2:119067695-119068097
  misc_feature 1..402: note = hyper
  source 1..402: mol_type = genomic DNA
cattaaaatgcaaatcgggcccgctgagaaaacaagtgacacaaaaagtgggcgccgcgcggccgccgcccgcgatggcgccgatggctgatgccgcgattacgccggcgggggcggcccgcgcgccacgaacgtgcccgacaagccgcgccgcttaatttctgaagagatttatattttttttgttgtcaggaaatgaacaaatacttatcaatgtaaaaactgctatctccgatctccccgccgggtttttcatactgatattctttgcaccccgtaacacaggaaatgaaaatcttctccgcctctcacgtcgccgctgcgccttcaaatcctctgcgagcagactggcctccccccaccggccccctcccgggctcccctccccggtaaacagaaaag

SEQ ID NO: 2037 - DNA, 141 bp, Homo sapiens
  misc_feature 1..141: note = chr2:119592997-119593138
  misc_feature 1..141: note = hyper
  source 1..141: mol_type = genomic DNA
gtgactggagagcagcgggggacagcgtggcctcacccaaggtcagcgctggtccccacgtgtcggccgggggaggggaggggagcggacagtcggagcgttcggatgtccagttgagccgcggcgcggggcagccggggg

SEQ ID NO: 2038 - DNA, 81 bp, Homo sapiens
  misc_feature 1..81: note = chr2:119603030-119603111
  misc_feature 1..81: note = hyper
  source 1..81: mol_type = genomic DNA
agaaaaacaggcctacggatgccagaagtctgctggatgtgcgggtgaaaaaaggaaagcgccgcgcggggaggatgcggg

SEQ ID NO: 2039 - DNA, 182 bp, Homo sapiens
  misc_feature 1..182: note = chr2:119607442-119607624
  misc_feature 1..182: note = hyper
  source 1..182: mol_type = genomic DNA
ctgcaggagacgcctcgagaagggctgcggaagataatttataggttttaattactcttcattccgcctgatcagcttggcgttcatcacaggcctgtgaataaaaccctggtcaaaagctctgtcacatcgcgctggcaagacgcttaatcaaagtgagcggccccgcgcgccgcgcggcc

SEQ ID NO: 2040 - skipped

SEQ ID NO: 2041 - DNA, 142 bp, Homo sapiens; identical to SEQ ID NO: 198
  misc_feature 1..142: note = chr2:119616141-119616283
  misc_feature 1..142: note = hyper
  source 1..142: mol_type = genomic DNA

SEQ ID NO: 2042 - skipped

SEQ ID NO: 2043 - DNA, 481 bp, Homo sapiens
  misc_feature 1..481: note = chr2:124782692-124783173
  misc_feature 1..481: note = hyper
  source 1..481: mol_type = genomic DNA
cccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcg

SEQ ID NO: 2044 - DNA, 125 bp, Homo sapiens
  misc_feature 1..125: note = chr2:127783043-127783168
  misc_feature 1..125: note = hyper
  source 1..125: mol_type = genomic DNA
actcccccagcaggacgtttactgaatctggagggagtcgccctgcagatatcccgcggaagccggaggagacccaggtgcgccccaccggctagctgcgcctgcgggtgcccaaattggtgtcc

SEQ ID NO: 2045 - DNA, 412 bp, Homo sapiens
  misc_feature 1..412: note = chr2:127783169-127783581
  misc_feature 1..412: note = hyper
  source 1..412: mol_type = genomic DNA
ggccatcctcaccgcagtgactcctccgcagcgccaacgcactccattttccttccaccctgccggtggggggcgtttgcttgttctcactctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactg

SEQ ID NO: 2046 - DNA, 162 bp, Homo sapiens
  misc_feature 1..162: note = chr2:130737475-130737637
  misc_feature 1..162: note = hyper
  source 1..162: mol_type = genomic DNA
tactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcat

SEQ ID NO: 2047 - DNA, 272 bp, Homo sapiens
  misc_feature 1..272: note = chr2:131720827-131721099
  misc_feature 1..272: note = hyper
  source 1..272: mol_type = genomic DNA
caggagggtcgcaggcgcccggtggtccacgctcaccgtgcgcctggctgagcgcagatgagggtcgtgtcccgtctgagcgcgctccccccgccggcgcgcacgcctgcccgccgggtctctgccctgggccgagcggggccacctgcttgcgtcctcgccctggatggcgtgggaggcgccgccaaccgtctgagctggaatccttgcggtgaaaaagtgggcgcccaccagccctcctcaccaccgcggctgcgacgagcctgggcgtc

SEQ ID NO: 2048 - DNA, 124 bp, Homo sapiens
  misc_feature 1..124: note = chr2:131721461-131721585
  misc_feature 1..124: note = hyper
  source 1..124: mol_type = genomic DNA
ccccatgatgtcagccggcccgcacgcccctcgccctccgactgcgaccccggcccgggctcgcgcgccccgtcccccggcagccccgcggccgccgcaccgccgcccccggcccagccttccc

SEQ ID NO: 2049 - DNA, 83 bp, Homo sapiens
  misc_feature 1..83: note = chr2:131721866-131721949
  misc_feature 1..83: note = hyper
  source 1..83: mol_type = genomic DNA
gggtctgtgctcttgggaccccccgcccccctcctgcctttccttctcctccctcactttctgcctgtcgtttccatctcctg

SEQ ID NO: 2050 - DNA, 295 bp, Homo sapiens
  misc_feature 1..295: note = chr2:131792225-131792520
  misc_feature 1..295: note = hyper
  source 1..295: mol_type = genomic DNA
ccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggagg

SEQ ID NO: 2051 - DNA, 106 bp, Homo sapiens
  misc_feature 1..106: note = chr2:131792531-131792637
  misc_feature 1..106: note = hyper
  source 1..106: mol_type = genomic DNA
cggcgccggcttcgcgggaggagccccaggcccgcgagcgcaggcgccccgcctctccccgggcgctgcgggccaccggctcggccctgtgcggcgggatctcggg

SEQ ID NO: 2052 - DNA, 184 bp, Homo sapiens
  misc_feature 1..184: note = chr2:132152311-132152495
  misc_feature 1..184: note = hyper
  source 1..184: mol_type = genomic DNA
tgctgagccgaagctcggcggggctgagctccagctgggggcgggtagctgacagcctctaggcccgggctccctccagaggcagcgttgcaccctgaccctaacttccgcctgcggcgttcagatgcggaaagcagggagcctgaacccaaagctgcgatcagagaatcgtgtgtgtgaaggg

SEQ ID NO: 2053 - DNA, 325 bp, Homo sapiens; identical to SEQ ID NO: 199
  misc_feature 1..325: note = chr2:132182764-132183089
  misc_feature 1..325: note = hyper
  source 1..325: mol_type = genomic DNA

SEQ ID NO: 2054 - DNA, 371 bp, Homo sapiens; identical to SEQ ID NO: 200
  misc_feature 1..371: note = chr2:139536937-139537308
  misc_feature 1..371: note = hyper
  source 1..371: mol_type = genomic DNA

SEQ ID NO: 2055 - DNA, 200 bp, Homo sapiens
  misc_feature 1..200: note = chr2:144694315-144694515
  misc_feature 1..200: note = hyper
  source 1..200: mol_type = genomic DNA
tggttttgcttagtgcgtcttcatcgtattccctcgctgaggactgagcctggccgactcagggaaccgagttcaatgaaatcctcagacgcataaagcacagggtgccggcccaccgagctgcgctcccttcccgggggtgcccgagagagagcacgcgagcccggcgcagccaaacccgggcaggggtgggtccccac

SEQ ID NO: 2056 - DNA, 704 bp, Homo sapiens
  misc_feature 1..704: note = chr2:144694553-144695257
  misc_feature 1..704: note = hyper
  source 1..704: mol_type = genomic DNA
cgtggcgggtgcgtgccggtgtgtgtgcgtgacagcgcgcgcgtggcagggagttcgcgcgccagggtgcgcgtgccagcgcgggtgtgcgagggagtgcgcgcgggtgggagcgccaggggctggcggggcccgcgccctgggacgagcccctcgtgctccggctctgcgctcccgcagcgcccacgcagccgagaggagtgggtgatgacttcgtgacctcaacgtcctcccccgtccctcgacatgttcccgcgcctgaaaggtgcagaaaactccccccaccgctctggacgagactgagctaggcgtcgagggcgggcgccgccgcagaccggagctcgggctcgctggccgctcaggcgcagcggtgtggagggaacggacgcgcggcaaggcgacccgctctgggcaacgcgggcgcagctgccccgacgcaaggcactagctggtcgggggctcgggcgagccggggccggcgtgccggggcgtgcgctctctcggcaggcgagcgccgggctccgcggaggtccctgcgcccactgcctgcttctccgcccggcgacccggagtccccaggctgcggtgcgccaggccagacctgaccgagggcggaagacccgagcggcagggaggcagaaagaaaagaggtagcaagccccagacaagggatccttaattacagataaaaggcaaacaaaacc

SEQ ID NO: 2057 - DNA, 31 bp, Homo sapiens
  misc_feature 1..31: note = chr2:144695258-144695289
  misc_feature 1..31: note = hyper
  source 1..31: mol_type = genomic DNA
tacaccacattttccacgtgtcagctgacgg

SEQ ID NO: 2058 - DNA, 463 bp, Homo sapiens; identical to SEQ ID NO: 201
  misc_feature 1..463: note = chr2:145273327-145273790
  misc_feature 1..463: note = hyper
  source 1..463: mol_type = genomic DNA

SEQ ID NO: 2059 - DNA, 431 bp, Homo sapiens
  misc_feature 1..431: note = chr2:145274080-145274511
  misc_feature 1..431: note = hyper
  source 1..431: mol_type = genomic DNA
actcagcctggataacgggctcctccagaccatgtagaaactgccgggaaaagtctcgctgcgccctgcgactccttcagtccccggcctgggggcagagcctgctggagaggagtcatccgtccccgagccatcatcgaccccaccggaccccgcgcggggccggccgactccctcccaccccggggtctgggcgcgatgggccgggccccgctgcccgcggaccgttacttggcgcaccgagaagcggccgggcgactccggcaagaaactttaagcctcgctgaggcgcagacccggttcccctctcctgccttcgcagtctctctgccacccccgcccccgccccgggatcctgcgcgatccagcgcctgggcccccgccctgccccaggcggacgctcccgaagcccggccggagacccggcgggc

SEQ ID NO: 2060 - DNA, 399 bp, Homo sapiens
  misc_feature 1..399: note = chr2:145274576-145274975
  misc_feature 1..399: note = hyper
  source 1..399: mol_type = genomic DNA
cggggctgggggcgcggggccccggccggacccccgcgctcggacccccgggtgcctgacgctcactttgcccggcacttccccaacaccccccggtccagccgccgcgcgcgccgggctccggcgccggccgcggagggaggctcgccctagagccctgggcgccgccgccgccgccgcctcggttccttttccctttccccctccttctccctgggtctcgagccgcgtagtggcccggaaaagtttggttcgggctgcttcttaccgtttttcctcctgggattggcttgtttgcgcctcttgcaccgggggccatccgccatgatcggctgcttcattgataagagcggatcagatggcagttcgcatggactcggcgccctgcttcggcagcac

SEQ ID NO: 2061 - DNA, 479 bp, Homo sapiens
  misc_feature 1..479: note = chr2:145274976-145275455
  misc_feature 1..479: note = hyper
  source 1..479: mol_type = genomic DNA
caggctcgatctagcaaccaaacacagcgacaatgtgggcatcgcccgcgcccattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctgg

SEQ ID NO: 2062 - DNA, 92 bp, Homo sapiens
  misc_feature 1..92: note = chr2:145281307-145281399
  misc_feature 1..92: note = hyper
  source 1..92: mol_type = genomic DNA
ggaggaggtggggggcggcaggggtccaagccaagccaaacggttttctcacgtgcagactcgcaatccaatccattcggagttgagcctag

SEQ ID NO: 2063 - DNA, 746 bp, Homo sapiens
  misc_feature 1..746: note = chr2:149633311-149634057
  misc_feature 1..746: note = hyper
  source 1..746: mol_type = genomic DNA
ggtaagtggctggggcgtctgccttccctgctgctccgcgccgcagctgggcgccccgacgccccagacgcagcggaggtgtttaggccgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgccttgcctcttcttctcacgaccctagcaaaaaagaaagaaaaaggggtacaggaaaatttctagtcgcgtctcggagctcccgcggcagtgtagacgcggctccccgcggtgttacacctggctccgcgcgcggaaggcggagggttgggggagtactggtggcctcggtgtcccctggaggcctggtgtgtctcccgcttcctctcacgcctggctgccctggatgtggagtcccggcttgatccctcccctctgggatgacctccctcccatgtctgcagaccctctgatgcgcctcacgctgggtggagagg

SEQ ID NO: 2064 - DNA, 24 bp, Homo sapiens
  misc_feature 1..24: note = chr2:149645535-149645559
  misc_feature 1..24: note = hyper
  source 1..24: mol_type = genomic DNA
ccgcagcaagggctgcgaccccgc

SEQ ID NO: 2065 - DNA, 287 bp, Homo sapiens; identical to SEQ ID NO: 203
  misc_feature 1..287: note = chr2:149645560-149645847
  misc_feature 1..287: note = hyper
  source 1..287: mol_type = genomic DNA

SEQ ID NO: 2066 - DNA, 247 bp, Homo sapiens
  misc_feature 1..247: note = chr2:154334199-154334446
  misc_feature 1..247: note = hyper
  source 1..247: mol_type = genomic DNA
caaaacctcttaaaacggcacgttacaatcaaaggtatttatcgcccctcccctccagggcagggggggagcaggagaagagtgggagcgcacccggacacggatttgtgagaccccatgagtctgctgcgtggcttttaacaggtcactcttccggtcacaaggcgatcagtgccgctgggtctctcccctgcccgccctctccacctgcccccagagcttggcccacctgcgggtggagaagggc

SEQ ID NO: 2067 - DNA, 266 bp, Homo sapiens
  misc_feature 1..266: note = chr2:154335184-154335450
  misc_feature 1..266: note = hyper
  source 1..266: mol_type = genomic DNA
gtgcgagggctcctcgctctgctttcgaaagtccctgggccgtgggagtttcccaggagcctctccgacgcgcgcagcagctaggctcttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgc

SEQ ID NO: 2068 - DNA, 1265 bp, Homo sapiens; identical to SEQ ID NO: 204
  misc_feature 1..1265: note = chr2:157176900-157178165
  misc_feature 1..1265: note = hyper
  source 1..1265: mol_type = genomic DNA

SEQ ID NO: 2069 - DNA, 13 bp, Homo sapiens
  misc_feature 1..13: note = chr2:157178166-157178179
  misc_feature 1..13: note = hyper
  source 1..13: mol_type = genomic DNA
aggcccaggcagg

SEQ ID NO: 2070 - DNA, 55 bp, Homo sapiens; identical to SEQ ID NO: 206
  misc_feature 1..55: note = chr2:162275172-162275227
  misc_feature 1..55: note = hyper
  source 1..55: mol_type = genomic DNA

SEQ ID NO: 2071 - DNA, 128 bp, Homo sapiens; identical to SEQ ID NO: 207
  misc_feature 1..128: note = chr2:162275310-162275438
  misc_feature 1..128: note = hyper
  source 1..128: mol_type = genomic DNA

SEQ ID NO: 2072 - DNA, 128 bp, Homo sapiens; identical to SEQ ID NO: 208
  misc_feature 1..128: note = chr2:162275472-162275600
  misc_feature 1..128: note = hyper
  source 1..128: mol_type = genomic DNA

SEQ ID NO: 2073 - DNA, 264 bp, Homo sapiens; identical to SEQ ID NO: 209
  misc_feature 1..264: note = chr2:162280152-162280416
  misc_feature 1..264: note = hyper
  source 1..264: mol_type = genomic DNA

SEQ ID NO: 2074 - DNA, 216 bp, Homo sapiens; identical to SEQ ID NO: 210
  misc_feature 1..216: note = chr2:162280740-162280956
  misc_feature 1..216: note = hyper
  source 1..216: mol_type = genomic DNA

SEQ ID NO: 2075 - DNA, 238 bp, Homo sapiens; identical to SEQ ID NO: 211
  misc_feature 1..238: note = chr2:162283365-162283603
  misc_feature 1..238: note = hyper
  source 1..238: mol_type = genomic DNA

SEQ ID NO: 2076 - DNA, 273 bp, Homo sapiens; identical to SEQ ID NO: 212
  misc_feature 1..273: note = chr2:162283782-162284055
  misc_feature 1..273: note = hyper
  source 1..273: mol_type = genomic DNA

SEQ ID NO: 2077 - DNA, 228 bp, Homo sapiens
  misc_feature 1..228: note = chr2:168150566-168150794
  misc_feature 1..228: note = hyper
  source 1..228: mol_type = genomic DNA
ctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcagctgccaaatgcctggcggctccgctttccgacaaagttcaggc

SEQ ID NO: 2078 - DNA, 22 bp, Homo sapiens
  misc_feature 1..22: note = chr2:171675361-171675383
  misc_feature 1..22: note = hyper
  source 1..22: mol_type = genomic DNA
tgactcccagggcaccggaaag

SEQ ID NO: 2079 - DNA, 131 bp, Homo sapiens; identical to SEQ ID NO: 214
  misc_feature 1..131: note = chr2:171675522-171675653
  misc_feature 1..131: note = hyper
  source 1..131: mol_type = genomic DNA

SEQ ID NO: 2080 - DNA, 329 bp, Homo sapiens; identical to SEQ ID NO: 215
  misc_feature 1..329: note = chr2:172945896-172946225
  misc_feature 1..329: note = hyper
  source 1..329: mol_type = genomic DNA

SEQ ID NO: 2081 - DNA, 56 bp, Homo sapiens
  misc_feature 1..56: note = chr2:172949227-172949283
  misc_feature 1..56: note = hyper
  source 1..56: mol_type = genomic DNA
ctaaactctggaagtcgcgctagacctcaggaggccggaaaatgaccacctggcgt

SEQ ID NO: 2082 - DNA, 499 bp, Homo sapiens
  misc_feature 1..499: note = chr2:172949348-172949847
  misc_feature 1..499: note = hyper
  source 1..499: mol_type = genomic DNA
cgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtc

SEQ ID NO: 2083 - DNA, 323 bp, Homo sapiens; identical to SEQ ID NO: 216
  misc_feature 1..323: note = chr2:172955471-172955794
  misc_feature 1..323: note = hyper
  source 1..323: mol_type = genomic DNA

SEQ ID NO: 2084 - DNA, 59 bp, Homo sapiens; identical to SEQ ID NO: 217
  misc_feature 1..59: note = chr2:172957976-172958035
  misc_feature 1..59: note = hyper
  source 1..59: mol_type = genomic DNA

SEQ ID NO: 2085 - DNA, 94 bp, Homo sapiens; identical to SEQ ID NO: 218
  misc_feature 1..94: note = chr2:172964795-172964889
  misc_feature 1..94: note = hyper
  source 1..94: mol_type = genomic DNA

SEQ ID NO: 2086 - skipped

SEQ ID NO: 2087 - DNA, 116 bp, Homo sapiens; identical to SEQ ID NO: 220
  misc_feature 1..116: note = chr2:172965647-172965763
  misc_feature 1..116: note = hyper
  source 1..116: mol_type = genomic DNA

SEQ ID NO: 2088 - DNA, 802 bp, Homo sapiens; identical to SEQ ID NO: 221
  misc_feature 1..802: note = chr2:172966250-172967052
  misc_feature 1..802: note = hyper
  source 1..802: mol_type = genomic DNA

SEQ ID NO: 2089 - DNA, 1168 bp, Homo sapiens; identical to SEQ ID NO: 222
  misc_feature 1..1168: note = chr2:175190805-175191973
  misc_feature 1..1168: note = hyper
  source 1..1168: mol_type = genomic DNA

SEQ ID NO: 2090 - DNA, 149 bp, Homo sapiens; identical to SEQ ID NO: 223
  misc_feature 1..149: note = chr2:175192084-175192233
  misc_feature 1..149: note = hyper
  source 1..149: mol_type = genomic DNA

SEQ ID NO: 2091 - DNA, 83 bp, Homo sapiens; identical to SEQ ID NO: 224
  misc_feature 1..83: note = chr2:175193294-175193377
  misc_feature 1..83: note = hyper
  source 1..83: mol_type = genomic DNA

SEQ ID NO: 2092 - DNA, 267 bp, Homo sapiens; identical to SEQ ID NO: 225
  misc_feature 1..267: note = chr2:175193378-175193645
  misc_feature 1..267: note = hyper
  source 1..267: mol_type = genomic DNA

SEQ ID NO: 2093 - DNA, 35 bp, Homo sapiens; identical to SEQ ID NO: 226
  misc_feature 1..35: note = chr2:175193808-175193843
  misc_feature 1..35: note = hyper
  source 1..35: mol_type = genomic DNA

SEQ ID NO: 2094 - DNA, 90 bp, Homo sapiens; identical to SEQ ID NO: 227
  misc_feature 1..90: note = chr2:175199465-175199555
  misc_feature 1..90: note = hyper
  source 1..90: mol_type = genomic DNA

SEQ ID NO: 2095 - skipped

SEQ ID NO: 2096 - DNA, 181 bp, Homo sapiens; identical to SEQ ID NO: 229
  misc_feature 1..181: note = chr2:175200260-175200441
  misc_feature 1..181: note = hyper
  source 1..181: mol_type = genomic DNA

SEQ ID NO: 2097 - DNA, 144 bp, Homo sapiens; identical to SEQ ID NO: 230
  misc_feature 1..144: note = chr2:175200709-175200853
  misc_feature 1..144: note = hyper
  source 1..144: mol_type = genomic DNA

SEQ ID NO: 2098 - DNA, 267 bp, Homo sapiens; identical to SEQ ID NO: 231
  misc_feature 1..267: note = chr2:175200916-175201183
  misc_feature 1..267: note = hyper
  source 1..267: mol_type = genomic DNA

SEQ ID NO: 2099 - DNA, 183 bp, Homo sapiens; identical to SEQ ID NO: 232
  misc_feature 1..183: note = chr2:175201359-175201542
  misc_feature 1..183: note = hyper
  source 1..183: mol_type = genomic DNA

SEQ ID NO: 2100 - DNA, 54 bp, Homo sapiens; identical to SEQ ID NO: 233
  misc_feature 1..54: note = chr2:175201775-175201829
  misc_feature 1..54: note = hyper
  source 1..54: mol_type = genomic DNA

SEQ ID NO: 2101 - DNA, 120 bp, Homo sapiens; identical to SEQ ID NO: 234
  misc_feature 1..120: note = chr2:175202126-175202246
  misc_feature 1..120: note = hyper
  source 1..120: mol_type = genomic DNA

SEQ ID NO: 2102 - DNA, 33 bp, Homo sapiens; identical to SEQ ID NO: 235
  misc_feature 1..33: note = chr2:175202568-175202601
  misc_feature 1..33: note = hyper
  source 1..33: mol_type = genomic DNA

SEQ ID NO: 2103 - DNA, 78 bp, Homo sapiens; identical to SEQ ID NO: 236
  misc_feature 1..78: note = chr2:175202633-175202711
  misc_feature 1..78: note = hyper
  source 1..78: mol_type = genomic DNA

SEQ ID NO: 2104 - DNA, 119 bp, Homo sapiens; identical to SEQ ID NO: 237
  misc_feature 1..119: note = chr2:175204828-175204947
  misc_feature 1..119: note = hyper
  source 1..119: mol_type = genomic DNA

SEQ ID NO: 2105 - DNA, 558 bp, Homo sapiens; identical to SEQ ID NO: 238
  misc_feature 1..558: note = chr2:175208311-175208869
  misc_feature 1..558: note = hyper
  source 1..558: mol_type = genomic DNA

SEQ ID NO: 2106 - DNA, 93 bp, Homo sapiens; identical to SEQ ID NO: 239
  misc_feature 1..93: note = chr2:175208996-175209089
  misc_feature 1..93: note = hyper
  source 1..93: mol_type = genomic DNA

SEQ ID NO: 2107 - DNA, 148 bp, Homo sapiens
  misc_feature 1..148: note = chr2:176940167-176940315
  misc_feature 1..148: note = hyper
  source 1..148: mol_type = genomic DNA
aattgcagagggtagcgattgtttcatcaaatgtttcatatttctgagtttggagggcggggatgccagggtaagcttcctccgagcgactaaggagcagcaacaagctctggaatttcctctcggggtggtccgttccaccttaaat

SEQ ID NO: 2108 - DNA, 59 bp, Homo sapiens; identical to SEQ ID NO: 240
  misc_feature 1..59: note = chr2:176944346-176944405
  misc_feature 1..59: note = hyper
  source 1..59: mol_type = genomic DNA

SEQ ID NO: 2109 - DNA, 391 bp, Homo sapiens; identical to SEQ ID NO: 241
  misc_feature 1..391: note = chr2:176944456-176944847
  misc_feature 1..391: note = hyper
  source 1..391: mol_type = genomic DNA

SEQ ID NO: 2110 - DNA, 132 bp, Homo sapiens; identical to SEQ ID NO: 242
  misc_feature 1..132: note = chr2:176945137-176945269
  misc_feature 1..132: note = hyper
  source 1..132: mol_type = genomic DNA

SEQ ID NO: 2111 - DNA, 203 bp, Homo sapiens; identical to SEQ ID NO: 243
  misc_feature 1..203: note = chr2:176945581-176945784
  misc_feature 1..203: note = hyper
  source 1..203: mol_type = genomic DNA

SEQ ID NO: 2112 - DNA, 43 bp, Homo sapiens
  misc_feature 1..43: note = chr2:176949959-176950002
  misc_feature 1..43: note = hyper
  source 1..43: mol_type = genomic DNA
ccagccccttacctgcggccacaggtattcccagcgttgggtc

SEQ ID NO: 2113 - DNA, 184 bp, Homo sapiens
  misc_feature 1..184: note = chr2:176950074-176950258
  misc_feature 1..184: note = hyper
  source 1..184: mol_type = genomic DNA
cgacaactttgatagtcataatgacgccggtggcaaccattttaacgaagatcaatcttcactccaggccgctcctcatctcccgcggttgcgcccacccttccctgaccctccaagcactgtgcccacccgccaacggcccagccggagagagattcgcggacacaggcggaggcgagggagg

SEQ ID NO: 2114 - DNA, 68 bp, Homo sapiens; identical to SEQ ID NO: 244
  misc_feature 1..68: note = chr2:176957347-176957415
  misc_feature 1..68: note = hyper
  source 1..68: mol_type = genomic DNA

SEQ ID NO: 2115 - DNA, 53 bp, Homo sapiens; identical to SEQ ID NO: 245
  misc_feature 1..53: note = chr2:176957576-176957629
  misc_feature 1..53: note = hyper
  source 1..53: mol_type = genomic DNA

SEQ ID NO: 2116 - DNA, 207 bp, Homo sapiens; identical to SEQ ID NO: 246
  misc_feature 1..207: note = chr2:176957914-176958121
  misc_feature 1..207: note = hyper
  source 1..207: mol_type = genomic DNA

SEQ ID NO: 2117 - DNA, 52 bp, Homo sapiens
  misc_feature 1..52: note = chr2:176958391-176958443
  misc_feature 1..52: note = hyper
  source 1..52: mol_type = genomic DNA
ctttccaggtaggggcgatggagaaaagggaccgacacgagggagggggaga

SEQ ID NO: 2118 - DNA, 298 bp, Homo sapiens; identical to SEQ ID NO: 247
  misc_feature 1..298: note = chr2:176959213-176959511
  misc_feature 1..298: note = hyper
  source 1..298: mol_type = genomic DNA

SEQ ID NO: 2119 - DNA, 213 bp, Homo sapiens
  misc_feature 1..213: note = chr2:176964389-176964602
  misc_feature 1..213: note = hyper
  source 1..213: mol_type = genomic DNA
cggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttct

SEQ ID NO: 2120 - DNA, 35 bp, Homo sapiens
  misc_feature 1..35: note = chr2:176969579-176969614
  misc_feature 1..35: note = hyper
  source 1..35: mol_type = genomic DNA
tggctcaccctcccccgccaaatcgctgctcccgc

SEQ ID NO: 2121 - DNA, 69 bp, Homo sapiens
  misc_feature 1..69: note = chr2:176969676-176969745
  misc_feature 1..69: note = hyper
  source 1..69: mol_type = genomic DNA
cggtcagcaggctccatactgggggcgccgggctgcctgcaccccaccccgtgccgccagtagagagaa

SEQ ID NO: 2122 - DNA, 105 bp, Homo sapiens
  misc_feature 1..105: note = chr2:176976065-176976170
  misc_feature 1..105: note = hyper
  source 1..105: mol_type = genomic DNA
ccacccaaggcaagccgaacccgagataccattttccgtttgcaggggcctggagatccacacgagggcgcgctcacgttccagaagccgcgtttgaccaagagg

SEQ ID NO: 2123 - DNA, 168 bp, Homo sapiens; identical to SEQ ID NO: 248
  misc_feature 1..168: note = chr2:176980770-176980938
  misc_feature 1..168: note = hyper
  source 1..168: mol_type = genomic DNA

SEQ ID NO: 2124 - DNA, 130 bp, Homo sapiens; identical to SEQ ID NO: 249
  misc_feature 1..130: note = chr2:176981376-176981506
  misc_feature 1..130: note = hyper
  source 1..130: mol_type = genomic DNA

SEQ ID NO: 2125 - DNA, 504 bp, Homo sapiens
  misc_feature 1..504: note = chr2:176986711-176987215
  misc_feature 1..504: note = hyper
  source 1..504: mol_type = genomic DNA
cgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggactcgccgcccgcggctcggaagctggagagtcagcgacggggcccgactgcgggaccgagggctgcaagaagaagcgaacaaatagtccccagcgcctcctctgg

SEQ ID NO: 2126 - DNA, 277 bp, Homo sapiens
  misc_feature 1..277: note = chr2:176993514-176993791
  misc_feature 1..277: note = hyper
  source 1..277: mol_type = genomic DNA
atttcacaggcttggcggaggaagtaggatcgttagcataagatgggccgcctgcagctgcctggaaccggcgcgatctgaacgccggctgggaggctcctggggggaacttgcggtcgtctgccctccgcactcctccgggaaccgcagccggccctggttcgctgcgcgccggggctgagacccgggagccgcgtcctgcccgaggaaatgtcaccctccccagcgcgagccctttttcccgcctcagaacgtttctgtccgctcttctatttac

SEQ ID NO: 2127 - DNA, 256 bp, Homo sapiens
  misc_feature 1..256: note = chr2:176994124-176994380
  misc_feature 1..256: note = hyper
  source 1..256: mol_type = genomic DNA
tccctgggctgcacccgcgtgtccagagctgcaaaagccacgggcaacctctgcttttgcagccaggggctcggggaggcagtcatttgctccgcagcctcctgggagtggcctccttggctcccccaagtctaaggctccgccgcggcccctccctgccggctgcgatccgcattcccgcggccccggggcacacggagcccttggcagtgcgtctttatgggccccctttaaggccggcggaggcatctcgggc

SEQ ID NO: 2128 - DNA, 63 bp, Homo sapiens
  misc_feature 1..63: note = chr2:176994497-176994560
  misc_feature 1..63: note = hyper
  source 1..63: mol_type = genomic DNA
cgccggtgcgcaccgggtcggcagcctcggcggcgggggcgagattggcgggaggggggcgcg

SEQ ID NO: 2129 - DNA, 57 bp, Homo sapiens; identical to SEQ ID NO: 250
  misc_feature 1..57: note = chr2:177001206-177001263
  misc_feature 1..57: note = hyper
  source 1..57: mol_type = genomic DNA

SEQ ID NO: 2130 - DNA, 432 bp, Homo sapiens; identical to SEQ ID NO: 251
  misc_feature 1..432: note = chr2:177001264-177001696
  misc_feature 1..432: note = hyper
  source 1..432: mol_type = genomic DNA

SEQ ID NO: 2131 - DNA, 75 bp, Homo sapiens; identical to SEQ ID NO: 252
  misc_feature 1..75: note = chr2:177001781-177001856
  misc_feature 1..75: note = hyper
  source 1..75: mol_type = genomic DNA

SEQ ID NO: 2132 - DNA, 73 bp, Homo sapiens
  misc_feature 1..73: note = chr2:177042926-177042999
  misc_feature 1..73: note = hyper
  source 1..73: mol_type = genomic DNA
ggcggggtgggctggcgctcctgatccacctggaacacttttgcaaagacagacggtgagttaatcaccctac

SEQ ID NO: 2133 - DNA, 19 bp, Homo sapiens
  misc_feature 1..19: note = chr2:177053935-177053954
  misc_feature 1..19: note = hyper
  source 1..19: mol_type = genomic DNA
cctcggccgtcttctcggg

SEQ ID NO: 2134 - DNA, 364 bp, Homo sapiens; identical to SEQ ID NO: 254
  misc_feature 1..364: note = chr2:177053999-177054363
  misc_feature 1..364: note = hyper
  source 1..364: mol_type = genomic DNA

SEQ ID NO: 2135 - DNA, 158 bp, Homo sapiens; identical to SEQ ID NO: 255
  misc_feature 1..158: note = chr2:182321397-182321555
  misc_feature 1..158: note = hyper
  source 1..158: mol_type = genomic DNA

SEQ ID NO: 2136 - DNA, 27 bp, Homo sapiens
  misc_feature 1..27: note = chr2:182321811-182321838
  misc_feature 1..27: note = hyper
  source 1..27: mol_type = genomic DNA
ctggcatttgggccacgccgggctggg

SEQ ID NO: 2137 - DNA, 154 bp, Homo sapiens; identical to SEQ ID NO: 257
  misc_feature 1..154: note = chr2:182322038-182322192
  misc_feature 1..154: note = hyper
  source 1..154: mol_type = genomic DNA

SEQ ID NO: 2138 - DNA, 631 bp, Homo sapiens; identical to SEQ ID NO: 258
  misc_feature 1..631: note = chr2:182322399-182323030
  misc_feature 1..631: note = hyper
  source 1..631: mol_type = genomic DNA

SEQ ID NO: 2139 - DNA, 440 bp, Homo sapiens
  misc_feature 1..440: note = chr2:182542878-182543318
  misc_feature 1..440: note = hyper
  source 1..440: mol_type = genomic DNA
agctgtccatggtaccgtaaggcggactgggcagcccaggcgactggtaggagtaggggtgtacagggaaggaagcgctggccgtcggcaggtgggggggcatgtcctggttctgctcaggcagaaaagtccgaggattgagttgcaggcagcccgcaaccaggttggtggtgggttgggataagcccttgcaaagcgtctgaacgaaggagaccaggtctgggcttttgcctgagcgcaggatctccgacagagcccagatgtagttcttggccaagcgcagagtctcgattttggacagcttctgcgtcttagaatagcaaggcaccaccttgcgcaggttgtctagcgccgcgttcagtccgtgcatgcggttccgctcccgggcgttagccttcatgcgtctcaatttaaaacgctccaggcgagccttagtcatc

SEQ ID NO: 2140 - DNA, 397 bp, Homo sapiens
  misc_feature 1..397: note = chr2:182545388-182545785
  misc_feature 1..397: note = hyper
  source 1..397: mol_type = genomic DNA
ccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacctgcccatttgtatgccgcggagcgctccattccggcccctttgtggccagaagaaagtggcccatctgtcgccagttagagactccgcggacctgtttttacccgcaggagagattaaccctttcaggcggcagaagggacggggatagaggggggaggggatttgagggaaggaagggaaaagctaatgttaactaggtctagatcagagcgagtggcctgctttcgcgccggaagtaggacaga

SEQ ID NO: 2141 - DNA, 84 bp, Homo sapiens
  misc_feature 1..84: note = chr2:182546001-182546085
  misc_feature 1..84: note = hyper
  source 1..84: mol_type = genomic DNA
cgccatataaaagcggcttcatctgtaaacgcagcgttgagattagttccccaacctccctaaccggatcgtcctctcccagtt

SEQ ID NO: 2142 - DNA, 495 bp, Homo sapiens; identical to SEQ ID NO: 259
  misc_feature 1..495: note = chr2:182547437-182547932
  misc_feature 1..495: note = hyper
  source 1..495: mol_type = genomic DNA

SEQ ID NO: 2143 - DNA, 100 bp, Homo sapiens; identical to SEQ ID NO: 260
  misc_feature 1..100: note = chr2:182548061-182548161
  misc_feature 1..100: note = hyper
  source 1..100: mol_type = genomic DNA

SEQ ID NO: 2144 - DNA, 366 bp, Homo sapiens
  misc_feature 1..366: note = chr2:182549088-182549454
  misc_feature 1..366: note = hyper
  source 1..366: mol_type = genomic DNA
ggagctgcccaggctcgacaggcaggcgacccgggagagccaagagcaacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttagggagtgatttagtgccgggcttccccagctcggcctgcctgggcctttttatttattatttatgccctcccggtcccgacggggctttggtggctcctttgtcggctcccacaggcc

SEQ ID NO: 2145 - DNA, 110 bp, Homo sapiens
  misc_feature 1..110: note = chr2:183731222-183731332
  misc_feature 1..110: note = hyper
  source 1..110: mol_type = genomic DNA
ccagggcaagcagcccggcccgcagcagcagcatccctcccgggctgccgcagaccatgatcccggcaggatggggcagggtgcagccgcgcagtggacgccaaaaggcc

SEQ ID NO: 2146 - DNA, 640 bp, Homo sapiens
  misc_feature 1..640: note = chr2:183731466-183732106
  misc_feature 1..640: note = hyper
  source 1..640: mol_type = genomic DNA
cgcccctgccgcccaggctgctctttcccaacgtctaagccttcggaagcagcaacatctatttattcctctccctctggcagaagcatcagacttcgcagatcagtcagataagagggacacgagaggaggcgaggaagacataaaaacaaaagtagaattcagctgagagctagttggagctctggggtgtctcctcccctagatcacgcacacaaaaagatgctaaagaaagcattaaattccccaaagtgaggaggacagaggggttggggggaaggagggaggaaaagctcctaatgggagagaagggtgcagtaagagtttacaagtcctgtgtgggctaagagctgcggccgccgctgcggctgcgaccctggctggcaggagggacgctcaggaggagccccgcagggacgtctgtgcctctgcccgggcggctctgcactttcctacctcccgcctgagagggagctccgcccctggggcagtctctgccctccagtgccggctgctcttcccgagaatggagtgggcgcccggggaagagaaggcctgggagtcgcaggcggtggggtgcgaagccgtgcgagtgcgagaccccaagacagcgccgagtcgagcgcgccctcacactagg

SEQ ID NO: 2147 - DNA, 500 bp, Homo sapiens
  misc_feature 1..500: note = chr2:185463255-185463755
  misc_feature 1..500: note = hyper
  source 1..500: mol_type = genomic DNA
aactccgagtgcaggcgccgagcgcgggggatgctgccgccgccgccgcttctgctgccgcgcgggcggctcccgcagccccgctccgcccggccaccgcgcgggcactgactcccgctcggttccgtttcgccggcccggccccctcctaggctggaatcctcccgcggggctcgtcgtcccgacgcgaatctgaggagaaacaggagcgagagactgaggggagagcgcggcgagcatgcggaggcgggggagcctcggcgctcaccacagaggggtgcagtgagccagtctccagaggacgtgccgggggtggctgcgtgccctcgtggcgggttcccagcccaccgtcgccggccccggcgcgctgcggctgtgggcgcggggtgcgtggaagcggcggctgcggcggaggaggcggcggctgccccatggagtgttactacattgtcatcagctccacgcatctcagcaacggacactttcgcaacatcaaggga

SEQ ID NO: 2148 - DNA, 293 bp, Homo sapiens
  misc_feature 1..293: note = chr2:193059025-193059318
  misc_feature 1..293: note = hyper
  source 1..293: mol_type = genomic DNA
acgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcag

SEQ ID NO: 2149 - DNA, 165 bp, Homo sapiens
  misc_feature 1..165: note = chr2:193059344-193059509
  misc_feature 1..165: note = hyper
  source 1..165: mol_type = genomic DNA
cggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgcc

SEQ ID NO: 2150 - DNA, 707 bp, Homo sapiens
  misc_feature 1..707: note = chr2:193059734-193060441
  misc_feature 1..707: note = hyper
  source 1..707: mol_type = genomic DNA
gcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatcc

SEQ ID NO: 2151 - DNA, 271 bp, Homo sapiens
  misc_feature 1..271: note = chr2:193060675-193060946
  misc_feature 1..271: note = hyper
  source 1..271: mol_type = genomic DNA
tactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgc

SEQ ID NO: 2152 - DNA, 29 bp, Homo sapiens
  misc_feature 1..29: note = chr2:200327423-200327452
  misc_feature 1..29: note = hyper
  source 1..29: mol_type = genomic DNA
ggaggtagagactgtggaggtcctcctcc

SEQ ID NO: 2153 - DNA, 365 bp, Homo sapiens
  misc_feature 1..365: note = chr2:200329029-200329394
  misc_feature 1..365: note = hyper
  source 1..365: mol_type = genomic DNA
ggagccacatccggacttgggaaccccgtgtcgggcttagaggacttcactgggcgggttggggtttattttcaataaattcagctgttcacatacacccccaccaccatttccacgcgcgcgcgcgcacacacacacacacacacacagagggacttgtcaactattgagacagcgacccagaaaggtgtaaattcacctggtgcccacccaattgcaaagctcccagacccacacaaaacactagcgagccctggaggtctgagacgccccgcgcccgactcacggcgcgaacaccagcgctccggccgggtcgcaggggccggtgcccagcgggccggggtctggcgagccaggcagcgggc

SEQ ID NO: 2154 - DNA, 262 bp, Homo sapiens
  misc_feature 1..262: note = chr2:200329432-200329694
  misc_feature 1..262: note = hyper
  source 1..262: mol_type = genomic DNA
cgcctactcccttattattggctgggacctgttcctttccaaagtgtgatgcccggtgtcctaccctaggccacgcggagctctctcccggcgtgtcgggccctgcgcccctgcccagtggctcacctcggctcgctgcgcccgccttcgccccaagtgcccaggacggagcgaggggctgtgggtcggcgcagggacgctggctgctcacctccaggagccgacagaaggtgccttcggcgtcacgcgtccaaccctgggg

SEQ ID NO: 2155 - DNA, 49 bp, Homo sapiens
  misc_feature 1..49: note = chr2:200335076-200335125
  misc_feature 1..49: note = hyper
  source 1..49: mol_type = genomic DNA
tgccaacttggggcacggaggcgacgggctgctccgaagctggagggtt

SEQ ID NO: 2156 - DNA, 217 bp, Homo sapiens
  misc_feature 1..217: note = chr2:201450490-201450707
  misc_feature 1..217: note = hyper
  source 1..217: mol_type = genomic DNA
caatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggtt

SEQ ID NO: 2157 - DNA, 40 bp, Homo sapiens
  misc_feature 1..40: note = chr2:207139115-207139155
  misc_feature 1..40: note = hyper
  source 1..40: mol_type = genomic DNA
atttggaccctcaaacgctaaaaccttggtctctacttcg

SEQ ID NO: 2158 - DNA, 606 bp, Homo sapiens
  misc_feature 1..606: note = chr2:207139217-207139823
  misc_feature 1..606: note = hyper
  source 1..606: mol_type = genomic DNA
cggagtggggccctgaccagggaggaagtgtccgctttaagagcttctggaggggaggaaggggctcctccgcccgggtgggagagtgagtgagtgggtgggcgggcagggggcggtcccgccgctcctgcgtcagaaggggtctggttttcgcaccttccctgacgtcaaacctccatcagggttgcaacgccacgttgccttggatgcctgcgtgagtggagtcgcgactcggggcccgcgtcctgagagacgcgctcccgcgccgcttctcgcctccggaccgcaggggccgaagtcgcctatttctggctccgcgggcagcggggccgtggcgctcggacggtctgggattcgggcgccgccgcggaaccggaataagaagggagagcgcccggctcggtcctcggtctccaccgcggcccggaaggaatccgggcagcctccgcggaggtgagtgccgcggcgggggcggggcgcggccggggcgacgcccgcgggcggggcctgctcgccgggcgcccggggcgccttcttcccgagggacgccaggaccgctcgctgggctcccgcggccgcctcgcaggtcctcggcttccccccacc

SEQ ID NO: 2159 - DNA, 310 bp, Homo sapiens
  misc_feature 1..310: note = chr2:207506759-207507069
  misc_feature 1..310: note = hyper
  source 1..310: mol_type = genomic DNA
acacccctttattctcggacgaggcccgtgtggtgagcgggaacccctgctgtcccctggaccagcgcggagctgggccctaactttgcagttcccgccgcatcggcacgcacccgcgaggtgggagcgggaagcccagccgcattagaggctcaattccggcaggtgcagagtgggtgcgggtcaaggccaatgagagtgtgtgtggccaagcccgctggtttcctgaaccgaaattctccggggagggagagaagaggagggtgcgggagacggacttggaggcgagaggtggcggcagtttccagga

SEQ ID NO: 2160 - DNA, 695 bp, Homo sapiens
  misc_feature 1..695: note = chr2:213402687-213403382
  misc_feature 1..695: note = hyper
  source 1..695: mol_type = genomic DNA
cacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagccactcgaggcagccccgccggcggctgcaggttcggcgaccggagtgccagaaggaacccacctgactgagaatcgctgggctggacggtccccgccgccacgagaaggctcacccagacccaaagtcctgtcgccggcttcattttttggaagtctcagatcccgtgctgacaattacatgtccaaatggcatatccccctttcgggcacgcggaggagatcccccagccgggcgcgcgtgggggtgcgaggggggcgggcgcggcgcgcg

SEQ ID NO: 2161 - DNA, 93 bp, Homo sapiens
  misc_feature 1..93: note = chr2:218806209-218806302
  misc_feature 1..93: note = hyper
  source 1..93: mol_type = genomic DNA
gccagggcagagcgtcgggctcttggttccttacacattggcaggaaggagggggcccctgcgagtggtctgcgcccacgccccaggccagag

SEQ ID NO: 2162 - DNA, 394 bp, Homo sapiens; identical to SEQ ID NO: 262
  misc_feature 1..394: note = chr2:219736151-219736545
  misc_feature 1..394: note = hyper
  source 1..394: mol_type = genomic DNA

SEQ ID NO: 2163 - DNA, 231 bp, Homo sapiens
  misc_feature 1..231: note = chr2:220174065-220174296
  misc_feature 1..231: note = hyper
  source 1..231: mol_type = genomic DNA
ccgggcgctcgctcccgggccggagccgcagcgacgctggcgggagcctgccagaggggctgaggcggggcttgccgctccccacctccctacgaggcggggtctacatgcccctctcgctgcaacgcggccaaccgcaggcgggtgctgacgacacctccacccccggctcgtaagctaatttgcgtcacatatggcgtaagagccctgtcggagcgggggacctaccta

SEQ ID NO: 2164 - DNA, 280 bp, Homo sapiens
  misc_feature 1..280: note = chr2:220196354-220196634
  misc_feature 1..280: note = hyper
  source 1..280: mol_type = genomic DNA
gaagggaaagagcttcgggaaggggagctgattctctgaggcagcgttcccaggactggtgggaaggagtggtgacccgctcgggctcggcgtggacccggagcgcgcctggcgctgtccgtggtgctgagaggtggggaggccagcgtggcggcggcgctgggcggaatgtgggcgagacatctccgcaaggcttggcggtccttccccacggccctcatcctctcattgccaccaggcctcctcccacagctgttcctgaatccgctgcattggcctc

SEQ ID NO: 2165 - DNA, 102 bp, Homo sapiens; identical to SEQ ID NO: 263
  misc_feature 1..102: note = chr2:220299533-220299635
  misc_feature 1..102: note = hyper
  source 1..102: mol_type = genomic DNA

SEQ ID NO: 2166 - DNA, 174 bp, Homo sapiens; identical to SEQ ID NO: 264
  misc_feature 1..174: note = chr2:220299885-220300059
  misc_feature 1..174: note = hyper
  source 1..174: mol_type = genomic DNA

SEQ ID NO: 2167 - DNA, 618 bp, Homo sapiens; identical to SEQ ID NO: 265
  misc_feature 1..618: note = chr2:220349101-220349719
  misc_feature 1..618: note = hyper
  source 1..618: mol_type = genomic DNA

SEQ ID NO: 2168 - DNA, 1308 bp, Homo sapiens
  misc_feature 1..1308: note = chr2:220416379-220417687
  misc_feature 1..1308: note = hyper
  source 1..1308: mol_type = genomic DNA
ctcccgggcacagctcggccccctcccgcagccagcacacgtggccccccgagcgggacacagtcacctccagcaccgcccggcggcccaccagaacggtcttctcgcgaggggggtggcggcacatctggagaggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagtagagccagggactgggcgggccccgcctggaagcggacttcaccggcgtcctcggcgcgcagctcgctaagcaccagaatgtgtttcttccctgggggtgagggggtcgctagcgaggccggagccacctctgaggagcgttggggacgaaggtgggggcccagcaggcccctgggtcggttcggacgccgttagtgtatgctagggtgggcggaacagggatgcggagcgggaagcctagaggtccgggactaggggctgggggcgggggaaagaacagggacgaggctcacagggccgtggggcggggcccgtcggagccaggggcggggcttgtcccggtggggcgggatctgttcgagcctgggcggggcagcgaggggcccgaaagggtaaccaggcgggcagaccttcctgtcggatgcggacgcgggctccgggtctcagcgggcggcctccgagctcccagcgccccgtggtctcgacctccgacacggtgcactcgaacgtagcgccgtcgccttcgcgggcgctcaccgaccgcagctcggagagtaccgccacagtacgctctggggcggagcccggggcgtgagcggggcggggcagagggcagttaccggtcacgccccctccacgccccctttctagaagcacgcgcggtcatcagggtccggggaagacagctccgcaagtctcgcgcccaaagcagtgcccagcctccacatcaccccgtacccaccgcgcacggtcaggcggaccggtccggcgcgggccgtccccaccgcgcagctgtaggtcccggcgtccgaggggccgcagcgtcgcagctggagaagg

SEQ ID NO: 2169 - DNA, 749 bp, Homo sapiens; identical to SEQ ID NO: 266
  misc_feature 1..749: note = chr2:223158730-223159479
  misc_feature 1..749: note = hyper
  source 1..749: mol_type = genomic DNA

SEQ ID NO: 2170 - DNA, 145 bp, Homo sapiens; identical to SEQ ID NO: 267
  misc_feature 1..145: note = chr2:223161540-223161685
  misc_feature 1..145: note = hyper
  source 1..145: mol_type = genomic DNA

SEQ ID NO: 2171 - DNA, 220 bp, Homo sapiens; identical to SEQ ID NO: 268
  misc_feature 1..220: note = chr2:223161806-223162026
  misc_feature 1..220: note = hyper
  source 1..220: mol_type = genomic DNA

SEQ ID NO: 2172 - DNA, 32 bp, Homo sapiens; identical to SEQ ID NO: 269
  misc_feature 1..32: note = chr2:223162859-223162891
  misc_feature 1..32: note = hyper
  source 1..32: mol_type = genomic DNA

SEQ ID NO: 2173 - DNA, 297 bp, Homo sapiens; identical to SEQ ID NO: 270
  misc_feature 1..297: note = chr2:223162928-223163225
  misc_feature 1..297: note = hyper
  source 1..297: mol_type = genomic DNA

SEQ ID NO: 2174 - DNA, 337 bp, Homo sapiens; identical to SEQ ID NO: 271
  misc_feature 1..337: note = chr2:223163472-223163809
  misc_feature 1..337: note = hyper
  source 1..337: mol_type = genomic DNA

SEQ ID NO: 2175 - DNA, 193 bp, Homo sapiens; identical to SEQ ID NO: 272
  misc_feature 1..193: note = chr2:223163810-223164003
  misc_feature 1..193: note = hyper
  source 1..193: mol_type = genomic DNA

SEQ ID NO: 2176 - DNA, 300 bp, Homo sapiens
  misc_feature 1..300: note = chr2:223167250-223167550
  misc_feature 1..300: note = hyper
  source 1..300: mol_type = genomic DNA
aagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgatcatgagcttccggtccggatgtgatgatacaggattggtgaatgcccgggttaaacccgtggtccttcgcagccgctgcctcagtgacagtcattaggccccccgcagttatttgtcaaaagcattggcgccgctcttctccccatcgaaaaatcagtcgg

SEQ ID NO: 2177 - DNA, 416 bp, Homo sapiens; identical to SEQ ID NO: 273
  misc_feature 1..416: note = chr2:223176096-223176512
  misc_feature 1..416: note = hyper
  source 1..416: mol_type = genomic DNA

SEQ ID NO: 2178 - DNA, 307 bp, Homo sapiens; identical to SEQ ID NO: 274
  misc_feature 1..307: note = chr2:223176719-223177026
  misc_feature 1..307: note = hyper
  source 1..307: mol_type = genomic DNA

SEQ ID NO: 2179 - DNA, 232 bp, Homo sapiens
  misc_feature 1..232: note = chr2:230578195-230578427
  misc_feature 1..232: note = hyper
  source 1..232: mol_type = genomic DNA
gggcggccctgccagcgccacgtacaatgccccctcgaatgcctccgactgttccaacactgctcctaagcttagagagggctggtcgcaggccgaggggaggcagctgccctcctcgtcctctggctgctttgtcacagccctcaagggcgtaggaagagaaggagaaagtgccccaccacctggcacggggcccaccatcacctgcctcccacaccgcacaccctttaca

SEQ ID NO: 2180 - DNA, 352 bp, Homo sapiens
  misc_feature 1..352: note = chr2:232791677-232792029
  misc_feature 1..352: note = hyper
  source 1..352: mol_type = genomic DNA
gactggggtgggaggcgcagggagagcggggttcgcctgggccgcaggggggagcgcaagtcttccacactggagagtgcaggggtgtcgccagcctgagtgtttgagcgcaaggcgggaacgaggggactgcgagcgcggaaccaagatattcatgctcatgcgtgtgctccgcggcatcgtatgctcgccagttactgctctaggttcacgttcagccggtttcggccacacagaacgtcccggggtctgactccgctggtgaactccctctgtgggaacaatgcgcacctgaccttgcctgcacccacgcgaggatccgctgctgggggaagcccgctccagtatcctg

SEQ ID NO: 2181 - DNA, 277 bp, Homo sapiens; identical to SEQ ID NO: 275
  misc_feature 1..277: note = chr2:233350263-233350540
  misc_feature 1..277: note = hyper
  source 1..277: mol_type = genomic DNA

SEQ ID NO: 2182 - DNA, 436 bp, Homo sapiens; identical to SEQ ID NO: 276
  misc_feature 1..436: note = chr2:233350843-233351279
  misc_feature 1..436: note = hyper
  source 1..436: mol_type = genomic DNA

SEQ ID NO: 2183 - DNA, 181 bp, Homo sapiens; identical to SEQ ID NO: 277
  misc_feature 1..181: note = chr2:233351415-233351596
  misc_feature 1..181: note = hyper
  source 1..181: mol_type = genomic DNA

SEQ ID NO: 2184 - DNA, 351 bp, Homo sapiens; identical to SEQ ID NO: 278
  misc_feature 1..351: note = chr2:233352101-233352452
  misc_feature 1..351: note = hyper
  source 1..351: mol_type = genomic DNA

SEQ ID NO: 2185 - DNA, 257 bp, Homo sapiens; identical to SEQ ID NO: 279
  misc_feature 1..257: note = chr2:233352506-233352763
  misc_feature 1..257: note = hyper
  source 1..257: mol_type = genomic DNA

SEQ ID NO: 2186 - DNA, 136 bp, Homo sapiens; identical to SEQ ID NO: 280
  misc_feature 1..136: note = chr2:233352775-233352911
  misc_feature 1..136: note = hyper
  source 1..136: mol_type = genomic DNA

SEQ ID NO: 2187 - DNA, 357 bp, Homo sapiens; identical to SEQ ID NO: 281
  misc_feature 1..357: note = chr2:237072641-237072998
  misc_feature 1..357: note = hyper
  source 1..357: mol_type = genomic DNA

SEQ ID NO: 2188 - DNA, 16 bp, Homo sapiens
  misc_feature 1..16: note = chr2:237072999-237073015
  misc_feature 1..16: note = hyper
  source 1..16: mol_type = genomic DNA
ctcacactcgctggcc

SEQ ID NO: 2189 - DNA, 440 bp, Homo sapiens; identical to SEQ ID NO: 283
  misc_feature 1..440: note = chr2:237073056-237073496
  misc_feature 1..440: note = hyper
  source 1..440: mol_type = genomic DNA

SEQ ID NO: 2190 - skipped

SEQ ID NO: 2191 - DNA, 377 bp, Homo sapiens; identical to SEQ ID NO: 285
  misc_feature 1..377: note = chr2:237082343-237082720
  misc_feature 1..377: note = hyper
  source 1..377: mol_type = genomic DNA

SEQ ID NO: 2192 - DNA, 202 bp, Homo sapiens
  misc_feature 1..202: note = chr2:237416164-237416366
  misc_feature 1..202: note = hyper
  source 1..202: mol_type = genomic DNA
tcgcgaacctcacttcggccactcaggtgggcgcgacgcggccctagcaacggaaacgccgcgcctgcgcattgccttccgcctgccccctccccccccccgccccccgcattccgcgcctgcgccaccgcgggaggcctgggtgggcgcagctgtgggagccggtcggagtccgagcgctccgtcgcggggcccggccgct

SEQ ID NO: 2193 - DNA, 43 bp, Homo sapiens
  misc_feature 1..43: note = chr2:238864588-238864631
  misc_feature 1..43: note = hyper
  source 1..43: mol_type = genomic DNA
ccaccatccaaagggcgacagggaggcgtccccccaaccccgg

SEQ ID NO: 2194 - DNA, 330 bp, Homo sapiens
  misc_feature 1..330: note = chr2:238864726-238865056
  misc_feature 1..330: note = hyper
  source 1..330: mol_type = genomic DNA
cgcggcccgggtaaccaggtcccatgtaaccgcagcctggtgaagccgtgcgccctgggcgcggctacttggccctcacggcagggcggagatgcgaggccccagggttcggccccgcagcgccgctgagtccaaggaccgagctgggagtgggggcggagccaagaaggggcgcccctgcgcccacaagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactca

SEQ ID NO: 2195 - DNA, 111 bp, Homo sapiens
  misc_feature 1..111: note = chr2:239140138-239140249
  misc_feature 1..111: note = hyper
  source 1..111: mol_type = genomic DNA
cgggggctgcagagccttcatctcttcctccgtcccgggatgtcggagagacggcagcccagcctccgccaccgcaaagctgcttaacgggcagcgcgagtccctcgggca

SEQ ID NO: 2196 - DNA, 187 bp, Homo sapiens; identical to SEQ ID NO: 286
  misc_feature 1..187: note = chr2:241393223-241393410
  misc_feature 1..187: note = hyper
  source 1..187: mol_type = genomic DNA

SEQ ID NO: 2197 - DNA, 301 bp, Homo sapiens
  misc_feature 1..301: note = chr2:241758377-241758678
  misc_feature 1..301: note = hyper
  source 1..301: mol_type = genomic DNA
ccctattcccggggacgtgggcgcgcatcgggtccgcgccgggcgacgtcgcgctcgcgcccagcaggccccatgacttggcattccctccttcccctccccctcccgcccctgcggccggcagggcccccccaaccccacctaccggcgcccagcgccccgctcctgcggaccctccctcccggcggggatgctgccccggcccttcccagcgagagggcagcgcggctggtttgggggaagtcagcgtgaggagcggcttaaagcgggagtgcgaaggtcttcgcggccactgttcctt

SEQ ID NO: 2198 - DNA, 522 bp, Homo sapiens; identical to SEQ ID NO: 287
  misc_feature 1..522: note = chr3:239347-239869
  misc_feature 1..522: note = hyper
  source 1..522: mol_type = genomic DNA

SEQ ID NO: 2199 - DNA, 81 bp, Homo sapiens
  misc_feature 1..81: note = chr3:3840498-3840579
  misc_feature 1..81: note = hyper
  source 1..81: mol_type = genomic DNA
tcaaagtttcagaaacgttttcggaaagcctcctccaatgggaagcgacttcgccgctgagttaagcgtccgaatcctcct

SEQ ID NO: 2200 - DNA, 47 bp, Homo sapiens
  misc_feature 1..47: note = chr3:9595395-9595442
  misc_feature 1..47: note = hyper
  source 1..47: mol_type = genomic DNA
gggactggcacggcctaggcgccgcggctcggcgctcccagcagcgg

SEQ ID NO: 2201 - DNA, 334 bp, Homo sapiens
  misc_feature 1..334: note = chr3:9904291-9904625
  misc_feature 1..334: note = hyper
  source 1..334: mol_type = genomic DNA
gatccatgggaagatcgggtggctcaggggagtgactccccggcttggtcggcgctttgaggccccggggacccagcggagagggctcgggtgaggcatctggaggcgctgaatggggccgggagccgcgggacccgcagagggcgcctgtccgtgtgggcgcagcagcgcctagagggaggcggccccggcagcccgcaggggtcaggctctgctggagcaggggcgtccctgtctccgcttcccagcgcaggctgggtggggccgatggccattaaagccccgccccccgcggctcaccgccgcctggccccgtccccgaggccagaaaaga

SEQ ID NO: 2202 - DNA, 182 bp, Homo sapiens; identical to SEQ ID NO: 288
  misc_feature 1..182: note = chr3:11035171-11035353
  misc_feature 1..182: note = hyper
  source 1..182: mol_type = genomic DNA

SEQ ID NO: 2203 - skipped

SEQ ID NO: 2204 - DNA, 535 bp, Homo sapiens
  misc_feature 1..535: note = chr3:13323494-13324029
  misc_feature 1..535: note = hyper
  source 1..535: mol_type = genomic DNA
aggcaaacgggaacccggctggcgggctgcgagccggtagggacgctggggtccagggctgctggacagccccgccctgtacctctccccatccctcacttaatcctgggtccgaaatagccccgggtaatcccagggcgaggcagtcgggaattaaccccagccttgaagtaagagacagaggcgtccacagaagagggctctgcgcgtcccggactggacacagcgcagagtccattccagggacaccgcaacccgcaagcgacccaggcccgctccagggcgggatccgcgcggcccgcgacccctccctaccggtctcgggatctctgggtcggaagttctcgccctgctgctccgagacctaggtccgctccccggacagacctccgcccggctcgtccgagccccgggggtcgccaaccctgagtccgcgccgcagcgcagagccaggccggcgggagcgctgagcagctccctggagcccttttccagggaacccagtccccacccgagatcgagctccggatctggg

SEQ ID NO: 2205 - DNA, 114 bp, Homo sapiens
  misc_feature 1..114: note = chr3:13324234-13324348
  misc_feature 1..114: note = hyper
  source 1..114: mol_type = genomic DNA
gggatggcgccgagcggctgcgggccggggccggggcccgggtcggggcggcgggcgcacgcggccaggtgtcgccggtgtcgctccagcaggccggcgttctcccggctcagc

SEQ ID NO: 2206 - DNA, 19 bp, Homo sapiens
  misc_feature 1..19: note = chr3:13324419-13324438
  misc_feature 1..19: note = hyper
  source 1..19: mol_type = genomic DNA
gatccgggtcagctcctgc

SEQ ID NO: 2207 - DNA, 194 bp, Homo sapiens; identical to SEQ ID NO: 290
  misc_feature 1..194: note = chr3:13590447-13590641
  misc_feature 1..194: note = hyper
  source 1..194: mol_type = genomic DNA

SEQ ID NO: 2208 - DNA, 48 bp, Homo sapiens; identical to SEQ ID NO: 291
  misc_feature 1..48: note = chr3:13590973-13591021
  misc_feature 1..48: note = hyper
  source 1..48: mol_type = genomic DNA

SEQ ID NO: 2209 - DNA, 119 bp, Homo sapiens
  misc_feature 1..119: note = chr3:16554347-16554466
  misc_feature 1..119: note = hyper
  source 1..119: mol_type = genomic DNA
ttctggtggttccggcgcttcctcggagcgcgcggcatgtctgctcctacacgtccagcacctctgtccccagagcaaacccacctcccagggcacacgcagaggggcagtcaggcacc

SEQ ID NO: 2210 - DNA, 189 bp, Homo sapiens
  misc_feature 1..189: note = chr3:16554467-16554656
  misc_feature 1..189: note = hyper
  source 1..189: mol_type = genomic DNA
cctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggc

SEQ ID NO: 2211 - DNA, 45 bp, Homo sapiens
  misc_feature 1..45: note = chr3:26665077-26665122
  misc_feature 1..45: note = hyper
  source 1..45: mol_type = genomic DNA
tgtgttcttgccagtcgacttttcactccccgcagctctggctcc

SEQ ID NO: 2212 - DNA, 181 bp, Homo sapiens
  misc_feature 1..181: note = chr3:27765181-27765362
  misc_feature 1..181: note = hyper
  source 1..181: mol_type = genomic DNA
agctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttc

SEQ ID NO: 2213 - DNA, 367 bp, Homo sapiens
  misc_feature 1..367: note = chr3:28616764-28617131
  misc_feature 1..367: note = hyper
  source 1..367: mol_type = genomic DNA
ctttacgccaaactccggcgcgccgcgagactcgcgtcctcgctgtccccgaggggccccaccccttcccggttctaacctgcgacctggccagaggcaagggtaggtcgacttcctgcccggaatttgccgttggcttctccttctctactccagttctttagtgcagggctgtgcggcgcggagccgccagcggcagaacagaccccggagcggagctctgggatacacacacgcgcagcccggagggactgaccccggaggcgcgctcggccgggagagggaggggaccagggccagcgcggaggcgggggtcacctggggttgggggtgggcgcaccagccctccgcacgctcctctctttct

SEQ ID NO: 2214 - DNA, 306 bp, Homo sapiens
  misc_feature 1..306: note = chr3:28617343-28617649
  misc_feature 1..306: note = hyper
  source 1..306: mol_type = genomic DNA
ggtagggaggagaaacgccaaggggccccaagagacgctggaaagcggctaggagcgtgggccgggctggagagcaagtacccaagcggccctgaggctgggagcgcggctgggaggcgccgccgccgccgccgccgccgccgccgggatgcgctctgcttagcgggactgccgggggcgcctgaaggccagcgctccaaggacacgcggccacccgctcctcgcgcaccccggcccagacgccgccagggccggagccaagcaggcgagcggagctgcggggagcgggggcgaagggtggcagaa

SEQ ID NO: 2215 - DNA, 606 bp, Homo sapiens; identical to SEQ ID NO: 292
  misc_feature 1..606: note = chr3:32858353-32858959
  misc_feature 1..606: note = hyper
  source 1..606: mol_type = genomic DNA

SEQ ID NO: 2216 - DNA, 30 bp, Homo sapiens; identical to SEQ ID NO: 293
  misc_feature 1..30: note = chr3:32859255-32859285
  misc_feature 1..30: note = hyper
  source 1..30: mol_type = genomic DNA

SEQ ID NO: 2217 - DNA, 800 bp, Homo sapiens; identical to SEQ ID NO: 294
  misc_feature 1..800: note = chr3:32859417-32860217
  misc_feature 1..800: note = hyper
  source 1..800: mol_type = genomic DNA

SEQ ID NO: 2218 - DNA, 770 bp, Homo sapiens
  misc_feature 1..770: note = chr3:33260026-33260796
  misc_feature 1..770: note = hyper
  source 1..770: mol_type = genomic DNA
gctgggtcgcaggaccgcggctcgttcgttcctctcaggcttgcgcttgccgcttgccgggccggtcagagggagcagccccggcgagctacgccctccctgcccggaccccacgctccaccccccgccccgccgcctcccgcacactcaccatccgcccgcaccgaaaggcgcggcagaccgagcaggagcagcgccgccgcccagagcccggggaggcgtctgtgccaacgggcaggcgggctgggtccctcggcagtcatggtccgggagtgcgcgggccagcggactcgggtgagggctctggctgcgtttggggttgcccaggccactgcccagcgtgcgccactcggctctgcgctctgcgctcggctcacgaatcgcaggcttcgcgccgggcgcgccgagagggaggagcgcggagagccgggggaggctcgggacgcagagccggagcgcctgggccgccgaactcccgggggtcttctctgtggcgccgaggaggcggctgtaacccggctccgccttcgcgctgggcacctggaaacctcggtgccaaaaggggctgcgctgggccgcgcgctctgcgggtacagcggggcggagggcgagggcgcagggaggcggggagagtagctagccggccgcaaggagcccccgcccgtctgggggacccttggcgagagggtgacgcagtctgacaggcggagcccctccggcagggccgttagacaacgagtgtctaactctgtcctcggcctctacttttc

SEQ ID NO: 2219 - DNA, 240 bp, Homo sapiens
  misc_feature 1..240: note = chr3:38035773-38036013
  misc_feature 1..240: note = hyper
  source 1..240: mol_type = genomic DNA
cgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatgtgagtgcgggggcgaccggggcaggagggagccgtggaggcggtgccttggctgg

SEQ ID NO: 2220 - DNA, 854 bp, Homo sapiens
  misc_feature 1..854: note = chr3:44036274-44037128
  misc_feature 1..854: note = hyper
  source 1..854: mol_type = genomic DNA
gcgttggtgtgagaacgagcgagagaaagcgggagcaagagcgagagctatgcctcccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgc

SEQ ID NO: 2221 - DNA, 1765 bp, Homo sapiens
  misc_feature 1..1765: note = chr3:44037129-44038894
  misc_feature 1..1765: note = hyper
  source 1..1765: mol_type = genomic DNA
ggggccggcgggttccacgtgggtggaccccgagctgagggcagggtagggtcgcggatcgctgacctatgagctcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtcacttcaagcccacagcgagttgctcgtgtcctcggcttctgctccgcaaatctcggacgatgccaccggaggacgctgaaggcaaaggctggtggggccaggcgccggcgagactgccgcgctagcacagcttccgcgggagccgagtgctgacgggcctcgcgaccccctcccgagggcaaacggctcggccctccagggacacttggtcagtgtcactctctccctaccgggtgtcgcgcattttctcaacagaacgtgaccccgtagacggatgaactcggaatcggcaaaacccgcctgcccttgtctagtctctctgccccaccacaccactgcccttcactgcggactgcgccgtgtgcgctccgggaccgcccctgcacctttgcccacagcttcccattaccaaggcagccggaggaagacctttccgagttacctgtctcacgtcagcagccacaccgaggcggtccccctcgcaccactccccaagtgcagagcccctgaaagtccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagac

SEQ ID NO: 2222 - DNA, 602 bp, Homo sapiens
  misc_feature 1..602: note = chr3:44039424-44040026
  misc_feature 1..602: note = hyper
  source 1..602: mol_type = genomic DNA
tgttcctccccatcccgccaccaccaccaccggtccccgggctctgctgagcgctgcggcggtcttggctgaaaactgcgtccccgcccaaatcgagcgcaaaactcccttggacagaagtttgaaagaatccagtgtagaaacagacttctccgtccaatttggttttaatcagtaatcatataagtatacccacataaccacctaagtggagagcagacgcccagattcacggtccccacgtgttgctggagttggcgcagacgcgtgtgcgggcatagcggcggacgtgacaccgcattttctccgaattcctgccatctagggtggtgccgccccaagagggggccgtggggaggtggggtaataggctgcgcaatccacttgctctgggggagcttagggttcagagcagagcgcaactccggggggctgtcgcacagccccattctcccacaccagaagagcaatgctccttatggatgattaatagccgggcttctcctgaccatgcggcgcgtccctgccggcaccacttagttgttttaatttgacctttattagcaacgtgctcccagaggctgcgagttggattcgcacca

SEQ ID NO: 2223 - DNA, 1039 bp, Homo sapiens
  misc_feature 1..1039: note = chr3:44040056-44041095
  misc_feature 1..1039: note = hyper
  source 1..1039: mol_type = genomic DNA
cggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcga

SEQ ID NO: 2224 - DNA, 321 bp, Homo sapiens; identical to SEQ ID NO: 295
  misc_feature 1..321: note = chr3:44063500-44063821
  misc_feature 1..321: note = hyper
  source 1..321: mol_type = genomic DNA

SEQ ID NO: 2225 - DNA, 87 bp, Homo sapiens
  misc_feature 1..87: note = chr3:44626451-44626538
  misc_feature 1..87: note = hyper
  source 1..87: mol_type = genomic DNA
acgcagttccttctgcgctttgttcaagatgtgggtctggcgctttcggtgaggggtgctctacagtctggcgtggggggtcgggcc

SEQ ID NO: 2226 - DNA, 13 bp, Homo sapiens
  misc_feature 1..13: note = chr3:44626539-44626552
  misc_feature 1..13: note = hyper
  source 1..13: mol_type = genomic DNA
ggttctgggagcg

SEQ ID NO: 2227 - DNA, 409 bp, Homo sapiens; identical to SEQ ID NO: 296
  misc_feature 1..409: note = chr3:48693292-48693701
  misc_feature 1..409: note = hyper
  source 1..409: mol_type = genomic DNA

SEQ ID NO: 2228 - DNA, 31 bp, Homo sapiens; identical to SEQ ID NO: 297
  misc_feature 1..31: note = chr3:48693851-48693882
  misc_feature 1..31: note = hyper
  source 1..31: mol_type = genomic DNA

SEQ ID NO: 2229 - DNA, 272 bp, Homo sapiens; identical to SEQ ID NO: 298
  misc_feature 1..272: note = chr3:48693883-48694155
  misc_feature 1..272: note = hyper
  source 1..272: mol_type = genomic DNA

SEQ ID NO: 2230 - DNA, 164 bp, Homo sapiens; identical to SEQ ID NO: 299
  misc_feature 1..164: note = chr3:48698847-48699011
  misc_feature 1..164: note = hyper
  source 1..164: mol_type = genomic DNA

SEQ ID NO: 2231 - DNA, 363 bp, Homo sapiens; identical to SEQ ID NO: 300
  misc_feature 1..363: note = chr3:48699376-48699739
  misc_feature 1..363: note = hyper
  source 1..363: mol_type = genomic DNA

SEQ ID NO: 2232 - DNA, 443 bp, Homo sapiens; identical to SEQ ID NO: 301
  misc_feature 1..443: note = chr3:62353488-62353931
  misc_feature 1..443: note = hyper
  source 1..443: mol_type = genomic DNA

SEQ ID NO: 2233 - DNA, 168 bp, Homo sapiens
  misc_feature 1..168: note = chr3:62354625-62354793
  misc_feature 1..168: note = hyper
  source 1..168: mol_type = genomic DNA
tacttagaaagcaagcgtgagatcatttcatcagcgtgctcggcagcagagatagctattcaggaaatgggctaacggagcggtaatcaggacccaggaggcggcggcggcggcggcagcgagctcggggagcccgggcgcgccctccggcggcagggctcagggcac

SEQ ID NO: 2234 - DNA, 40 bp, Homo sapiens
  misc_feature 1..40: note = chr3:62354899-62354939
  misc_feature 1..40: note = hyper
  source 1..40: mol_type = genomic DNA
cggtggttgccctccttaggtctcccggagaaggggacgc

SEQ ID NO: 2235 - DNA, 446 bp, Homo sapiens; identical to SEQ ID NO: 302
  misc_feature 1..446: note = chr3:62355774-62356220
  misc_feature 1..446: note = hyper
  source 1..446: mol_type = genomic DNA

SEQ ID NO: 2236 - DNA, 279 bp, Homo sapiens; identical to SEQ ID NO: 303
  misc_feature 1..279: note = chr3:62356366-62356645
  misc_feature 1..279: note = hyper
  source 1..279: mol_type = genomic DNA

SEQ ID NO: 2237 - DNA, 367 bp, Homo sapiens; identical to SEQ ID NO: 304
  misc_feature 1..367: note = chr3:62356792-62357159
  misc_feature 1..367: note = hyper
  source 1..367: mol_type = genomic DNA

SEQ ID NO: 2238 - DNA, 1051 bp, Homo sapiens; identical to SEQ ID NO: 305
  misc_feature 1..1051: note = chr3:62359440-62360491
  misc_feature 1..1051: note = hyper
  source 1..1051: mol_type = genomic DNA

SEQ ID NO: 2239 - DNA, 581 bp, Homo sapiens
  misc_feature 1..581: note = chr3:62363596-62364177
  misc_feature 1..581: note = hyper
  source 1..581: mol_type = genomic DNA
caatacataacacagcgccctatgtatgccatctccccagggagccgagcagcttgggaggagaaggcttgcttgcggctcccgagtttggggaaacacgggcactggggaccccgctccttcctgactttttttttttgggggggggggaggaaccaatcctgaaacaaacaaactttatggtttaaggaatgtcttttcttattccctccctccttccctccctccctccctccttcttccctccagctctccttccttcctcctttcctttcttttcttccttctttccaaaggaacatttagaatctgatttacttggtgccgcgcttaaccgctgctgaaaatagattaacttctgaagagaaattcttttgctatcctctcttttttccccaggaagcattttattgaaaacattcgaactggcttgcccgtggcgggcttgtccaaagcacaggggcctccgccttcggtgcgcgttgttctcaggattagtgctgttgggagacaaagagccccagatacccgaggctgggagcgccggagagctcccaggtttcgggtaccctcccggagca

SEQ ID NO: 2240 - DNA, 373 bp, Homo sapiens
  misc_feature 1..373: note = chr3:62364753-62365126
  misc_feature 1..373: note = hyper
  source 1..373: mol_type = genomic DNA
atctgatccaatacccgcgtgcagcaatttgccagcagacgtgtcattttgtaaggcgcagtgagggaaggaagtcgtctcgcctacctgggttttccacttgctacgcgattttggtgtgcaacccaaaggaaataatcgtttatagagaacgatgatgatgtatttttatatatgatataacacacacatccgtgtatgcatatttgaaattaaaaggcgttttggtgactgactggccctgcgtagttgagagatgtcggtttccgactccctgggaagacggcttaggatcctccgcgttatttaacttggcagctggttaaactccgcggtggagcctgcccaaaggtattagcgttaagtgctgaga

SEQ ID NO: 2241 - DNA, 31 bp, Homo sapiens; identical to SEQ ID NO: 306
  misc_feature 1..31: note = chr3:68980916-68980947
  misc_feature 1..31: note = hyper
  source 1..31: mol_type = genomic DNA

SEQ ID NO: 2242 - DNA, 270 bp, Homo sapiens; identical to SEQ ID NO: 307
  misc_feature 1..270: note = chr3:68980948-68981218
  misc_feature 1..270: note = hyper
  source 1..270: mol_type = genomic DNA

SEQ ID NO: 2243 - DNA, 118 bp, Homo sapiens
  misc_feature 1..118: note = chr3:85008597-85008715
  misc_feature 1..118: note = hyper
  source 1..118: mol_type = genomic DNA
ccgccgatccgagtccgcgggttcgaacaccgcagcggtggggacggtgggtccggcgggcgccgggaggaggacaccagcggagccctgcactctcgtgccccgctcaccagcatct

SEQ ID NO: 2244 - DNA, 16 bp, Homo sapiens
  misc_feature 1..16: note = chr3:117715630-117715646
  misc_feature 1..16: note = hyper
  source 1..16: mol_type = genomic DNA
gtcgccaccacctcgc

SEQ ID NO: 2245 - DNA, 358 bp, Homo sapiens
  misc_feature 1..358: note = chr3:117715766-117716124
  misc_feature 1..358: note = hyper
  source 1..358: mol_type = genomic DNA
acacacacacacacacacacacacacacaagccctggcttctttccccatcaacaccgatgttgcagcaagtctgtccgcacaatcccgcacgcctcaggacccagcctgggcgcagagctggcagggcagggagcgcaccgcaggacttgtaaataaaccctgttccatccagaaccggagcgcttcttactccaccgaccaccccggagcccggcggcagggaggagggggcgcaaggggtcagggaatcctccccctaccttgcaatgagaagagggacaggaaaaagcccagcacccagacgctgtgcagccagtaggtcctcatgtctccgctgcgctcgatgctccctcgcg

SEQ ID NO: 2246 - DNA, 99 bp, Homo sapiens
  misc_feature 1..99: note = chr3:117716213-117716312
  misc_feature 1..99: note = hyper
  source 1..99: mol_type = genomic DNA
cggcaacccggacagacaagcctcttgccgcacgacggccggatcccagaacagccttgctctcctcttcgggagcgcaagccaggggccgggatggac

SEQ ID NO: 2247 - DNA, 368 bp, Homo sapiens
  misc_feature 1..368: note = chr3:117716313-117716681
  misc_feature 1..368: note = hyper
  source 1..368: mol_type = genomic DNA
ctcgtagcccgtgcctggtgtaaacacaccgagcccccttgtccctcgagctctcccgctttcctgcttcctatcctcctctccctcactcccctgcagcttcaactaaatgcgatgtacttaaacaagcagcgccttataggaccgcgaaccgagccgaaagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttgg

SEQ ID NO: 2248 - DNA, 39 bp, Homo sapiens
  misc_feature 1..39: note = chr3:120627972-120628011
  misc_feature 1..39: note = hyper
  source 1..39: mol_type = genomic DNA
taaaatactctgagccgaacgtttcgaagaaggaaagtc

SEQ ID NO: 2249 - DNA, 173 bp, Homo sapiens; identical to SEQ ID NO: 308
  misc_feature 1..173: note = chr3:121902777-121902950
  misc_feature 1..173: note = hyper
  source 1..173: mol_type = genomic DNA

SEQ ID NO: 2250 - DNA, 229 bp, Homo sapiens; identical to SEQ ID NO: 309
  misc_feature 1..229: note = chr3:121902990-121903219
  misc_feature 1..229: note = hyper
  source 1..229: mol_type = genomic DNA

SEQ ID NO: 2251 - DNA, 325 bp, Homo sapiens; identical to SEQ ID NO: 310
  misc_feature 1..325: note = chr3:121903323-121903648
  misc_feature 1..325: note = hyper
  source 1..325: mol_type = genomic DNA

SEQ ID NO: 2252 - DNA, 28 bp, Homo sapiens
  misc_feature 1..28: note = chr3:123166978-123167006
  misc_feature 1..28: note = hyper
  source 1..28: mol_type = genomic DNA
gccgccgccgccgcccgcagggggcgcc

SEQ ID NO: 2253 - DNA, 430 bp, Homo sapiens
  misc_feature 1..430: note = chr3:123167300-123167730
  misc_feature 1..430: note = hyper
  source 1..430: mol_type = genomic DNA
gcagagcggtgttcggggcctccccggggcgccggcgccgcagtcttctgcgccgcgtagcccggggggctcacgcttttggagccggacatccccccctcggcctcgtcgtctccttcctcctcccccggaagccgggccgggggtctccaaggggagggcggacggccgagcagggggaccaggctagggtcacacgtcgggggcggcccggggccctgcgctgcagcggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgaggg

SEQ ID NO: 2254 - DNA, 386 bp, Homo sapiens
  misc_feature 1..386: note = chr3:127794474-127794860
  misc_feature 1..386: note = hyper
  source 1..386: mol_type = genomic DNA
tgtgacttggaatctcggatccctgggctaggcctggccacgcccccatggggggaggggcagcgcggcgggggcggagcctgggcccgaaacgccacgggcgcgactctgtgcgcgtccgcccacacgggggcgctgtgtcctcgcaagctcccgcggggtgcctcgcggccctggaacgctgtggttttcgaggggaaaagtgagagtggctggtcctgcctccgctgccgcttggccctgagatccccactgcccacgggataggccccagtccacccagccggggccccccccttcccctcgtctcgctctccttggcagttcggacttcgggtcagtcccacactcgcgcccggctgtccctgctgcgctcctgtcactgg

SEQ ID NO: 2255 - DNA, 220 bp, Homo sapiens
  misc_feature 1..220: note = chr3:128273832-128274052
  misc_feature 1..220: note = hyper
  source 1..220: mol_type = genomic DNA
cctcagggttgggggcgccgtggccggtgagggagtgaggtcagaggggaggggagggctggcatccttgggaaggctcgaatagaggggaggcttggtgtgaacgataccctgccggctgcgtgtggaggggaggctgtggcctgggcggaaggcaggagtcccgggaggggcagcggggacggggaccctgaggcccaggggattgggctcaggggcc

SEQ ID NO: 2256 - DNA, 347 bp, Homo sapiens
  misc_feature 1..347: note = chr3:128274308-128274655
  misc_feature 1..347: note = hyper
  source 1..347: mol_type = genomic DNA
gctcctgtaacaggctggggcttggcccggcccgcggccgccccgccaggaagcgccccgtccgccccctcggggcgcgtccgcggcaggcacttttgaggacaggaaggggagaggtgacctgagcatccacgcagctgtggcattcggggacgggccgaggactgggtttcttgccatcctcagcgctgggggtgactccaagcccccgggtgggggtggggagtggccgggcatggcgcccggctccacaatgcatcgccttacccggccggaattcctgcaggacgctttgttctcagatggcagcgctgctagagccatcggacctgtgaggggggggcgcc

SEQ ID NO: 2257 - DNA, 184 bp, Homo sapiens
  misc_feature 1..184: note = chr3:128720163-128720347
  misc_feature 1..184: note = hyper
  source 1..184: mol_type = genomic DNA
cgtgagtgaggagaggagagcgtgggagtcacgcggagaagccagacccagacgccgaccgggcactggtggcgctgccggggtcccgggggttcctggaccccctaccccaggcccctccaaagcaactggggtaaaccagacgcactgtgaggccagcgcagctgctggacacggtccccgg

SEQ ID NO: 2258 - DNA, 116 bp, Homo sapiens
  misc_feature 1..116: note = chr3:128720418-128720534
  misc_feature 1..116: note = hyper
  source 1..116: mol_type = genomic DNA
cggggcgaagggaccggaggagggaccggaggagcgaggcgcgcggcgcagcgatggagccggtcagcacgggcgcggaggccggcatggagggcgcgggaggtgacccgtaccgg

SEQ ID NO: 2259 - DNA, 23 bp, Homo sapiens
  misc_feature 1..23: note = chr3:128720566-128720589
  misc_feature 1..23: note = hyper
  source 1..23: mol_type = genomic DNA
cgccctggcgcaccactacgggc

SEQ ID NO: 2260 - DNA, 54 bp, Homo sapiens
  misc_feature 1..54: note = chr3:128720830-128720884
  misc_feature 1..54: note = hyper
  source 1..54: mol_type = genomic DNA
cggggactcagataccgatgaagaggcgcgcctggcgctgcgcgccgagccgcc

SEQ ID NO: 2261 - DNA, 430 bp, Homo sapiens
  misc_feature 1..430: note = chr3:128720885-128721315
  misc_feature 1..430: note = hyper
  source 1..430: mol_type = genomic DNA
gagctcaccttccgccagttccacgcgcgcctctgtggctacttcggcacccgtgcggggccccggctgccccgcggcgctctcagcgagcacatcgagacgcagatccgcctgcgccgtccgcgccgccgccgccgcccgccctgcgcgcctggccccgacagcggtcctgactgtgagcgcgttgcgcggctggaggaggagaatagcagcttgcgcgagttggtggaggacctgcgcgccgcgctgcagagcagtgatgcgcgctgcctagcactgcaggtgcgcgccggccacgaagggagggtggtaacgcccgggagagggctcgaactaaaagctggctggctgcggagcccgacaggacagagtcagaggaaggggagacagagggcagccccacaccatcccactccgcatcagcacactt

SEQ ID NO: 2262 - DNA, 82 bp, Homo sapiens
  misc_feature 1..82: note = chr3:128764525-128764607
  misc_feature 1..82: note = hyper
  source 1..82: mol_type = genomic DNA
ctgggccctaagggccgggcctcgaccccccgcaggtccccgcggtcccggtcccccgcccgggacatctgatggaccgagc

SEQ ID NO: 2263 - DNA, 92 bp, Homo sapiens; identical to SEQ ID NO: 311
  misc_feature 1..92: note = chr3:129693108-129693200
  misc_feature 1..92: note = hyper
  source 1..92: mol_type = genomic DNA

SEQ ID NO: 2264 - DNA, 195 bp, Homo sapiens; identical to SEQ ID NO: 312
  misc_feature 1..195: note = chr3:129693304-129693499
  misc_feature 1..195: note = hyper
  source 1..195: mol_type = genomic DNA

SEQ ID NO: 2265 - DNA, 259 bp, Homo sapiens; identical to SEQ ID NO: 313
  misc_feature 1..259: note = chr3:129693954-129694213
  misc_feature 1..259: note = hyper
  source 1..259: mol_type = genomic DNA

SEQ ID NO: 2266 - DNA, 93 bp, Homo sapiens
  misc_feature 1..93: note = chr3:130235834-130235927
  misc_feature 1..93: note = hyper
  source 1..93: mol_type = genomic DNA
caagaggggagaagccggtggagcagtaacagccttcataatgtctccagtcccgcttccgtcacctccctaaggctgcgcccccctcctggg

SEQ ID NO: 2267 - DNA, 175 bp, Homo sapiens
  misc_feature 1..175: note = chr3:134515771-134515946
  misc_feature 1..175: note = hyper
  source 1..175: mol_type = genomic DNA
aaactcccccaaacacgatggtttggtgccccccgccattccggaaagctctgcccttctggaagtgaagctggaggggcattccgggccctgaggcgcggctaagattcccttcccttttggcgaagaccaccgcatcccacgtttgttctggtggcggcgtgggggtgcggcg

SEQ ID NO: 2268 - DNA, 165 bp, Homo sapiens
  misc_feature 1..165: note = chr3:137479522-137479687
  misc_feature 1..165: note = hyper
  source 1..165: mol_type = genomic DNA
ggccggagggtggggcggagccttgtggcaaggcaggtgggtgcaggcctctggggccccagactgccgcgtctggctctaccaggctgtgtctcgggccccgtgcctgcagctgcaaggcggggaaagacctatcgggaagatccacctcggcctgggcagaag

SEQ ID NO: 2269 - DNA, 698 bp, Homo sapiens; identical to SEQ ID NO: 314
  misc_feature 1..698: note = chr3:137479943-137480641
  misc_feature 1..698: note = hyper
  source 1..698: mol_type = genomic DNA

SEQ ID NO: 2270 - DNA, 145 bp, Homo sapiens; identical to SEQ ID NO: 315
  misc_feature 1..145: note = chr3:137481170-137481315
  misc_feature 1..145: note = hyper
  source 1..145: mol_type = genomic DNA

SEQ ID NO: 2271 - DNA, 283 bp, Homo sapiens
  misc_feature 1..283: note = chr3:137484405-137484688
  misc_feature 1..283: note = hyper
  source 1..283: mol_type = genomic DNA
ctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 2272 - DNA, 519 bp, Homo sapiens; identical to SEQ ID NO: 316
  misc_feature 1..519: note = chr3:137488807-137489326
  misc_feature 1..519: note = hyper
  source 1..519: mol_type = genomic DNA

SEQ ID NO: 2273 - DNA, 15 bp, Homo sapiens
  misc_feature 1..15: note = chr3:137489684-137489699
  misc_feature 1..15: note = hyper
  source 1..15: mol_type = genomic DNA
agagaaagacctgac

SEQ ID NO: 2274 - DNA, 1135 bp, Homo sapiens; identical to SEQ ID NO: 318
  misc_feature 1..1135: note = chr3:137489875-137491010
  misc_feature 1..1135: note = hyper
  source 1..1135: mol_type = genomic DNA

SEQ ID NO: 2275 - DNA, 171 bp, Homo sapiens
  misc_feature 1..171: note = chr3:138657617-138657788
  misc_feature 1..171: note = hyper
  source 1..171: mol_type = genomic DNA
cgattccatttctggggatcgggtccggtggggagccactgtccctaacgcctccagagactttaagtaggacaatataatgctggtaggagcaaggtgcaaggaatttagcggcagaagcctttcgggggggtggggaaaggcagatccgtgcctcgtctgagcctgggg

SEQ ID NO: 2276 - DNA, 161 bp, Homo sapiens; identical to SEQ ID NO: 319
  misc_feature 1..161: note = chr3:138658703-138658864
  misc_feature 1..161: note = hyper
  source 1..161: mol_type = genomic DNA

SEQ ID NO: 2277 - DNA, 93 bp, Homo sapiens
  misc_feature 1..93: note = chr3:138662087-138662180
  misc_feature 1..93: note = hyper
  source 1..93: mol_type = genomic DNA
ccctgaggttcctaccgcctgaccactggagggctgaagtgagaggcctgcaggctcattcccgtggcgcaaaaccgctcctggcccaccagc

SEQ ID NO: 2278 - DNA, 167 bp, Homo sapiens
  misc_feature 1..167: note = chr3:138662281-138662448
  misc_feature 1..167: note = hyper
  source 1..167: mol_type = genomic DNA
cgcaagaaccggcggatctatcctatcagaagtcggaagtcatctatcccatcagaagagtgaaagccgaccaccccctaatccgcctgggagaaccagactgcaaccaggtcaaacgcctgtgtgcctgcgcggaagcatggatcttaattcgttatttggggatc

SEQ ID NO: 2279 - DNA, 42 bp, Homo sapiens
  misc_feature 1..42: note = chr3:138664141-138664183
  misc_feature 1..42: note = hyper
  source 1..42: mol_type = genomic DNA
ggaaagagacgagcccagtagaaagcgcgcagagaggcagct

SEQ ID NO: 2280 - DNA, 303 bp, Homo sapiens
  misc_feature 1..303: note = chr3:138664928-138665231
  misc_feature 1..303: note = hyper
  source 1..303: mol_type = genomic DNA
gggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaa

SEQ ID NO: 2281 - DNA, 668 bp, Homo sapiens; identical to SEQ ID NO: 320
  misc_feature 1..668: note = chr3:138665557-138666225
  misc_feature 1..668: note = hyper
  source 1..668: mol_type = genomic DNA

SEQ ID NO: 2282 - DNA, 352 bp, Homo sapiens
  misc_feature 1..352: note = chr3:138668757-138669109
  misc_feature 1..352: note = hyper
  source 1..352: mol_type = genomic DNA
cgccagggccggttccttttctccccgcggcattggggcgacgcagggcccccggcttagtgaccttggggcggcgctcacctccaaaggccagggtggtgggctgggcagaactcactgcctctttgccccagttttccagggtcccgcagctgcaattcagcagccaccggcgcctcctgaccgtggtcccaccgtagcgccgcctgcggatacggttccagtgaaccgccgattgagcgcagtctcagctcccgcgcctcctcgcagcctggccccgcgcctcggaggtcccgacagccggcgcgagcaatctacacggctctgatacagacgcttttctccccagggc

SEQ ID NO: 2283 - DNA, 196 bp, Homo sapiens
  misc_feature 1..196: note = chr3:138669140-138669336
  misc_feature 1..196: note = hyper
  source 1..196: mol_type = genomic DNA
cgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagag

SEQ ID NO: 2284 - DNA, 105 bp, Homo sapiens; identical to SEQ ID NO: 321
  misc_feature 1..105: note = chr3:138679188-138679293
  misc_feature 1..105: note = hyper
  source 1..105: mol_type = genomic DNA

SEQ ID NO: 2285 - DNA, 82 bp, Homo sapiens; identical to SEQ ID NO: 322
  misc_feature 1..82: note = chr3:139653491-139653573
  misc_feature 1..82: note = hyper
  source 1..82: mol_type = genomic DNA

SEQ ID NO: 2286 - DNA, 298 bp, Homo sapiens; identical to SEQ ID NO: 323
  misc_feature 1..298: note = chr3:139653574-139653872
  misc_feature 1..298: note = hyper
  source 1..298: mol_type = genomic DNA

SEQ ID NO: 2287 - DNA, 682 bp, Homo sapiens; identical to SEQ ID NO: 324
  misc_feature 1..682: note = chr3:139653873-139654555
  misc_feature 1..682: note = hyper
  source 1..682: mol_type = genomic DNA

SEQ ID NO: 2288 - DNA, 674 bp, Homo sapiens; identical to SEQ ID NO: 325
  misc_feature 1..674: note = chr3:140769628-140770302
  misc_feature 1..674: note = hyper
  source 1..674: mol_type = genomic DNA

SEQ ID NO: 2289 - DNA, 183 bp, Homo sapiens; identical to SEQ ID NO: 326
  misc_feature 1..183: note = chr3:140770407-140770590
  misc_feature 1..183: note = hyper
  source 1..183: mol_type = genomic DNA

SEQ ID NO: 2290 - DNA, 40 bp, Homo sapiens; identical to SEQ ID NO: 327
  misc_feature 1..40: note = chr3:140770643-140770683
  misc_feature 1..40: note = hyper
  source 1..40: mol_type = genomic DNA

SEQ ID NO: 2291 - DNA, 356 bp, Homo sapiens; identical to SEQ ID NO: 328
  misc_feature 1..356: note = chr3:140770684-140771040
  misc_feature 1..356: note = hyper
  source 1..356: mol_type = genomic DNA

SEQ ID NO: 2292 - DNA, 355 bp, Homo sapiens; identical to SEQ ID NO: 329
  misc_feature 1..355: note = chr3:141516389-141516744
  misc_feature 1..355: note = hyper
  source 1..355: mol_type = genomic DNA

SEQ ID NO: 2293 - DNA, 207 bp, Homo sapiens
  misc_feature 1..207: note = chr3:142838112-142838319
  misc_feature 1..207: note = hyper
  source 1..207: mol_type = genomic DNA
gggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgca

SEQ ID NO: 2294 - DNA, 168 bp, Homo sapiens
  misc_feature 1..168: note = chr3:142838479-142838647
  misc_feature 1..168: note = hyper
  source 1..168: mol_type = genomic DNA
cgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccgg

SEQ ID NO: 2295 - DNA, 160 bp, Homo sapiens
  misc_feature 1..160: note = chr3:142838876-142839036
  misc_feature 1..160: note = hyper
  source 1..160: mol_type = genomic DNA
cgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtccc

SEQ ID NO: 2296 - DNA, 86 bp, Homo sapiens
  misc_feature 1..86: note = chr3:142839440-142839526
  misc_feature 1..86: note = hyper
  source 1..86: mol_type = genomic DNA
ggagggagattggggcgcatccgctcactccgcttcccctcgcaggtcctacccggagccgctgccatgggagagccagccttggg

SEQ ID NO: 2297 - DNA, 16 bp, Homo sapiens
  misc_feature 1..16: note = chr3:142839562-142839578
  misc_feature 1..16: note = hyper
  source 1..16: mol_type = genomic DNA
cggcccgagtcccggc

SEQ ID NO: 2298 - DNA, 110 bp, Homo sapiens
  misc_feature 1..110: note = chr3:142839579-142839689
  misc_feature 1..110: note = hyper
  source 1..110: mol_type = genomic DNA
ccagcagccagcccgctgcgtccccttcccgggctgcagggctgcctccgccgcgccgccggcccggattgtgcctgtgatgagccgcagcccgcagcgagctctgcccc

SEQ ID NO: 2299 - DNA, 119 bp, Homo sapiens
  misc_feature 1..119: note = chr3:142839783-142839902
  misc_feature 1..119: note = hyper
  source 1..119: mol_type = genomic DNA
cgcgtcccctctcggaatgaaggtgttccgtaggaaggcgctggtgttgtgcgcgggctatgcactgctgctggtgctcactatgctcaacctcctggactacaagtggcacaaggagc

SEQ ID NO: 2300 - DNA, 47 bp, Homo sapiens
  misc_feature 1..47: note = chr3:142839944-142839991
  misc_feature 1..47: note = hyper
  source 1..47: mol_type = genomic DNA
cgggggcagccggaggcagctgggggcgcccagggccgcctccggcc

SEQ ID NO: 2301 - DNA, 136 bp, Homo sapiens
  misc_feature 1..136: note = chr3:142839992-142840128
  misc_feature 1..136: note = hyper
  source 1..136: mol_type = genomic DNA
ggccgccccgtgctcatgcccgtttggacctccgcactccttaccgccctcccgctgccgccgtcggggcggctcctgcagccgcggcagggatggcgggggttgcggcccctccaggcaatggcactcggggcac

SEQ ID NO: 2302 - DNA, 33 bp, Homo sapiens
  misc_feature 1..33: note = chr3:142840221-142840254
  misc_feature 1..33: note = hyper
  source 1..33: mol_type = genomic DNA
cgaggtgttctttctctacgagccagtgtggca

SEQ ID NO: 2303 - DNA, 229 bp, Homo sapiens; identical to SEQ ID NO: 330
  misc_feature 1..229: note = chr3:147078959-147079188
  misc_feature 1..229: note = hyper
  source 1..229: mol_type = genomic DNA

SEQ ID NO: 2304 - DNA, 90 bp, Homo sapiens
  misc_feature 1..90: note = chr3:147108806-147108896
  misc_feature 1..90: note = hyper
  source 1..90: mol_type = genomic DNA
ggcagacggtgtagccgaatcgtagccagagctgggcggcggcgagcgcccgtgcaccttcatgtgcttacgcagcgagctggggtgcgt

SEQ ID NO: 2305 - DNA, 387 bp, Homo sapiens
  misc_feature 1..387: note = chr3:147109225-147109612
  misc_feature 1..387: note = hyper
  source 1..387: mol_type = genomic DNA
cgcctccatccctcccgccttcctcctctgggctcatggggagggtatggaggaggagcgacagtgactccatcttagtcgagtttccatcctcgaaaatcctgatccactcgggttgtttcctccaaattttctccacttggaaccagaagcacctctgctcggaaatacattaacggaggagctcacaatatagttaacggggaagctcacatctgctcgatttaaagttgctgtttcagactaacttctctgccgctaccccgcccagccgttcatcccccccacccacccccatcctggcccaaattgtttcctaaagtaggttttgcgcaaacgccaaagcgatgaaataatttaaggatgcgcagccgatgcacattgtgt

SEQ ID NO: 2306 - DNA, 497 bp, Homo sapiens; identical to SEQ ID NO: 331
  misc_feature 1..497: note = chr3:147110228-147110725
  misc_feature 1..497: note = hyper
  source 1..497: mol_type = genomic DNA

SEQ ID NO: 2307 - DNA, 231 bp, Homo sapiens
  misc_feature 1..231: note = chr3:147138768-147138999
  misc_feature 1..231: note = hyper
  source 1..231: mol_type = genomic DNA
aggactccaagctaacgatgacctgtgtgggccttgctctgaacagaaaactcaaactcagcgtgggttcccgcgtcttccccaaaaggccaaggcccaaagaacccttttcatttggcgaggggcttgaggaagggaggggctggggcgggagagggtcggggtctgcaagccagcggcccggcgcagcggacttgtccggctgctcagcttggcagctagcgtccgtgc

SEQ ID NO: 2308 - DNA, 226 bp, Homo sapiens
  misc_feature 1..226: note = chr3:153839727-153839953
  misc_feature 1..226: note = hyper
  source 1..226: mol_type = genomic DNA
taggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggaggga

SEQ ID NO: 2309 - DNA, 236 bp, Homo sapiens; identical to SEQ ID NO: 332
  misc_feature 1..236: note = chr3:156009064-156009300
  misc_feature 1..236: note = hyper
  source 1..236: mol_type = genomic DNA

SEQ ID NO: 2310 - DNA, 265 bp, Homo sapiens; identical to SEQ ID NO: 333
  misc_feature 1..265: note = chr3:156009318-156009583
  misc_feature 1..265: note = hyper
  source 1..265: mol_type = genomic DNA

SEQ ID NO: 2311 - DNA, 101 bp, Homo sapiens
  misc_feature 1..101: note = chr3:157812157-157812258
  misc_feature 1..101: note = hyper
  source 1..101: mol_type = genomic DNA
aggaggcaagggcgccgcgagctccccggatgcactggtcccacaggccgtgcccgagtggagcactgcgaatggggccaagaaattttggcctttctcgc

SEQ ID NO: 2312 - DNA, 209 bp, Homo sapiens
  misc_feature 1..209: note = chr3:157812436-157812645
  misc_feature 1..209: note = hyper
  source 1..209: mol_type = genomic DNA
cgcaccgcctcctttgacctcgggcttcccccgcgctccgctgcttggggcagactggccccgagagggagccaccatctcccctgctccagggtctccagggtccgaacccgtgttgggatctgggttaggattagggtttggagcttggagcctgcctgttaggacccccggccccggcgccgactggagctcgctggaggccacag

SEQ ID NO: 2313 - DNA, 60 bp, Homo sapiens
  misc_feature 1..60: note = chr3:157812973-157813033
  misc_feature 1..60: note = hyper
  source 1..60: mol_type = genomic DNA
ctctttcagtctttgcggaaggtcccgtcatcacaagagcccgcgcgggaaggaaagttc

SEQ ID NO: 2314 - skipped

SEQ ID NO: 2315 - DNA, 126 bp, Homo sapiens
  misc_feature 1..126: note = chr3:157821536-157821662
  misc_feature 1..126: note = hyper
  source 1..126: mol_type = genomic DNA
gcagactcgaccctaaacgcttaacccacagagatcaacaggttcaagcggaatattcgcgatcctcggtttctattggttgctcaaagccttttcatgcaaccagcagctcggatgtttaataaa

SEQ ID NO: 2316 - DNA, 59 bp, Homo sapiens
  misc_feature 1..59: note = chr3:157825176-157825235
  misc_feature 1..59: note = hyper
  source 1..59: mol_type = genomic DNA
aaagtgtttccttagcgcccggtcaaggacagctcgacttcgttcgtttcctctctgag

SEQ ID NO: 2317 - DNA, 342 bp, Homo sapiens
  misc_feature 1..342: note = chr3:172165443-172165785
  misc_feature 1..342: note = hyper
  source 1..342: mol_type = genomic DNA
tgagcgaggcacccacgacagcatcgccgcgcctcctccgccacagcttcctgccgatgagactgtagaggaccgtgagacagaagacaggaaggaagaagaagatgctggacacccacaccatgaccgtgagcagtccagagcgcaccgcaaactcggtggggcggcactcgttggtgtcccaagggtcggtgccgttctcgtgctccaccccgactagcacgaagatgggcccggcgctgcagaaggccacggcccagatgacgaagatgaccagcttcacccgccccttggtgaccaccaccttggcccggagtgggaagcagatggcgaagtagcgct

SEQ ID NO: 2318 - DNA, 368 bp, Homo sapiens
  misc_feature 1..368: note = chr3:172165866-172166234
  misc_feature 1..368: note = hyper
  source 1..368: mol_type = genomic DNA
cgccgaagttccagggccggtactgccagaggcgaacgaggtccaggggcatgcagaggaagatgagcagatcggagaaggccatgctggacaggtagaggttggtggtggtgcgcagctcgcggaagcgcgacaccaccagcatggtgagcaggttgccagcgatgcccaccacgaagagtgccacgcaggtggctgtgacgcccgccagcagcggcgcggggaagagctgcagcagctcgtcgcccagcgagtcgttgccgggggaagcatcccagtccaggtcggccagtgtgaggttgaaccccggctcttcgctgggcgtcgcgttccacatgctgccggctcagctgaacaggctctgggac

SEQ ID NO: 2319 - DNA, 49 bp, Homo sapiens
  misc_feature 1..49: note = chr3:172166235-172166284
  misc_feature 1..49: note = hyper
  source 1..49: mol_type = genomic DNA
tgactgcgctgggaggctggaccgagctggctcccgaggaggtccgctt

SEQ ID NO: 2320 - DNA, 257 bp, Homo sapiens
  misc_feature 1..257: note = chr3:172167660-172167917
  misc_feature 1..257: note = hyper
  source 1..257: mol_type = genomic DNA
cagcactgtggccagcgccacatccatcctaccgcaaagcgccgctggaggaatggcttccctgtcactcccaccgtttttaacttgcgcttctaacgcctcagtcctaccccacggaggagcagggcagactcccacgaagcacaggccggcgttagtcactgccttgaccatacacatcggcgctcacccgatgagataccacgtactgtgtatgagagagtatccccctcagttgaatgcgtttgtacttgcct

SEQ ID NO: 2321 - DNA, 120 bp, Homo sapiens
  misc_feature 1..120: note = chr3:173115047-173115167
  misc_feature 1..120: note = hyper
  source 1..120: mol_type = genomic DNA
tttgccagagttgagcgagacgaagccgtgtctaaataagtacatgacactaaatttccttttaaatccaccttttacaccatggccagtcgcttgtttaactcccgttcaagggacacg

SEQ ID NO: 2322 - DNA, 283 bp, Homo sapiens
  misc_feature 1..283: note = chr3:173302927-173303210
  misc_feature 1..283: note = hyper
  source 1..283: mol_type = genomic DNA
aatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgt

SEQ ID NO: 2323 - DNA, 858 bp, Homo sapiens; identical to SEQ ID NO: 334
  misc_feature 1..858: note = chr3:179168782-179169640
  misc_feature 1..858: note = hyper
  source 1..858: mol_type = genomic DNA

SEQ ID NO: 2324 - DNA, 255 bp, Homo sapiens; identical to SEQ ID NO: 335
  misc_feature 1..255: note = chr3:179754505-179754760
  misc_feature 1..255: note = hyper
  source 1..255: mol_type = genomic DNA

SEQ ID NO: 2325 - DNA, 70 bp, Homo sapiens; identical to SEQ ID NO: 336
  misc_feature 1..70: note = chr3:179754803-179754873
  misc_feature 1..70: note = hyper
  source 1..70: mol_type = genomic DNA

SEQ ID NO: 2326 - DNA, 286 bp, Homo sapiens; identical to SEQ ID NO: 337
  misc_feature 1..286: note = chr3:179755086-179755372
  misc_feature 1..286: note = hyper
  source 1..286: mol_type = genomic DNA

SEQ ID NO: 2327 - DNA, 27 bp, Homo sapiens
  misc_feature 1..27: note = chr3:181413421-181413448
  misc_feature 1..27: note = hyper
  source 1..27: mol_type = genomic DNA
gacccacccagccgggcccgatccctc

SEQ ID NO: 2328 - DNA, 483 bp, Homo sapiens
  misc_feature 1..483: note = chr3:181419975-181420458
  misc_feature 1..483: note = hyper
  source 1..483: mol_type = genomic DNA
gcggctctcgccttccggggctggaacccgactcagatgtgaagcggcactgagccgctgcgcaggttcgtgcccagcgccccctgttggacacagtaggagctgcgcagcgccagtcccagaaatcgctggaatcctgctctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactcttttgaaaggttctgcgatggtaaaacaggtaaagaaaagtgacgaaaaacaaagcatttttctgtagccgtggagaatcaagcaaagtatacttcctccgttttgtccacatttcaaaaaattaaacggaagatgctgctg

SEQ ID NO: 2329 - DNA, 743 bp, Homo sapiens; identical to SEQ ID NO: 338
  misc_feature 1..743: note = chr3:181421539-181422282
  misc_feature 1..743: note = hyper
  source 1..743: mol_type = genomic DNA

SEQ ID NO: 2330 - DNA, 422 bp, Homo sapiens
  misc_feature 1..422: note = chr3:181428388-181428810
  misc_feature 1..422: note = hyper
  source 1..422: mol_type = genomic DNA
ctgagcccctacccccgcccccatctcatcctcctctaacccgggccttgctgggctcccccttccccagtcccggccgccttctcccagtgtgcgctgcctgcacctgtgcctggagagcatcgaccccgcctcccaggccttgagcccctttgcggcgcagccccagccttgcgcggcctgggctttgcggccaccacaatggaaatctacggggaaaatgccagggctggttctgctggagtcctgggaactctgcgtgggagggagtttgtgactgcggcccaaaagccacctccatacagtgccgtgggatgccaggaagttgaaatcaccctcccccatcgcctgcacttttgagcgcccttccgtctgtgtctttccccagcccccatttgaaagccgcacgaccgaaacccttc

SEQ ID NO: 2331 - DNA, 348 bp, Homo sapiens
  misc_feature 1..348: note = chr3:181430741-181431089
  misc_feature 1..348: note = hyper
  source 1..348: mol_type = genomic DNA
ccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccct

SEQ ID NO: 2332 - DNA, 729 bp, Homo sapiens; identical to SEQ ID NO: 339
  misc_feature 1..729: note = chr3:181441019-181441748
  misc_feature 1..729: note = hyper
  source 1..729: mol_type = genomic DNA

SEQ ID NO: 2333 - DNA, 448 bp, Homo sapiens; identical to SEQ ID NO: 340
  misc_feature 1..448: note = chr3:181441962-181442410
  misc_feature 1..448: note = hyper
  source 1..448: mol_type = genomic DNA

SEQ ID NO: 2334 - DNA, 536 bp, Homo sapiens
  misc_feature 1..536: note = chr3:181443014-181443550
  misc_feature 1..536: note = hyper
  source 1..536: mol_type = genomic DNA
gaaggaatgggtccccgctgctcgaatgaaagattaattacatttgccccaaaagccccaattctaacggtctctatcgcggcttttgccgtcactgaaggaccgctgtctctggggtcttcagacatcggagtcctttgcaaatgaagagcccccaccatttggaattcgggtcaaggagaaagactctgagcctgcagcagtttttgtttttgcgtgtgcccgcctctccattttattcaacttcttctgcctgtcgggaagcagaacaatcgctccccacccacccccctccgccccgtttctaagataaacaggaggtgcaaaatgctttgcctgcacacgcgccctcgtggcccagtcttcctgcaacccccagcgcaccggccatgcatctgtctcccaaccagacgtgggagaagacatccccccttcactcttcccacctgcatttaaaaaccatcacattgactgctctagagtcaggttcacatttttggccctccatgccaccttccagtttcttcccggtccac

SEQ ID NO: 2335 - DNA, 91 bp, Homo sapiens
  misc_feature 1..91: note = chr3:181444434-181444525
  misc_feature 1..91: note = hyper
  source 1..91: mol_type = genomic DNA
cacgtgctgtgccttcgaaacgccgccgcgggccctgcctttcagagctgcggcagccggggctggcgtggagggggcgctgaaacaccgg

SEQ ID NO: 2336 - DNA, 157 bp, Homo sapiens
  misc_feature 1..157: note = chr3:181444612-181444769
  misc_feature 1..157: note = hyper
  source 1..157: mol_type = genomic DNA
cgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcgcctcccgcatc

SEQ ID NO: 2337 - DNA, 120 bp, Homo sapiens
  misc_feature 1..120: note = chr3:181444829-181444949
  misc_feature 1..120: note = hyper
  source 1..120: mol_type = genomic DNA
gcgtcttgcgcagcgcagacacctccactctggattgaaacgaaaaagctcgcggtaagagcagaaaattggtctattgatacattcgctccgagtgttgatcttggcatcaccgatagc

SEQ ID NO: 2338 - skipped

SEQ ID NO: 2339 - DNA, 474 bp, Homo sapiens
  misc_feature 1..474: note = chr3:181444990-181445464
  misc_feature 1..474: note = hyper
  source 1..474: mol_type = genomic DNA
cggattgccgagggcttgcaggcactcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacc

SEQ ID NO: 2340 - DNA, 15 bp, Homo sapiens
  misc_feature 1..15: note = chr3:181445710-181445725
  misc_feature 1..15: note = hyper
  source 1..15: mol_type = genomic DNA
cgtaacaccatcatc

SEQ ID NO: 2341 - DNA, 62 bp, Homo sapiens
  misc_feature 1..62: note = chr3:181445799-181445861
  misc_feature 1..62: note = hyper
  source 1..62: mol_type = genomic DNA
cggccagtctcagtttttctctgaataatccctgagggtaagtcctccgggcttttaaagag

SEQ ID NO: 2342 - DNA, 127 bp, Homo sapiens
  misc_feature 1..127: note = chr3:186079204-186079331
  misc_feature 1..127: note = hyper
  source 1..127: mol_type = genomic DNA
attctctgaggtgtccgtgttcgcttcagcttccctttaagtcgccctgcgcaggggctttgtggagtgcccccaaagtcctagaaccccgcgggacggtcggaggctttggcggccagacattagg

SEQ ID NO: 2343 - DNA, 130 bp, Homo sapiens; identical to SEQ ID NO: 341
  misc_feature 1..130: note = chr3:187387791-187387921
  misc_feature 1..130: note = hyper
  source 1..130: mol_type = genomic DNA

SEQ ID NO: 2344 - DNA, 183 bp, Homo sapiens; identical to SEQ ID NO: 342
  misc_feature 1..183: note = chr3:187388006-187388189
  misc_feature 1..183: note = hyper
  source 1..183: mol_type = genomic DNA

SEQ ID NO: 2345 - DNA, 406 bp, Homo sapiens; identical to SEQ ID NO: 343
  misc_feature 1..406: note = chr3:192126305-192126711
  misc_feature 1..406: note = hyper
  source 1..406: mol_type = genomic DNA

SEQ ID NO: 2346 - DNA, 63 bp, Homo sapiens; identical to SEQ ID NO: 344
  misc_feature 1..63: note = chr3:192126786-192126849
  misc_feature 1..63: note = hyper
  source 1..63: mol_type = genomic DNA

SEQ ID NO: 2347 - DNA, 110 bp, Homo sapiens; identical to SEQ ID NO: 345
  misc_feature 1..110: note = chr3:192126850-192126960
  misc_feature 1..110: note = hyper
  source 1..110: mol_type = genomic DNA

SEQ ID NO: 2348 - DNA, 49 bp, Homo sapiens; identical to SEQ ID NO: 346
  misc_feature 1..49: note = chr3:192126961-192127010
  misc_feature 1..49: note = hyper
  source 1..49: mol_type = genomic DNA

SEQ ID NO: 2349 - DNA, 59 bp, Homo sapiens; identical to SEQ ID NO: 347
  misc_feature 1..59: note = chr3:192127314-192127373
  misc_feature 1..59: note = hyper
  source 1..59: mol_type = genomic DNA

SEQ ID NO: 2350 - DNA, 175 bp, Homo sapiens; identical to SEQ ID NO: 348
  misc_feature 1..175: note = chr3:192127556-192127731
  misc_feature 1..175: note = hyper
  source 1..175: mol_type = genomic DNA

SEQ ID NO: 2351 - DNA, 54 bp, Homo sapiens; identical to SEQ ID NO: 349
  misc_feature 1..54: note = chr3:192127936-192127990
  misc_feature 1..54: note = hyper
  source 1..54: mol_type = genomic DNA

SEQ ID NO: 2352 - DNA, 100 bp, Homo sapiens
  misc_feature 1..100: note = chr3:194208467-194208567
  misc_feature 1..100: note = hyper
  source 1..100: mol_type = genomic DNA
cgcgcccggccacctgcagcctctggctgcggccatctttccgcctggggccacctggcctgcgccctttgtgcccggcccgctccgtgactgttcttct

SEQ ID NO: 2353 - DNA, 342 bp, Homo sapiens
  misc_feature 1..342: note = chr3:194408427-194408769
  misc_feature 1..342: note = hyper
  source 1..342: mol_type = genomic DNA
agcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgc

SEQ ID NO: 2354 - DNA, 220 bp, Homo sapiens
  misc_feature 1..220: note = chr3:194408838-194409058
  misc_feature 1..220: note = hyper
  source 1..220: mol_type = genomic DNA
cgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgaga

SEQ ID NO: 2355 - DNA, 114 bp, Homo sapiens
  misc_feature 1..114: note = chr4:568539-568653
  misc_feature 1..114: note = hyper
  source 1..114: mol_type = genomic DNA
gaggctgcaaagccacgtggaagaggcggcgcccctgaggcctggccctggaccccgccccgctgcccgtcctcccttgccgcgggggtcctgagcggggcggggtgggtggaa

SEQ ID NO: 2356 - DNA, 69 bp, Homo sapiens
  misc_feature 1..69: note = chr4:569047-569116
  misc_feature 1..69: note = hyper
  source 1..69: mol_type = genomic DNA
ggagccgccgcggggccgcgccagggcccggcctcccctccgcctgccgcgccgaccgcgccgggcctg

SEQ ID NO: 2357 - DNA, 162 bp, Homo sapiens
  misc_feature 1..162: note = chr4:569274-569436
  misc_feature 1..162: note = hyper
  source 1..162: mol_type = genomic DNA
cgccgggggccgagcccggcgccgagccgggggccgagcccggggccgagccgggggttgagcccggggccgagccggggctcgaacctggcgcccgcgggggcaggcagtagtgcgagtacttgcgctccaccagggacacggtgtcgccgtcgatcacgg

SEQ ID NO: 2358 - DNA, 36 bp, Homo sapiens
  misc_feature 1..36: note = chr4:569460-569496
  misc_feature 1..36: note = hyper
  source 1..36: mol_type = genomic DNA
cgagcatgaagaccaggacgccgagcagaagcaggt

SEQ ID NO: 2359 - DNA, 853 bp, Homo sapiens
  misc_feature 1..853: note = chr4:570836-571689
  misc_feature 1..853: note = hyper
  source 1..853: mol_type = genomic DNA
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgagcgtgtgcccgcggttcgggggatgagtaggggcgctgacttttaggaccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgcagcagggaacgcgctccgggcgccgggggaggtggagggacgccctgagaacgcacctccgtccctgtcaccagccttagcaagttctggcctgtggagccgtcatccagagcgcacagcttcatgcccttgaagggcgcagtgtgtcccgtggtgcccggtgggcccggacagagacccca

SEQ ID NO: 2360 - DNA, 14 bp, Homo sapiens
  misc_feature 1..14: note = chr4:2042655-2042669
  misc_feature 1..14: note = hyper
  source 1..14: mol_type = genomic DNA
gcagtcccagcttg

SEQ ID NO: 2361 - DNA, 183 bp, Homo sapiens
  misc_feature 1..183: note = chr4:3769007-3769190
  misc_feature 1..183: note = hyper
  source 1..183: mol_type = genomic DNA
catgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccgga

SEQ ID NO: 2362 - DNA, 238 bp, Homo sapiens
  misc_feature 1..238: note = chr4:4868555-4868793
  misc_feature 1..238: note = hyper
  source 1..238: mol_type = genomic DNA
ctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacct

SEQ ID NO: 2363 - DNA, 172 bp, Homo sapiens
  misc_feature 1..172: note = chr4:4868828-4869000
  misc_feature 1..172: note = hyper
  source 1..172: mol_type = genomic DNA
cggatcgctgaacccggggctgaaggaccagattgagcaggaggcccagtgaggacagttactggtgaggcaggggccccgagtgcgaatcctaccgctgcgccctccttagtgacccaaggccgggaggtgagcccagccgggtccaggcctgcgccccgcctagagccct

SEQ ID NO: 2364 - DNA, 127 bp, Homo sapiens
  misc_feature 1..127: note = chr4:4869131-4869258
  misc_feature 1..127: note = hyper
  source 1..127: mol_type = genomic DNA
cgcatcgccccacagtggaacagtcccccggccccgacgccggactccctgggaagcccccgacccccaagtgccaccaccaagtgcccactctccagagcactcccaggcccccactccagacttg

SEQ ID NO: 2365 - DNA, 1175 bp, Homo sapiens
  misc_feature 1..1175: note = chr4:5052930-5054105
  misc_feature 1..1175: note = hyper
  source 1..1175: mol_type = genomic DNA
gacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgcagggaccgagctcccggccgagggaggagggccgagcagggattcagattcttccgggccgatccctttctcagctccttccgccctgccgccgcccactgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacccaggcatggccacttcgcccagcgaatgcagtgtgtgcccgacccgtgccaggcgcggcgcttctgctgaggcaactcctaggtacccagtgccgtttagtagtcgggacggtgcctagcgcgggactggggaggcggcttcagagagttgaacccgaaacctgcacttgggggtgtggaagggaggagttgacttcggaggccagtcgggatggttctaggctcgggctccccaggaaaccgaggtttccttgagagcctgaggctgacggaggtggcctggaagggcgggttgcaccgtgtgtctgtgtgtgtgtgcgcgtgcccacgacgcatttggtctcgtgcaagggcctgt

SEQ ID NO: 2366 - DNA, 253 bp, Homo sapiens
  misc_feature 1..253: note = chr4:5712979-5713232
  misc_feature 1..253: note = hyper
  source 1..253: mol_type = genomic DNA
aggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcct

SEQ ID NO: 2367 - DNA, 116 bp, Homo sapiens
  misc_feature 1..116: note = chr4:5891966-5892082
  misc_feature 1..116: note = hyper
  source 1..116: mol_type = genomic DNA
caagggacaagaccacgtgcgtatcagggggaggagcatccgcctgccactggccaaacagatcgctgctcccaagcagatttcgccggtacaaagcgccgcagccgctcagcctc

SEQ ID NO: 2368 - DNA, 56 bp, Homo sapiens
  misc_feature 1..56: note = chr4:5892109-5892165
  misc_feature 1..56: note = hyper
  source 1..56: mol_type = genomic DNA
cgcagaaacccctcctgcagcccagggagaagcctggtgggcggggggggaagggc

SEQ ID NO: 2369 - DNA, 645 bp, Homo sapiens
  misc_feature 1..645: note = chr4:6201895-6202540
  misc_feature 1..645: note = hyper
  source 1..645: mol_type = genomic DNA
gccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgc

SEQ ID NO: 2370 - DNA, 290 bp, Homo sapiens; identical to SEQ ID NO: 350
  misc_feature 1..290: note = chr4:8858758-8859048
  misc_feature 1..290: note = hyper
  source 1..290: mol_type = genomic DNA

SEQ ID NO: 2371 - DNA, 557 bp, Homo sapiens; identical to SEQ ID NO: 351
  misc_feature 1..557: note = chr4:8859381-8859938
  misc_feature 1..557: note = hyper
  source 1..557: mol_type = genomic DNA

SEQ ID NO: 2372 - DNA, 156 bp, Homo sapiens; identical to SEQ ID NO: 352
  misc_feature 1..156: note = chr4:8869115-8869271
  misc_feature 1..156: note = hyper
  source 1..156: mol_type = genomic DNA

SEQ ID NO: 2373 - DNA, 445 bp, Homo sapiens; identical to SEQ ID NO: 353
  misc_feature 1..445: note = chr4:8869368-8869813
  misc_feature 1..445: note = hyper
  source 1..445: mol_type = genomic DNA

SEQ ID NO: 2374 - DNA, 116 bp, Homo sapiens
  misc_feature 1..116: note = chr4:8894842-8894958
  misc_feature 1..116: note = hyper
  source 1..116: mol_type = genomic DNA
ggggagagtccatgccgcgacggagcgagcagacttggacatggtcgagtgcctggtgcgcacgattggtcttaagagtttagggaaaaaagcacgcggggaaaccacgcggggcc

SEQ ID NO: 2375 - DNA, 134 bp, Homo sapiens
  misc_feature 1..134: note = chr4:8895964-8896098
  misc_feature 1..134: note = hyper
  source 1..134: mol_type = genomic DNA
cgcagccaggtttctccgctgccgtcctcttccagggccaaggggccgtggcagacccggagcctcccggaggcgcttctgccggggcggattatctcccctctcccaccaggccccggcggggggcaccaact

SEQ ID NO: 2376 - DNA, 205 bp, Homo sapiens
  misc_feature 1..205: note = chr4:8896117-8896322
  misc_feature 1..205: note = hyper
  source 1..205: mol_type = genomic DNA
cgctggaactccccctcctggccccctcctccgcttctgtttgtttaaccttccggcagggcggtgaccctgcgccctgccaggcgctgccatggggtcaggcgggggtggggggcgcctcaggggtccggcggcggctgggagtcccccgagcagcagagaccctcctcctgtctcctgttctgcccatcgtgggaagtgtccc

SEQ ID NO: 2377 - DNA, 726 bp, Homo sapiens
  misc_feature 1..726: note = chr4:10458395-10459121
  misc_feature 1..726: note = hyper
  source 1..726: mol_type = genomic DNA
ctcagctccgaggcccgcaggaggctttaaaaatggcctcctgacgacacttcctgctcggcgcggacggtaggagccctcggaggaggcatccttcataacgctgggggcggggagcgcaggccgggccagcggcgccacacgaacggccccgcgggacgctgccacccccgcctcggtcgccccggcgcgtcggccgagtccgcggggtcgcggcgcacaaaggcgagctgggggcgccgggccggaccccgaccctaggccaggcccgcgtacctgctcaacgcgcgccaagccgcggcccgggcccccaccccagccggtgccccacgcccaccagccggagcccgcgttcggcctacccggtgccacttgccacgacgccagccctcagcgcgggcacgcggggccgcggccgctcgacccgccccggcctggccccgtcaggcccccgccccgcgcgcccccacgacccggccgcagctggcgcttcggtcacgtacacgcggatccgggggccctcgccctcccgctcagctacttacccggcaggccggattcgggtgccaggtcccggcgaaggggcgtctacaccgccggccgcagaccgccggcgccgcgcccgctgtaggtccctacccggggggcggagcccgcgccagccccgcgcgtgcgcaatgtgaagcggcggcgcggctccagcgaggccggcgcctgaggtctcta

SEQ ID NO: 2378 - DNA, 273 bp, Homo sapiens; identical to SEQ ID NO: 354
  misc_feature 1..273: note = chr4:10462775-10463048
  misc_feature 1..273: note = hyper
  source 1..273: mol_type = genomic DNA

SEQ ID NO: 2379 - DNA, 184 bp, Homo sapiens; identical to SEQ ID NO: 355
  misc_feature 1..184: note = chr4:10463072-10463256
  misc_feature 1..184: note = hyper
  source 1..184: mol_type = genomic DNA

SEQ ID NO: 2380 - DNA, 280 bp, Homo sapiens; identical to SEQ ID NO: 356
  misc_feature 1..280: note = chr4:10463257-10463537
  misc_feature 1..280: note = hyper
  source 1..280: mol_type = genomic DNA

SEQ ID NO: 2381 - DNA, 83 bp, Homo sapiens; identical to SEQ ID NO: 357
  misc_feature 1..83: note = chr4:13545940-13546023
  misc_feature 1..83: note = hyper
  source 1..83: mol_type = genomic DNA

SEQ ID NO: 2382 - DNA, 35 bp, Homo sapiens; identical to SEQ ID NO: 358
  misc_feature 1..35: note = chr4:13548555-13548590
  misc_feature 1..35: note = hyper
  source 1..35: mol_type = genomic DNA

SEQ ID NO: 2383 - DNA, 328 bp, Homo sapiens; identical to SEQ ID NO: 359
  misc_feature 1..328: note = chr4:13548634-13548962
  misc_feature 1..328: note = hyper
  source 1..328: mol_type = genomic DNA

SEQ ID NO: 2384 - DNA, 78 bp, Homo sapiens
  misc_feature 1..78: note = chr4:16084741-16084819
  misc_feature 1..78: note = hyper
  source 1..78: mol_type = genomic DNA
gtgttggcccatttccgcactcagccagggaagctcagcgcctcacgtccccggggccatccctagagtttcctttac

SEQ ID NO: 2385 - DNA, 14 bp, Homo sapiens
  misc_feature 1..14: note = chr4:16085166-16085180
  misc_feature 1..14: note = hyper
  source 1..14: mol_type = genomic DNA
cgcagagcgaaccc

SEQ ID NO: 2386 - DNA, 121 bp, Homo sapiens
  misc_feature 1..121: note = chr4:16085181-16085302
  misc_feature 1..121: note = hyper
  source 1..121: mol_type = genomic DNA
tccactcctcactgtacacccccagtacagtggaaggagtgcgctcagccccgcgcctggtcagcagatgcctctctcgctccgggatgaggacccagctactcaccgtgcacccggctcc

SEQ ID NO: 2387 - DNA, 48 bp, Homo sapiens
  misc_feature 1..48: note = chr4:16085351-16085399
  misc_feature 1..48: note = hyper
  source 1..48: mol_type = genomic DNA
cgccagaccctggctcgtgaattatttatgacccggcttctgggacca

SEQ ID NO: 2388 - DNA, 291 bp, Homo sapiens
  misc_feature 1..291: note = chr4:17783003-17783294
  misc_feature 1..291: note = hyper
  source 1..291: mol_type = genomic DNA
agcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgc

SEQ ID NO: 2389 - DNA, 27 bp, Homo sapiens
  misc_feature 1..27: note = chr4:17783295-17783322
  misc_feature 1..27: note = hyper
  source 1..27: mol_type = genomic DNA
gtgggcgggcactgcgctcttggacac

SEQ ID NO: 2390 - DNA, 158 bp, Homo sapiens
  misc_feature 1..158: note = chr4:17783323-17783481
  misc_feature 1..158: note = hyper
  source 1..158: mol_type = genomic DNA
tgggtggcgcgcggccctggacttggtggcgacggaccctgcccgaggtggggatcccaggctaaagaggaagaagagcctccggagagggacagggcacagtgactggcggcctccggagagggacagggcacagtgactggcggctcccgagtctc

SEQ ID NO: 2391 - DNA, 45 bp, Homo sapiens
  misc_feature 1..45: note = chr4:37245537-37245582
  misc_feature 1..45: note = hyper
  source 1..45: mol_type = genomic DNA
gaacccacaccctcccgcccggcccaggtgcgcacccggccgcgc

SEQ ID NO: 2392 - DNA, 525 bp, Homo sapiens
  misc_feature 1..525: note = chr4:37245836-37246361
  misc_feature 1..525: note = hyper
  source 1..525: mol_type = genomic DNA
cgccaggagagatagggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggagtccaggaggctcctgcgcacccccgaggcccccgcgcccaagccccggccgtcctctaagccgcaagttatttctgcgcccgagagaggcgggctcggataaagtcgggacgccttctggtacataaagtttcatctgctctcctcgctcgcacggtccctgccgcctggcggccccctcctcccacggcgggcgcgggcggggagatggccgccggcgcttcccgg

SEQ ID NO: 2393 - DNA, 211 bp, Homo sapiens
  misc_feature 1..211: note = chr4:37246489-37246700
  misc_feature 1..211: note = hyper
  source 1..211: mol_type = genomic DNA
cgagggtccgtatggcttctcctcgccggcgggtgctgtgcgccacggagctcgccaaaggcgcttcgggctcggagcggctctgagccgcgccgcctgctgagatcgaccgcctgctgagccgttccgtggagctgcgggcaggaacccgaggagcaggaggtggcggcggcggcagtggctgttcctcccagagggcgatgtggccggc

SEQ ID NO: 2394 - DNA, 111 bp, Homo sapiens
  misc_feature 1..111: note = chr4:37247015-37247126
  misc_feature 1..111: note = hyper
  source 1..111: mol_type = genomic DNA
gctggccggttttgcctgcacacttctattaggacacccattctccaccccgggttattcccctgggtcaatccaagaaacatccaaggcattagccggcccttctggaag

SEQ ID NO: 2395 - DNA, 73 bp, Homo sapiens; identical to SEQ ID NO: 360
  misc_feature 1..73: note = chr4:41258716-41258789
  misc_feature 1..73: note = hyper
  source 1..73: mol_type = genomic DNA

SEQ ID NO: 2396 - DNA, 381 bp, Homo sapiens; identical to SEQ ID NO: 361
  misc_feature 1..381: note = chr4:41259085-41259466
  misc_feature 1..381: note = hyper
  source 1..381: mol_type = genomic DNA

SEQ ID NO: 2397 - DNA, 333 bp, Homo sapiens; identical to SEQ ID NO: 362
  misc_feature 1..333: note = chr4:41750266-41750599
  misc_feature 1..333: note = hyper
  source 1..333: mol_type = genomic DNA

SEQ ID NO: 2398 - DNA, 758 bp, Homo sapiens
  misc_feature 1..758: note = chr4:41752954-41753712
  misc_feature 1..758: note = hyper
  source 1..758: mol_type = genomic DNA
gcacaaggctgagatcgtccaagtttcttcgttccctcggatttcgggttgggggatgtgcttgctggttttctgaacgcaactctgccgccgaggcctgcactcaggagatgtggatgtagggagcacaggccggggtgtccaccgccagcccgctcctctgctgtagggtttaagcgcgtttccctgcagaagagagtgaccaggggtggtcaggaggtgatgaatttcggctccaaggcctatttttgacagtaaccaggttcacaccccgcttggcactagagccttactgcacctggggtgtgtctccgcgtggtgcagagcgcgcgctctactccggaagctacggccgggtgccgcgccaccgctgtgcgccctgggcctgatccctacgccctagtcgagtgcagggcagggcaatttcgccgtgggtcctagtttgctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcaggggacctggatgctgacggggcatcagagggtgtcaaaaggagaagctaagggatctgggcgaggtctcagccgaagggcgctggcaagggaagtgcttggcc

SEQ ID NO: 2399 - DNA, 90 bp, Homo sapiens
  misc_feature 1..90: note = chr4:41753713-41753803
  misc_feature 1..90: note = hyper
  source 1..90: mol_type = genomic DNA
gggagggtgcccggggggcggtcaaggggcaggcccggggctctgtccctcccggtcctggggtcccttcccgtcccgcggttccggaac

SEQ ID NO: 2400 - DNA, 113 bp, Homo sapiens
  misc_feature 1..113: note = chr4:41753804-41753917
  misc_feature 1..113: note = hyper
  source 1..113: mol_type = genomic DNA
cctcgccagccctctctgggcgccccctgctgccgggcgccccctgctgccggccgccccgggtcggggtgccgtgagccttctcgcctttgtaccaggagacctttcagcgc

SEQ ID NO: 2401 - DNA, 41 bp, Homo sapiens
  misc_feature 1..41: note = chr4:41754030-41754071
  misc_feature 1..41: note = hyper
  source 1..41: mol_type = genomic DNA
cgtccctctgcccgtcttttgtggcccggggtcctgcttct

SEQ ID NO: 2402 - DNA, 341 bp, Homo sapiens; identical to SEQ ID NO: 363
  misc_feature 1..341: note = chr4:41875410-41875751
  misc_feature 1..341: note = hyper
  source 1..341: mol_type = genomic DNA

SEQ ID NO: 2403 - DNA, 46 bp, Homo sapiens
  misc_feature 1..46: note = chr4:41881385-41881431
  misc_feature 1..46: note = hyper
  source 1..46: mol_type = genomic DNA
ccaataaatgcaacccggcgccactcgattccgggataatttttaa

SEQ ID NO: 2404 - DNA, 689 bp, Homo sapiens; identical to SEQ ID NO: 364
  misc_feature 1..689: note = chr4:41882935-41883624
  misc_feature 1..689: note = hyper
  source 1..689: mol_type = genomic DNA

SEQ ID NO: 2405 - DNA, 451 bp, Homo sapiens; identical to SEQ ID NO: 365
  misc_feature 1..451: note = chr4:42152961-42153412
  misc_feature 1..451: note = hyper
  source 1..451: mol_type = genomic DNA

SEQ ID NO: 2406 - DNA, 101 bp, Homo sapiens; identical to SEQ ID NO: 366
  misc_feature 1..101: note = chr4:42153532-42153633
  misc_feature 1..101: note = hyper
  source 1..101: mol_type = genomic DNA

SEQ ID NO: 2407 - DNA, 504 bp, Homo sapiens; identical to SEQ ID NO: 367
  misc_feature 1..504: note = chr4:42153881-42154385
  misc_feature 1..504: note = hyper
  source 1..504: mol_type = genomic DNA

SEQ ID NO: 2408 - DNA, 611 bp, Homo sapiens; identical to SEQ ID NO: 368
  misc_feature 1..611: note = chr4:42154386-42154997
  misc_feature 1..611: note = hyper
  source 1..611: mol_type = genomic DNA

SEQ ID NO: 2409 - DNA, 127 bp, Homo sapiens
  misc_feature 1..127: note = chr4:44450050-44450177
  misc_feature 1..127: note = hyper
  source 1..127: mol_type = genomic DNA
cgctctggcagccctcgtcgttgagagagttctgcttggtgaccttgggcgacagcagcttgaccaagtcggtgagctggaaatactcggcctcgcgcagcagccgctccttctcggggaagtgctc

SEQ ID NO: 2410 - DNA, 223 bp, Homo sapiens
  misc_feature 1..223: note = chr4:44450741-44450964
  misc_feature 1..223: note = hyper
  source 1..223: mol_type = genomic DNA
gagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgc

SEQ ID NO: 2411 - DNA, 660 bp, Homo sapiens
  misc_feature 1..660: note = chr4:46995161-46995821
  misc_feature 1..660: note = hyper
  source 1..660: mol_type = genomic DNA
gcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctcc

SEQ ID NO: 2412 - DNA, 567 bp, Homo sapiens
  misc_feature 1..567: note = chr4:46995822-46996389
  misc_feature 1..567: note = hyper
  source 1..567: mol_type = genomic DNA
gcttcgcagcccccgaccccaagtgggctccccgcccacagcagtgttcgtcctcctacctcctggccccctcccttccgctgggatttggatctaaccaatgaagctcctctgtcatcaggttgtgcgaggacctgtttgtacccagagtcaaggttggaggtggagaaagggcgggtgacggggactgctgggcgtcgggtggtagcggtggtgaggagaggggatcaagtccgggctcaaaccacctttgagaccctcccattcaggtgttatggggggcggtagggagagcaatgaaagcagaaagattcttcctggtaacaggggttgcagctcacccggcggactctcgccaaactattgggaagtggactcgagccgcactctagtcccagtatttgctaagctattgctttaaagacaccccatttctttacccgcctccaccagacacgcgcacaccctccgctttgctgctccatccttttctggagaggaggggagaggtggagacaagcgacctctggtcaaaatcactttcacttcttgcgacactcttctttt

SEQ ID NO: 2413 - DNA, 16 bp, Homo sapiens
  misc_feature 1..16: note = chr4:48485273-48485289
  misc_feature 1..16: note = hyper
  source 1..16: mol_type = genomic DNA
ttcacaggaggggacc

SEQ ID NO: 2414 - DNA, 216 bp, Homo sapiens
  misc_feature 1..216: note = chr4:48485589-48485805
  misc_feature 1..216: note = hyper
  source 1..216: mol_type = genomic DNA
cgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcgg

SEQ ID NO: 2415 - DNA, 162 bp, Homo sapiens
  misc_feature 1..162: note = chr4:54967330-54967492
  misc_feature 1..162: note = hyper
  source 1..162: mol_type = genomic DNA
gggccttagggacctcgaacgtcacggcggataaaccagaggttaactgcttgggatttggggtgggtgtgtttgaacctgtgtggcatccccgcgtcggggcggctaaagcgtcttgacgtttttggctaagcctgcgcgcttctccgcttggctcaaagg

SEQ ID NO: 2416 - DNA, 130 bp, Homo sapiens; identical to SEQ ID NO: 369
  misc_feature 1..130: note = chr4:54975802-54975932
  misc_feature 1..130: note = hyper
  source 1..130: mol_type = genomic DNA

SEQ ID NO: 2417 - DNA, 126 bp, Homo sapiens; identical to SEQ ID NO: 370
  misc_feature 1..126: note = chr4:54975990-54976116
  misc_feature 1..126: note = hyper
  source 1..126: mol_type = genomic DNA

SEQ ID NO: 2418 - skipped

SEQ ID NO: 2419 - DNA, 159 bp, Homo sapiens; identical to SEQ ID NO: 372
  misc_feature 1..159: note = chr4:57521505-57521664
  misc_feature 1..159: note = hyper
  source 1..159: mol_type = genomic DNA

SEQ ID NO: 2420 - DNA, 683 bp, Homo sapiens; identical to SEQ ID NO: 373
  misc_feature 1..683: note = chr4:57521700-57522383
  misc_feature 1..683: note = hyper
  source 1..683: mol_type = genomic DNA

SEQ ID NO: 2421 - DNA, 396 bp, Homo sapiens; identical to SEQ ID NO: 374
  misc_feature 1..396: note = chr4:57522419-57522815
  misc_feature 1..396: note = hyper
  source 1..396: mol_type = genomic DNA

SEQ ID NO: 2422 - DNA, 184 bp, Homo sapiens
  misc_feature 1..184: note = chr4:62067440-62067624
  misc_feature 1..184: note = hyper
  source 1..184: mol_type = genomic DNA
gagcaactgatgggacgatctcagggaccggcgtttacgaaaggtaatttattcttcgcactcttcataataggggtcgccctggccgggcgcaggcggcggcatccaccgggcgggcaacaagagggggtgcggggtgcatgcacactcgcccttccactcacacactcgccctcacacacac

SEQ ID NO: 2423 - DNA, 218 bp, Homo sapiens
  misc_feature 1..218: note = chr4:81106163-81106381
  misc_feature 1..218: note = hyper
  source 1..218: mol_type = genomic DNA
gggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaattaatcacaaccaccagcggatgcaaaatgtg

SEQ ID NO: 2424 - DNA, 279 bp, Homo sapiens
  misc_feature 1..279: note = chr4:81123625-81123904
  misc_feature 1..279: note = hyper
  source 1..279: mol_type = genomic DNA
tagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcac

SEQ ID NO: 2425 - DNA, 347 bp, Homo sapiens
  misc_feature 1..347: note = chr4:81124121-81124468
  misc_feature 1..347: note = hyper
  source 1..347: mol_type = genomic DNA
gcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacct

SEQ ID NO: 2426 - DNA, 65 bp, Homo sapiens
  misc_feature 1..65: note = chr4:81951421-81951486
  misc_feature 1..65: note = hyper
  source 1..65: mol_type = genomic DNA
gcaggtgcaggggcccgcagtgtccgtcagaagaggctcgggaaagtaagcgagaatggtgttca

SEQ ID NO: 2427 - DNA, 659 bp, Homo sapiens
  misc_feature 1..659: note = chr4:85402764-85403423
  misc_feature 1..659: note = hyper
  source 1..659: mol_type = genomic DNA
cggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgt

SEQ ID NO: 2428 - DNA, 30 bp, Homo sapiens; identical to SEQ ID NO: 375
  misc_feature 1..30: note = chr4:85404111-85404141
  misc_feature 1..30: note = hyper
  source 1..30: mol_type = genomic DNA

SEQ ID NO: 2429 - DNA, 252 bp, Homo sapiens; identical to SEQ ID NO: 376
  misc_feature 1..252: note = chr4:85404224-85404476
  misc_feature 1..252: note = hyper
  source 1..252: mol_type = genomic DNA

SEQ ID NO: 2430 - DNA, 44 bp, Homo sapiens; identical to SEQ ID NO: 377
  misc_feature 1..44: note = chr4:85404649-85404693
  misc_feature 1..44: note = hyper
  source 1..44: mol_type = genomic DNA

SEQ ID NO: 2431 - DNA, 121 bp, Homo sapiens
  misc_feature 1..121: note = chr4:85414725-85414846
  misc_feature 1..121: note = hyper
  source 1..121: mol_type = genomic DNA
gaggggaggcaagggcgaggaattaaacgagcagatccaggccatgctaccactcccgcatctcgatggccctcccgcggccccccgaaggcctgctgccctccctcgcagccctcccttt

SEQ ID NO: 2432 - DNA, 123 bp, Homo sapiens; identical to SEQ ID NO: 378
  misc_feature 1..123: note = chr4:85419120-85419243
  misc_feature 1..123: note = hyper
  source 1..123: mol_type = genomic DNA

SEQ ID NO: 2433 - DNA, 262 bp, Homo sapiens
  misc_feature 1..262: note = chr4:85422188-85422450
  misc_feature 1..262: note = hyper
  source 1..262: mol_type = genomic DNA
taaggtgaagtccttcgtcagcatgaatagtgctaaggagtcaagccaagacttgcttcagaagagagctgatgtgcggaccttctgcatttccacgcggggatccagtgcttgggtctaaaccccagcgccctgccacctcggccaggaagctgcgggaggatggtggcaggcatagcccgtcctagccttgaaactggggggcctatgtctctggcttcgttacaaacgaaacgtttctcgccttcggacactccaccct

SEQ ID NO: 2434 - DNA, 40 bp, Homo sapiens
  misc_feature 1..40: note = chr4:90758843-90758883
  misc_feature 1..40: note = hyper
  source 1..40: mol_type = genomic DNA
ggtcacaggttacaacgttaggggtcgctttagttcaaat

SEQ ID NO: 2435 - DNA, 133 bp, Homo sapiens
  misc_feature 1..133: note = chr4:94750906-94751039
  misc_feature 1..133: note = hyper
  source 1..133: mol_type = genomic DNA
cagccccagcttctgcgggagggtactcggtgcagctggacgctctgcacttctcgactttcgaggacagcgccctgacagcgatgatggcgcaaaagaatttgtctccttctctccccgggagcatcttgca

SEQ ID NO: 2436 - DNA, 221 bp, Homo sapiens
  misc_feature 1..221: note = chr4:101111366-101111587
  misc_feature 1..221: note = hyper
  source 1..221: mol_type = genomic DNA
actaactcaacagttcgcaaaacttggaagcgacctgccccgcggagcgccccccggccccgctgcccccaccaaggccgcagcttcgctcacctgccaggagttcgcgggggcctgcgcgctcgctgccgggtaaacacaggcaggtggcttcttaggagtcccctctcctggggactcggtgacctgcagaccccagcagccagcggcaccctgctcac

SEQ ID NO: 2437 - DNA, 365 bp, Homo sapiens; identical to SEQ ID NO: 379
  misc_feature 1..365: note = chr4:107955250-107955615
  misc_feature 1..365: note = hyper
  source 1..365: mol_type = genomic DNA

SEQ ID NO: 2438 - DNA, 357 bp, Homo sapiens
  misc_feature 1..357: note = chr4:107956676-107957033
  misc_feature 1..357: note = hyper
  source 1..357: mol_type = genomic DNA
ctccaccatcagcaccgcggccagtaggagcaggcagcaggacgaatccttgctccgcatcaacgcggccatctcccggcgagggggtccccaggaagacgcaaagcccggaggggtgggaatgcaaagggagggaggaccccaacacggggcccctcacttgggtcgcgggggcttgcagattgtgttccctcaacccttcctggttcggggacccaggaccctatgaactcagtctcacgcctcaggacagaaattagcggaacccaagcgagacccgcttctccaccaggacaggaagttctgcaataactggaagcaatcaaatgcgaggcgctttctcgccaaggaggcgtg

SEQ ID NO: 2439 - DNA, 306 bp, Homo sapiens
  misc_feature 1..306: note = chr4:111532704-111533010
  misc_feature 1..306: note = hyper
  source 1..306: mol_type = genomic DNA
cgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgc

SEQ ID NO: 2440 - DNA, 114 bp, Homo sapiens
  misc_feature 1..114: note = chr4:111543232-111543346
  misc_feature 1..114: note = hyper
  source 1..114: mol_type = genomic DNA
agaactaaagggatgcggggtagtcaaaattccggctcccggaagttctgcggggagccaggcgaacgaccactcccaccacgcctccccccggaggggctgacttccttgggg

SEQ ID NO: 2441 - DNA, 47 bp, Homo sapiens
  misc_feature 1..47: note = chr4:111543403-111543450
  misc_feature 1..47: note = hyper
  source 1..47: mol_type = genomic DNA
cgccttacctgcggcctccgggctggaggtgtcggagatggtgtgca

SEQ ID NO: 2442 - DNA, 105 bp, Homo sapiens
  misc_feature 1..105: note = chr4:111544076-111544181
  misc_feature 1..105: note = hyper
  source 1..105: mol_type = genomic DNA
tgcggcggcagcagccgctgcagccacgacgcggccctctgagcgcaccctccgcaacgcgcacacgcacacccctcgggcggtcgaacaggagccgggccttgc

SEQ ID NO: 2443 - DNA, 285 bp, Homo sapiens
  misc_feature 1..285: note = chr4:111544298-111544583
  misc_feature 1..285: note = hyper
  source 1..285: mol_type = genomic DNA
cgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggaga

SEQ ID NO: 2444 - DNA, 45 bp, Homo sapiens
  misc_feature 1..45: note = chr4:113431810-113431855
  misc_feature 1..45: note = hyper
  source 1..45: mol_type = genomic DNA
tttcttttgcagattcggaggccgggactttcacgctcccgggag

SEQ ID NO: 2445 - DNA, 240 bp, Homo sapiens
  misc_feature 1..240: note = chr4:113431915-113432155
  misc_feature 1..240: note = hyper
  source 1..240: mol_type = genomic DNA
cgcttgggagcccgagggggctcggggaagaccgaggctggcggtgaggaggaggcgcttttaaccggttccaggtgtcggtgcccagaagtcacaaccagctcaagggtgtgcaatgcaggggggtgtacccagcgggtgggggcgccgcagctcccagcctcgccctcaagcccggccctttagcagcctgtgacccagactggcgggtgggcagctgaagccggccttgggtctaaa

SEQ ID NO: 2446 - DNA, 114 bp, Homo sapiens
  misc_feature 1..114: note = chr4:113432226-113432340
  misc_feature 1..114: note = hyper
  source 1..114: mol_type = genomic DNA
cgcccagggccttcgcctcagctgggacaccaggagcgcccatccggctctggtccaggtgctgcgggcccgggaagcctcagcccctcctcctgcctccggctgagcctaggt

SEQ ID NO: 2447 - DNA, 239 bp, Homo sapiens; identical to SEQ ID NO: 380
  misc_feature 1..239: note = chr4:113441947-113442186
  misc_feature 1..239: note = hyper
  source 1..239: mol_type = genomic DNA

SEQ ID NO: 2448 - DNA, 237 bp, Homo sapiens; identical to SEQ ID NO: 381
  misc_feature 1..237: note = chr4:113442246-113442483
  misc_feature 1..237: note = hyper
  source 1..237: mol_type = genomic DNA

SEQ ID NO: 2449 - DNA, 275 bp, Homo sapiens; identical to SEQ ID NO: 382
  misc_feature 1..275: note = chr4:113444020-113444295
  misc_feature 1..275: note = hyper
  source 1..275: mol_type = genomic DNA

SEQ ID NO: 2450 - DNA, 133 bp, Homo sapiens; identical to SEQ ID NO: 383
  misc_feature 1..133: note = chr4:113444296-113444429
  misc_feature 1..133: note = hyper
  source 1..133: mol_type = genomic DNA

SEQ ID NO: 2451 - DNA, 251 bp, Homo sapiens; identical to SEQ ID NO: 384
  misc_feature 1..251: note = chr4:122301462-122301713
  misc_feature 1..251: note = hyper
  source 1..251: mol_type = genomic DNA

SEQ ID NO: 2452 - DNA, 48 bp, Homo sapiens; identical to SEQ ID NO: 385
  misc_feature 1..48: note = chr4:122301962-122302010
  misc_feature 1..48: note = hyper
  source 1..48: mol_type = genomic DNA

SEQ ID NO: 2453 - DNA, 244 bp, Homo sapiens; identical to SEQ ID NO: 386
  misc_feature 1..244: note = chr4:122686209-122686453
  misc_feature 1..244: note = hyper
  source 1..244: mol_type = genomic DNA

SEQ ID NO: 2454 - DNA, 16 bp, Homo sapiens
  misc_feature 1..16: note = chr4:122686454-122686470
  misc_feature 1..16: note = hyper
  source 1..16: mol_type = genomic DNA
gcgcagactctcccag

SEQ ID NO: 2455 - DNA, 1201 bp, Homo sapiens
  misc_feature 1..1201: note = chr4:122871251-122872452
  misc_feature 1..1201: note = hyper
  source 1..1201: mol_type = genomic DNA
ctccatttcctgggccgtttccattccacgcttatcttcagcaataactgaaccacatcgggatgcgtcgctcatttaaaatcagaactcttccctatgggatctactcccagccactgattgtgttcctgtgttctaccggcaggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcgccgcccgccaccatccgaccccaagttctctacctagttctgagcgttcttcctaaaaaagacagtaaaccctgcggcactcccagtgttacgtgacagaaaaaatacagagcatctcaccctgtgaaaccgatcaccctctttttatcttctctgcgtctcgcactgattaaaagctgtctccaagattggaaattaagaaaagttgctctttctcatgcattagcgcgccgaccgctccttcgtttagaaagagagagagggaaagaaagaaagagaaaaagagagcccgcgcgccggggcgcgagccgctgaccctgcaccgcctgggaaccgcagtcaaagttatcactaaagcggttccccggctgcccgatgcccactctctccctcaggggaccctatagggcttcggttccagttttaccccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcct

SEQ ID NO: 2456 - DNA, 761 bp, Homo sapiens; identical to SEQ ID NO: 388
  misc_feature 1..761: note = chr4:134071850-134072611
  misc_feature 1..761: note = hyper
  source 1..761: mol_type = genomic DNA

SEQ ID NO: 2457 - DNA, 304 bp, Homo sapiens; identical to SEQ ID NO: 389
  misc_feature 1..304: note = chr4:134072676-134072980
  misc_feature 1..304: note = hyper
  source 1..304: mol_type = genomic DNA

SEQ ID NO: 2458 - DNA, 301 bp, Homo sapiens
  misc_feature 1..301: note = chr4:134073340-134073641
  misc_feature 1..301: note = hyper
  source 1..301: mol_type = genomic DNA
cgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactc

SEQ ID NO: 2459 - DNA, 565 bp, Homo sapiens; identical to SEQ ID NO: 390
  misc_feature 1..565: note = chr4:140200592-140201157
  misc_feature 1..565: note = hyper
  source 1..565: mol_type = genomic DNA

SEQ ID NO: 2460 - DNA, 270 bp, Homo sapiens; identical to SEQ ID NO: 391
  misc_feature 1..270: note = chr4:140201192-140201462
  misc_feature 1..270: note = hyper
  source 1..270: mol_type = genomic DNA

SEQ ID NO: 2461 - DNA, 510 bp, Homo sapiens; identical to SEQ ID NO: 392
  misc_feature 1..510: note = chr4:141418921-141419431
  misc_feature 1..510: note = hyper
  source 1..510: mol_type = genomic DNA

SEQ ID NO: 2462 - DNA, 104 bp, Homo sapiens; identical to SEQ ID NO: 393
  misc_feature 1..104: note = chr4:144621336-144621440
  misc_feature 1..104: note = hyper
  source 1..104: mol_type = genomic DNA

SEQ ID NO: 2463 - DNA, 383 bp, Homo sapiens; identical to SEQ ID NO: 394
  misc_feature 1..383: note = chr4:144621514-144621897
  misc_feature 1..383: note = hyper
  source 1..383: mol_type = genomic DNA

SEQ ID NO: 2464 - DNA, 173 bp, Homo sapiens; identical to SEQ ID NO: 395
  misc_feature 1..173: note = chr4:144621981-144622154
  misc_feature 1..173: note = hyper
  source 1..173: mol_type = genomic DNA

SEQ ID NO: 2465 - DNA, 30 bp, Homo sapiens
  misc_feature 1..30: note = chr4:147558352-147558382
  misc_feature 1..30: note = hyper
  source 1..30: mol_type = genomic DNA
ctccaccgccgcttccgggagctgaccacc

SEQ ID NO: 2466 - DNA, 140 bp, Homo sapiens
  misc_feature 1..140: note = chr4:147558476-147558616
  misc_feature 1..140: note = hyper
  source 1..140: mol_type = genomic DNA
cgccttccccaggcgcccagtgcctgcacctgctcccggtcaacccccgtccggattgggccacccgcgggttcctgcgtcggggtcccggggccttctcaccctcgcctgcaccctgctccttccgctctctagggagg

SEQ ID NO: 2467 - DNA, 889 bp, Homo sapiens; identical to SEQ ID NO: 396
  misc_feature 1..889: note = chr4:147559190-147560079
  misc_feature 1..889: note = hyper
  source 1..889: mol_type = genomic DNA

SEQ ID NO: 2468 - DNA, 286 bp, Homo sapiens; identical to SEQ ID NO: 397
  misc_feature 1..286: note = chr4:147560133-147560419
  misc_feature 1..286: note = hyper
  source 1..286: mol_type = genomic DNA

SEQ ID NO: 2469 - DNA, 52 bp, Homo sapiens; identical to SEQ ID NO: 398
  misc_feature 1..52: note = chr4:147560459-147560511
  misc_feature 1..52: note = hyper
  source 1..52: mol_type = genomic DNA

SEQ ID NO: 2470 - DNA, 515 bp, Homo sapiens
  misc_feature 1..515: note = chr4:147576329-147576844
  misc_feature 1..515: note = hyper
  source 1..515: mol_type = genomic DNA
gggggcccctctggggccgcctggactcgcaggtctcccgcgccaccccctaccccattccccgcctgcgccccctgctgcgctcggcgcgcgtcctgctgcagcctgctggggacagcgcacgcagtgaccgggcgcggcagccgcttccctttcccatcgacctcgctgccttctggcttttctcaaagccttttctccagagccagacagcagacgccccggcgatgccttcgccgcccatttggccgaggtagcccaggcctgcccttgctgcctccgccggccgctccgccgcggcccaaagccggggaagcgtcccaagcccgcgcggtctgccccggagccccggaggacccgaatactcagcggaatgtcaccctggccgggttctttggattcccctccggggccatcctacggaatccagccgtccccacaagctacctcatgtaactggagacctaagaaaagactctccataccttttgacaaaaagacgtaccagaagcaat

SEQ ID NO: 2471 - DNA, 135 bp, Homo sapiens; identical to SEQ ID NO: 399
  misc_feature 1..135: note = chr4:154709476-154709611
  misc_feature 1..135: note = hyper
  source 1..135: mol_type = genomic DNA

SEQ ID NO: 2472 - DNA, 70 bp, Homo sapiens; identical to SEQ ID NO: 400
  misc_feature 1..70: note = chr4:154709758-154709828
  misc_feature 1..70: note = hyper
  source 1..70: mol_type = genomic DNA

SEQ ID NO: 2473 - DNA, 675 bp, Homo sapiens; identical to SEQ ID NO: 401
  misc_feature 1..675: note = chr4:154709829-154710504
  misc_feature 1..675: note = hyper
  source 1..675: mol_type = genomic DNA

SEQ ID NO: 2474 - DNA, 66 bp, Homo sapiens
  misc_feature 1..66: note = chr4:154710734-154710800
  misc_feature 1..66: note = hyper
  source 1..66: mol_type = genomic DNA
ccctgtgatggagcccgggacctgcccgcccgaggccgcctcggcgaacttcgttttccctcgaat

SEQ ID NO: 2475 - DNA, 684 bp, Homo sapiens
  misc_feature 1..684: note = chr4:154712024-154712708
  misc_feature 1..684: note = hyper
  source 1..684: mol_type = genomic DNA
ctctgagagatgctacgacttgggcctgggagtgggataagggccctctcgctttcacgcccccccaaccccccgccggccccggccaacccctaaatccccaacgccctccgctggggtcgcctcctccccgcagagccccttgttgggagttcaaggagcccgaagctggtctggctggtttgagccccgcgctgccgcacgcccggaagtggctggcggcccccgcgctccgcgcgccggctgcattgttttgggagccctcgctgcccggcttgccgccaggaggtgctgggagtcgcgcctgagtctccatccctgccgtgcgcagtgtccacctctggccagcttgtttgcccggcccgcggcgtcccctgcggcccatcgctgctcctcccggaacccacgccacttagtctggtcccgaccctgcactcgctgctgctgcctttcccacctcaagtcgctctccccactcccttctgcttttgggctaagaccggtccaattgatcactggggaacagggcaataacctcccgcggaggctgggacgcgggcacggagctctgcccatatgagcagcgcagggatgggacactgggtgcccatcccagcgcgcctccccagactggtccctgggatgctcacacgtggcgcggcaccgcggcggcgccttcacgaa

SEQ ID NO: 2476 - DNA, 104 bp, Homo sapiens
  misc_feature 1..104: note = chr4:155412085-155412189
  misc_feature 1..104: note = hyper
  source 1..104: mol_type = genomic DNA
aagctgtagtggtcccgccgctcgcggtccaggcgccgcgcagtgcggatgatgccggtgtccgggtgcacgtggaagtcgtccagcagcggggagtcatcgga

SEQ ID NO: 2477 - DNA, 149 bp, Homo sapiens; identical to SEQ ID NO: 402
  misc_feature 1..149: note = chr4:155663475-155663624
  misc_feature 1..149: note = hyper
  source 1..149: mol_type = genomic DNA

SEQ ID NO: 2478 - DNA, 480 bp, Homo sapiens
  misc_feature 1..480: note = chr4:156129606-156130086
  misc_feature 1..480: note = hyper
  source 1..480: mol_type = genomic DNA
gcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggac

SEQ ID NO: 2479 - DNA, 98 bp, Homo sapiens
  misc_feature 1..98: note = chr4:164265532-164265630
  misc_feature 1..98: note = hyper
  source 1..98: mol_type = genomic DNA
gggggatggacaaagcgctgcccccggctggacgcgctctggctgcagcccggctggcatccggagctgggaacagcagcccgcggggtgcccgggtc

SEQ ID NO: 2480 - DNA, 95 bp, Homo sapiens
  misc_feature 1..95: note = chr4:165305095-165305190
  misc_feature 1..95: note = hyper
  source 1..95: mol_type = genomic DNA
atcctttgtcagttgcgggtggagcgctcctccccagctagcggacgagcagccgggtggcaggcagcccggctctggctcggctccccagtcct

SEQ ID NO: 2481 - DNA, 98 bp, Homo sapiens
  misc_feature 1..98: note = chr4:172733771-172733869
  misc_feature 1..98: note = hyper
  source 1..98: mol_type = genomic DNA
aggttcctgagtgtgcggtcaggggcgttggtgcattgatacgttaggcggagggaggagtaccatctgccagagtcttatctcgagtcccacgtttt

SEQ ID NO: 2482 - DNA, 88 bp, Homo sapiens; identical to SEQ ID NO: 403
  misc_feature 1..88: note = chr4:172734188-172734276
  misc_feature 1..88: note = hyper
  source 1..88: mol_type = genomic DNA

SEQ ID NO: 2483 - DNA, 115 bp, Homo sapiens; identical to SEQ ID NO: 404
  misc_feature 1..115: note = chr4:172734277-172734392
  misc_feature 1..115: note = hyper
  source 1..115: mol_type = genomic DNA

SEQ ID NO: 2484 - DNA, 14 bp, Homo sapiens
  misc_feature 1..14: note = chr4:172734591-172734605
  misc_feature 1..14: note = hyper
  source 1..14: mol_type = genomic DNA
ggggagtggggcgc

SEQ ID NO: 2485 - DNA, 244 bp, Homo sapiens; identical to SEQ ID NO: 406
  misc_feature 1..244: note = chr4:174430310-174430554
  misc_feature 1..244: note = hyper
  source 1..244: mol_type = genomic DNA

SEQ ID NO: 2486 - DNA, 279 bp, Homo sapiens; identical to SEQ ID NO: 407
  misc_feature 1..279: note = chr4:174430793-174431072
  misc_feature 1..279: note = hyper
  source 1..279: mol_type = genomic DNA

SEQ ID NO: 2487 - DNA, 299 bp, Homo sapiens
  misc_feature 1..299: note = chr4:174439888-174440187
  misc_feature 1..299: note = hyper
  source 1..299: mol_type = genomic DNA
cctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggc

SEQ ID NO: 2488 - DNA, 383 bp, Homo sapiens
  misc_feature 1..383: note = chr4:174443551-174443934
  misc_feature 1..383: note = hyper
  source 1..383: mol_type = genomic DNA
agatgtccctaatagcggagataaagacggacagagcggccgggaataaatttgtaatcagggctctaccatctgatcatcaaagcggcccaaatgccgggagaatttgaagggaatgcgtgtgaggggggtcgcttgggggaagaggtgagggtgcacttcgcgatgggaactggcttcggtagggtagagcagggagaacagggcgagagatctgtaagttcggtgcacgtaagtcggatactcggtgctctttaacctccattagccctcagaccgaagccgtttagcggttccaggctgattggagctgcgcagttgctgtgcgggaagcacgcgttgcgcagcggctgggtggtaaggcggcgcgatgagaactgtcc

SEQ ID NO: 2489 - DNA, 360 bp, Homo sapiens
  misc_feature 1..360: note = chr4:174449950-174450310
  misc_feature 1..360: note = hyper
  source 1..360: mol_type = genomic DNA
cctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccat

SEQ ID NO: 2490 - DNA, 162 bp, Homo sapiens
  misc_feature 1..162: note = chr4:174450565-174450727
  misc_feature 1..162: note = hyper
  source 1..162: mol_type = genomic DNA
ggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctc

SEQ ID NO: 2491 - DNA, 173 bp, Homo sapiens
  misc_feature 1..173: note = chr4:174450751-174450924
  misc_feature 1..173: note = hyper
  source 1..173: mol_type = genomic DNA
cgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcg

SEQ ID NO: 2492 - DNA, 243 bp, Homo sapiens; identical to SEQ ID NO: 408
  misc_feature 1..243: note = chr4:174451855-174452098
  misc_feature 1..243: note = hyper
  source 1..243: mol_type = genomic DNA

SEQ ID NO: 2493 - DNA, 435 bp, Homo sapiens
  misc_feature 1..435: note = chr4:175135253-175135688
  misc_feature 1..435: note = hyper
  source 1..435: mol_type = genomic DNA
ctcagccgtcgggtgcgggaggaacgcccttgccaacctcagcctttttgatcttccgcgggcagagactcatcagagccaggaggactgtaactacccccggggcgtgtaccgccgaagcctgaagaggctggttgggccaaaatagcagtcgctgcaggcaccagtttcagcccgtcacctgagtgccggttcctgtgggcgcgccagtctcgcaggcagcgcgcccaagctcgcggatcgccctctcacatttttagaagccaagaaaagcacttttgaaattcactccttcgaccgtgggcagaggagcaggtgggcgccgagccctagctgagggtggggggtcgcggaggagaggaactggaaaatgggaaataggtgtctgctgacctagagttcttcggctttgattttaagcggcagtgaggctgg

SEQ ID NO: 2494 - DNA, 387 bp, Homo sapiens
  misc_feature 1..387: note = chr4:175750264-175750651
  misc_feature 1..387: note = hyper
  source 1..387: mol_type = genomic DNA
caaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccct

SEQ ID NO: 2495 - DNA, 124 bp, Homo sapiens
  misc_feature 1..124: note = chr4:176987050-176987174
  misc_feature 1..124: note = hyper
  source 1..124: mol_type = genomic DNA
gcggagcacgcttcccgcccctcggagcccgcgggcccggccgccccgcccccgggcgccctgagcgagcaggcggggagggcggggagggtccgcgcgttggtggtgctcgcctcgcagctgc

SEQ ID NO: 2496 - skipped

SEQ ID NO: 2497 - DNA, 107 bp, Homo sapiens
  misc_feature 1..107: note = chr4:176987206-176987313
  misc_feature 1..107: note = hyper
  source 1..107: mol_type = genomic DNA
cgctgcagccgcctcctcctccaggtaagaagccggtggggccgcagagataccaaggcaagctcaggattgatgtgggtgatgctggaactgtcgcggcgtcatgc

SEQ ID NO: 2498 - DNA, 13 bp, Homo sapiens
  misc_feature 1..13: note = chr4:176987314-176987327
  misc_feature 1..13: note = hyper
  source 1..13: mol_type = genomic DNA
agaggggctctga

SEQ ID NO: 2499 - DNA, 315 bp, Homo sapiens
  misc_feature 1..315: note = chr4:185941868-185942183
  misc_feature 1..315: note = hyper
  source 1..315: mol_type = genomic DNA
ccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagg

SEQ ID NO: 2500 - DNA, 836 bp, Homo sapiens; identical to SEQ ID NO: 409
  misc_feature 1..836: note = chr5:1294607-1295443
  misc_feature 1..836: note = hyper
  source 1..836: mol_type = genomic DNA

SEQ ID NO: 2501 - DNA, 75 bp, Homo sapiens; identical to SEQ ID NO: 410
  misc_feature 1..75: note = chr5:1295604-1295679
  misc_feature 1..75: note = hyper
  source 1..75: mol_type = genomic DNA

SEQ ID NO: 2502 - DNA, 126 bp, Homo sapiens
  misc_feature 1..126: note = chr5:1446236-1446362
  misc_feature 1..126: note = hyper
  source 1..126: mol_type = genomic DNA
cgcactcgcctaagaaaaccatttcccgggacgggcctggaaagccctggcggttggtatccggctccagggccgaatggactccgaggctttccttccgagatgcccgggcgggatttcttccat

SEQ ID NO: 2503 - DNA, 517 bp, Homo sapiens; identical to SEQ ID NO: 411
  misc_feature 1..517: note = chr5:1875025-1875542
  misc_feature 1..517: note = hyper
  source 1..517: mol_type = genomic DNA

SEQ ID NO: 2504 - DNA, 478 bp, Homo sapiens; identical to SEQ ID NO: 412
  misc_feature 1..478: note = chr5:1875829-1876307
  misc_feature 1..478: note = hyper
  source 1..478: mol_type = genomic DNA

SEQ ID NO: 2505 - DNA, 223 bp, Homo sapiens; identical to SEQ ID NO: 413
  misc_feature 1..223: note = chr5:1876637-1876860
  misc_feature 1..223: note = hyper
  source 1..223: mol_type = genomic DNA

SEQ ID NO: 2506 - DNA, 28 bp, Homo sapiens
  misc_feature 1..28: note = chr5:1877194-1877222
  misc_feature 1..28: note = hyper
  source 1..28: mol_type = genomic DNA
cgatgggctcccacgcccccccccggga

SEQ ID NO: 2507 - DNA, 15 bp, Homo sapiens
  misc_feature 1..15: note = chr5:1878014-1878029
  misc_feature 1..15: note = hyper
  source 1..15: mol_type = genomic DNA
ctcagtgaaaagagt

SEQ ID NO: 2508 - DNA, 354 bp, Homo sapiens
  misc_feature 1..354: note = chr5:1878223-1878577
  misc_feature 1..354: note = hyper
  source 1..354: mol_type = genomic DNA
cgagcgtcccagaggcccggggtccaggagggcgcccttggcggtggcccaggcctggttcaaagtgctgtgcctgaggatggggtcgtggaagaccccgtccacccagtttctgagactggttaccggggagtcctggtgcctgtccagggcgccagagtggggaagggccacagacggggacgtggcgggcgcggaggacacagccgcaggggccgcgggaccttggcgcttgagcatgcacgacggaaactcagtctggctcagggaggtggcggcggcggcggcggcggtggctgtgtgggccagggaccagatgcgcggcttagcctccaggcctgccgacgcccccgc

SEQ ID NO: 2509 - DNA, 43 bp, Homo sapiens
  misc_feature 1..43: note = chr5:1878830-1878873
  misc_feature 1..43: note = hyper
  source 1..43: mol_type = genomic DNA
ggcggctctgcttccagcgggtcgaagtcgtccaagtcactaa

SEQ ID NO: 2510 - DNA, 503 bp, Homo sapiens
  misc_feature 1..503: note = chr5:1882419-1882922
  misc_feature 1..503: note = hyper
  source 1..503: mol_type = genomic DNA
cgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaac

SEQ ID NO: 2511 - DNA, 187 bp, Homo sapiens; identical to SEQ ID NO: 414
  misc_feature 1..187: note = chr5:1883430-1883617
  misc_feature 1..187: note = hyper
  source 1..187: mol_type = genomic DNA

SEQ ID NO: 2512 - DNA, 347 bp, Homo sapiens; identical to SEQ ID NO: 415
  misc_feature 1..347: note = chr5:1883879-1884226
  misc_feature 1..347: note = hyper
  source 1..347: mol_type = genomic DNA

SEQ ID NO: 2513 - DNA, 174 bp, Homo sapiens; identical to SEQ ID NO: 416
  misc_feature 1..174: note = chr5:1884557-1884731
  misc_feature 1..174: note = hyper
  source 1..174: mol_type = genomic DNA

SEQ ID NO: 2514 - DNA, 67 bp, Homo sapiens; identical to SEQ ID NO: 417
  misc_feature 1..67: note = chr5:1885314-1885381
  misc_feature 1..67: note = hyper
  source 1..67: mol_type = genomic DNA

SEQ ID NO: 2515 - DNA, 103 bp, Homo sapiens; identical to SEQ ID NO: 418
  misc_feature 1..103: note = chr5:1886739-1886842
  misc_feature 1..103: note = hyper
  source 1..103: mol_type = genomic DNA

SEQ ID NO: 2516 - DNA, 149 bp, Homo sapiens; identical to SEQ ID NO: 419
  misc_feature 1..149: note = chr5:1886997-1887146
  misc_feature 1..149: note = hyper
  source 1..149: mol_type = genomic DNA

SEQ ID NO: 2517 - DNA, 36 bp, Homo sapiens; identical to SEQ ID NO: 420
  misc_feature 1..36: note = chr5:1887546-1887582
  misc_feature 1..36: note = hyper
  source 1..36: mol_type = genomic DNA

SEQ ID NO: 2518 - DNA, 101 bp, Homo sapiens; identical to SEQ ID NO: 421
  misc_feature 1..101: note = chr5:1887655-1887756
  misc_feature 1..101: note = hyper
  source 1..101: mol_type = genomic DNA

SEQ ID NO: 2519 - DNA, 31 bp, Homo sapiens; identical to SEQ ID NO: 422
  misc_feature 1..31: note = chr5:1930974-1931005
  misc_feature 1..31: note = hyper
  source 1..31: mol_type = genomic DNA

SEQ ID NO: 2520 - DNA, 223 bp, Homo sapiens; identical to SEQ ID NO: 423
  misc_feature 1..223: note = chr5:1931064-1931287
  misc_feature 1..223: note = hyper
  source 1..223: mol_type = genomic DNA

SEQ ID NO: 2521 - DNA, 133 bp, Homo sapiens; identical to SEQ ID NO: 424
  misc_feature 1..133: note = chr5:1931444-1931577
  misc_feature 1..133: note = hyper
  source 1..133: mol_type = genomic DNA

SEQ ID NO: 2522 - DNA, 349 bp, Homo sapiens; identical to SEQ ID NO: 425
  misc_feature 1..349: note = chr5:1931617-1931966
  misc_feature 1..349: note = hyper
  source 1..349: mol_type = genomic DNA

SEQ ID NO: 2523 - DNA, 424 bp, Homo sapiens
  misc_feature 1..424: note = chr5:2038439-2038863
  misc_feature 1..424: note = hyper
  source 1..424: mol_type = genomic DNA
cggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagccaacaggtggcacaaacgcatttgacttgggcatcgatcgccgcgcccgcccggggccgcacctccgccgccagcgtccctccagcccggccccgatgccgcgcaggcgcagtgctcttctctccgcgggccgggccgggtcagggtcaggatctgacc

SEQ ID NO: 2524 - DNA, 160 bp, Homo sapiens
  misc_feature 1..160: note = chr5:2738820-2738980
  misc_feature 1..160: note = hyper
  source 1..160: mol_type = genomic DNA
ccacccccagccgcacgcttgggcctccctcctcctgtgcctccgggaccgtctccccacctgcgggaggccaggtgtgtggctccagagaccctccacctgaactacccgctcccagagccccagtcagggccgccagaggtcgcggagggtgaagcca

SEQ ID NO: 2525 - DNA, 43 bp, Homo sapiens
  misc_feature 1..43: note = chr5:2743617-2743660
  misc_feature 1..43: note = hyper
  source 1..43: mol_type = genomic DNA
gtcgcggatccaccacgcgggcgccgggccgcggagccgggag

SEQ ID NO: 2526 - DNA, 46 bp, Homo sapiens
  misc_feature 1..46: note = chr5:2743698-2743744
  misc_feature 1..46: note = hyper
  source 1..46: mol_type = genomic DNA
cgccccaaagcccatctgctcctggtcgccccgttttgccgacgtc

SEQ ID NO: 2527 - DNA, 83 bp, Homo sapiens
  misc_feature 1..83: note = chr5:2751854-2751937
  misc_feature 1..83: note = hyper
  source 1..83: mol_type = genomic DNA
gcgctcatctgcatattcgggggcccgcccctcccctgctccgcccgctgcagcctccgggccgcggccgggggaggggcaga

SEQ ID NO: 2528 - DNA, 326 bp, Homo sapiens
  misc_feature 1..326: note = chr5:2755916-2756242
  misc_feature 1..326: note = hyper
  source 1..326: mol_type = genomic DNA
gatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttct

SEQ ID NO: 2529 - DNA, 253 bp, Homo sapiens; identical to SEQ ID NO: 426
  misc_feature 1..253: note = chr5:3590405-3590658
  misc_feature 1..253: note = hyper
  source 1..253: mol_type = genomic DNA

SEQ ID NO: 2530 - DNA, 844 bp, Homo sapiens; identical to SEQ ID NO: 427
  misc_feature 1..844: note = chr5:6448738-6449582
  misc_feature 1..844: note = hyper
  source 1..844: mol_type = genomic DNA

SEQ ID NO: 2531 - DNA, 101 bp, Homo sapiens
  misc_feature 1..101: note = chr5:7395293-7395394
  misc_feature 1..101: note = hyper
  source 1..101: mol_type = genomic DNA
gtgactgaagctgagcgtgcagggcgcaacggacgctgcccccgcgaggccgtggcgggggctcccagtgcagtcactgccgcttcacttccacatggtgc

SEQ ID NO: 2532 - DNA, 113 bp, Homo sapiens
  misc_feature 1..113: note = chr5:7395433-7395546
  misc_feature 1..113: note = hyper
  source 1..113: mol_type = genomic DNA
cgccctcgcagggagccccggccctctcaagagggtggagaggatgggggagccctcaaccctgctacgctgaggggaagaagggctggacggcaaaccggtgcccaccgcgg

SEQ ID NO: 2533 - DNA, 496 bp, Homo sapiens
  misc_feature 1..496: note = chr5:10333618-10334114
  misc_feature 1..496: note = hyper
  source 1..496: mol_type = genomic DNA
tgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcagga

SEQ ID NO: 2534 - DNA, 31 bp, Homo sapiens; identical to SEQ ID NO: 428
  misc_feature 1..31: note = chr5:10564628-10564659
  misc_feature 1..31: note = hyper
  source 1..31: mol_type = genomic DNA

SEQ ID NO: 2535 - DNA, 428 bp, Homo sapiens; identical to SEQ ID NO: 429
  misc_feature 1..428: note = chr5:10564800-10565228
  misc_feature 1..428: note = hyper
  source 1..428: mol_type = genomic DNA

SEQ ID NO: 2536 - skipped

SEQ ID NO: 2537 - DNA, 358 bp, Homo sapiens; identical to SEQ ID NO: 431
  misc_feature 1..358: note = chr5:10565264-10565622
  misc_feature 1..358: note = hyper
  source 1..358: mol_type = genomic DNA

SEQ ID NO: 2538 - DNA, 88 bp, Homo sapiens
  misc_feature 1..88: note = chr5:11904455-11904543
  misc_feature 1..88: note = hyper
  source 1..88: mol_type = genomic DNA
cggcgcgcggcagcctcagcctccacctaaacctcggcggccggcccgggcgcccggctagtgagggagcgtccgccccgccgccgaa

SEQ ID NO: 2539 - DNA, 28 bp, Homo sapiens
  misc_feature 1..28: note = chr5:16179554-16179582
  misc_feature 1..28: note = hyper
  source 1..28: mol_type = genomic DNA
cggggaccggggccggctctcccggcgg

SEQ ID NO: 2540 - DNA, 139 bp, Homo sapiens
  misc_feature 1..139: note = chr5:16180182-16180321
  misc_feature 1..139: note = hyper
  source 1..139: mol_type = genomic DNA
cgtgagctgggaagtagggggcaggggagaggccgcgggtccagaaaccgttactggatgggccggtgggatgtggcgcgggccgggtggggcgcgacagtctgagccgagacccgcgtgggcttaagggtgcgcgagg

SEQ ID NO: 2541 - DNA, 53 bp, Homo sapiens
  misc_feature 1..53: note = chr5:16180371-16180424
  misc_feature 1..53: note = hyper
  source 1..53: mol_type = genomic DNA
cgcgggacccgggactgtaaccgccacttccaggccctcgctccccgcgcttg

SEQ ID NO: 2542 - DNA, 121 bp, Homo sapiens
  misc_feature 1..121: note = chr5:22853104-22853225
  misc_feature 1..121: note = hyper
  source 1..121: mol_type = genomic DNA
gcatgcaccctgaagcgatcacacacacgcggtgcaatcccaatcaaaaacggaagccttacctgatggcagaaaaggcagctgcaggagcagcagcaccgacggccgcagcagggtgcca

SEQ ID NO: 2543 - DNA, 159 bp, Homo sapiens
  misc_feature 1..159: note = chr5:31639686-31639845
  misc_feature 1..159: note = hyper
  source 1..159: mol_type = genomic DNA
ggggagtgaggacgccgaaccggggtcccacgttgggcggcgcaaactcctctagcatccggccggggacggggagggcgcagcccaggggagggggctagacagagcgggaccgagacagcgggacaaccggagacgcactgccgggggtactcaaga

SEQ ID NO: 2544 - DNA, 99 bp, Homo sapiens
  misc_feature 1..99: note = chr5:32711765-32711864
  misc_feature 1..99: note = hyper
  source 1..99: mol_type = genomic DNA
aagcgcccaagggggcgcagggaccttggagagaagagtggggaggaaagaggaagggtgggtggggggcagagggcgagtcggcggcggcgagggcaa

SEQ ID NO: 2545 - DNA, 25 bp, Homo sapiens
  misc_feature 1..25: note = chr5:32712077-32712102
  misc_feature 1..25: note = hyper
  source 1..25: mol_type = genomic DNA
ttgttttcactcacccgggtgcggc

SEQ ID NO: 2546 - DNA, 563 bp, Homo sapiens
  misc_feature 1..563: note = chr5:32712289-32712852
  misc_feature 1..563: note = hyper
  source 1..563: mol_type = genomic DNA
cgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagaggtgagcaggggcgcgtcccgggccccgggccctaacccaaccgctctccgcggctctccctgcacactcgtccactctgcagaccccactccccactgcggcgctgaggtcgggtgcgcgcgggcactcgttcaggtatgcgccgtgtggctgcgacaacctttgacgaccgcccatcgcggtgtacgtagagggtcccag

SEQ ID NO: 2547 - DNA, 1728 bp, Homo sapiens
  misc_feature 1..1728: note = chr5:37836649-37838377
  misc_feature 1..1728: note = hyper
  source 1..1728: mol_type = genomic DNA
agctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagaga

SEQ ID NO: 2548 - DNA, 285 bp, Homo sapiens
  misc_feature 1..285: note = chr5:37838600-37838885
  misc_feature 1..285: note = hyper
  source 1..285: mol_type = genomic DNA
agttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacag

SEQ ID NO: 2549 - DNA, 268 bp, Homo sapiens
  misc_feature 1..268: note = chr5:37839807-37840075
  misc_feature 1..268: note = hyper
  source 1..268: mol_type = genomic DNA
cgccaacagggcgagggctgccggcaactctcccgccgggcccccgcacccccagaagccgaggtccgagcagccgccgctgctttgggtggggggctgacagggctgcgcgcgtcgcgctcttggctggggctgcgcgggcccggggcgctgcgggcggctcagcggcagctgccgcgctctgcgcctcctctgggcgcactgcctgggagcacgagactggtttgtctgatgctgctgccggagctgaggtcttgcctggagatcc

SEQ ID NO: 2550 - DNA, 144 bp, Homo sapiens
  misc_feature 1..144: note = chr5:37840076-37840220
  misc_feature 1..144: note = hyper
  source 1..144: mol_type = genomic DNA
aacgagacaccacgtcaaccggcgcggggagtcccgtgaagacatgagggcgccaggagcgcaggctggtcttctagagcccgggctgggggtccggggtccggggtgggggaggggaggcgcggggccccgggagggaggggt

SEQ ID NO: 2551 - DNA, 96 bp, Homo sapiens
  misc_feature 1..96: note = chr5:37840267-37840363
  misc_feature 1..96: note = hyper
  source 1..96: mol_type = genomic DNA
cgaggaggccctggagttcccgaggcggggggccggggtgcgagtgggcgacgcgaggcgcccctccctgggctgcagggagagcgctgagagcgc

SEQ ID NO: 2552 - DNA, 187 bp, Homo sapiens
  misc_feature 1..187: note = chr5:37840529-37840716
  misc_feature 1..187: note = hyper
  source 1..187: mol_type = genomic DNA
ggtgcagggcagcgccgggctttcctcgcgcctgtcgaaggccggccttcccgctcgggtgtctcgccctctcgcttctccgcagggcaggaggcagtggcgagaaaaggagctgccggccggagttctagcaccgagaaggagaggtgcggagcggccgggtgagggaagccgagtatttgccagg

SEQ ID NO: 2553 - DNA, 67 bp, Homo sapiens
  misc_feature 1..67: note = chr5:38257842-38257909
  misc_feature 1..67: note = hyper
  source 1..67: mol_type = genomic DNA
gccaggaccccgccccggccccctgccccaggcccagctgggcgccgcccaggggcttttctcggtc

SEQ ID NO: 2554 - DNA, 15 bp, Homo sapiens
  misc_feature 1..15: note = chr5:38257944-38257959
  misc_feature 1..15: note = hyper
  source 1..15: mol_type = genomic DNA
cgccaggcttaactt

SEQ ID NO: 2555 - DNA, 207 bp, Homo sapiens; identical to SEQ ID NO: 432
  misc_feature 1..207: note = chr5:42951105-42951312
  misc_feature 1..207: note = hyper
  source 1..207: mol_type = genomic DNA

SEQ ID NO: 2556 - DNA, 693 bp, Homo sapiens; identical to SEQ ID NO: 433
  misc_feature 1..693: note = chr5:42951419-42952112
  misc_feature 1..693: note = hyper
  source 1..693: mol_type = genomic DNA

SEQ ID NO: 2557 - DNA, 457 bp, Homo sapiens; identical to SEQ ID NO: 434
  misc_feature 1..457: note = chr5:42991785-42992242
  misc_feature 1..457: note = hyper
  source 1..457: mol_type = genomic DNA

SEQ ID NO: 2558 - DNA, 180 bp, Homo sapiens; identical to SEQ ID NO: 435
  misc_feature 1..180: note = chr5:42992375-42992555
  misc_feature 1..180: note = hyper
  source 1..180: mol_type = genomic DNA

SEQ ID NO: 2559 - DNA, 42 bp, Homo sapiens; identical to SEQ ID NO: 436
  misc_feature 1..42: note = chr5:42992556-42992598
  misc_feature 1..42: note = hyper
  source 1..42: mol_type = genomic DNA

SEQ ID NO: 2560 - DNA, 239 bp, Homo sapiens; identical to SEQ ID NO: 437
  misc_feature 1..239: note = chr5:42992782-42993021
  misc_feature 1..239: note = hyper
  source 1..239: mol_type = genomic DNA

SEQ ID NO: 2561 - DNA, 240 bp, Homo sapiens; identical to SEQ ID NO: 438
  misc_feature 1..240: note = chr5:42993321-42993561
  misc_feature 1..240: note = hyper
  source 1..240: mol_type = genomic DNA

SEQ ID NO: 2562 - DNA, 276 bp, Homo sapiens; identical to SEQ ID NO: 439
  misc_feature 1..276: note = chr5:42993861-42994137
  misc_feature 1..276: note = hyper
  source 1..276: mol_type = genomic DNA

SEQ ID NO: 2563 - DNA, 224 bp, Homo sapiens
  misc_feature 1..224: note = chr5:43017953-43018177
  misc_feature 1..224: note = hyper
  source 1..224: mol_type = genomic DNA
gcacccagtgccagtcgatccgtcacggcgccgcaaactttccctgaacggagggtttgtggctgacatctctagtttctcagagcctgggagtgatcactggctgcaccgctgatggcgcccaaaagaacgcgcatttgtctttggcaacagcgctgggtttcgcctcgtgcccgcgcctgaagggtcctagcgccgccagattctcacactcgcgggtccag

SEQ ID NO: 2564 - DNA, 325 bp, Homo sapiens
  misc_feature 1..325: note = chr5:43018326-43018651
  misc_feature 1..325: note = hyper
  source 1..325: mol_type = genomic DNA
cgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcg

SEQ ID NO: 2565 - DNA, 156 bp, Homo sapiens
  misc_feature 1..156: note = chr5:43019191-43019347
  misc_feature 1..156: note = hyper
  source 1..156: mol_type = genomic DNA
gcaagtcctgccgaacgcgactttttcctcttgtggaccaagtctgaatagaccagctactgcgatttttaagtcgtagtaaaaaaggtttaaccgtgactgcttttttttgttggtgttgtttgtttttgtttttgttttcgtaggaaatgtaga

SEQ ID NO: 2566 - DNA, 157 bp, Homo sapiens; identical to SEQ ID NO: 440
  misc_feature 1..157: note = chr5:50263484-50263641
  misc_feature 1..157: note = hyper
  source 1..157: mol_type = genomic DNA

SEQ ID NO: 2567 - DNA, 142 bp, Homo sapiens
  misc_feature 1..142: note = chr5:50264500-50264642
  misc_feature 1..142: note = hyper
  source 1..142: mol_type = genomic DNA
gaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcagg

SEQ ID NO: 2568 - DNA, 347 bp, Homo sapiens; identical to SEQ ID NO: 441
  misc_feature 1..347: note = chr5:54516334-54516681
  misc_feature 1..347: note = hyper
  source 1..347: mol_type = genomic DNA

SEQ ID NO: 2569 - DNA, 96 bp, Homo sapiens; identical to SEQ ID NO: 442
  misc_feature 1..96: note = chr5:54516831-54516927
  misc_feature 1..96: note = hyper
  source 1..96: mol_type = genomic DNA

SEQ ID NO: 2570 - DNA, 156 bp, Homo sapiens; identical to SEQ ID NO: 443
  misc_feature 1..156: note = chr5:54519133-54519289
  misc_feature 1..156: note = hyper
  source 1..156: mol_type = genomic DNA

SEQ ID NO: 2571 - DNA, 166 bp, Homo sapiens
  misc_feature 1..166: note = chr5:59189863-59190029
  misc_feature 1..166: note = hyper
  source 1..166: mol_type = genomic DNA
ccgcctccagggcaccggaaccctgatcccggagctgctgaaaagttggacagctccaggctggcacgcccgagctgtgactttcaccaaaaccactccagccagtcaggagtcagacctgtcctcttgatccttcccctcgccgtgcccgcgcctccctcctcca

SEQ ID NO: 2572 - DNA, 80 bp, Homo sapiens; identical to SEQ ID NO: 444
  misc_feature 1..80: note = chr5:63255163-63255243
  misc_feature 1..80: note = hyper
  source 1..80: mol_type = genomic DNA

SEQ ID NO: 2573 - DNA, 395 bp, Homo sapiens
  misc_feature 1..395: note = chr5:63801877-63802272
  misc_feature 1..395: note = hyper
  source 1..395: mol_type = genomic DNA
acaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagc

SEQ ID NO: 2574 - DNA, 32 bp, Homo sapiens
  misc_feature 1..32: note = chr5:63802273-63802305
  misc_feature 1..32: note = hyper
  source 1..32: mol_type = genomic DNA
cttccccggctctccttcaagctgaaggttac

SEQ ID NO: 2575 - DNA, 166 bp, Homo sapiens
  misc_feature 1..166: note = chr5:63802339-63802505
  misc_feature 1..166: note = hyper
  source 1..166: mol_type = genomic DNA
cgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcc

SEQ ID NO: 2576 - DNA, 194 bp, Homo sapiens
  misc_feature 1..194: note = chr5:71014720-71014914
  misc_feature 1..194: note = hyper
  source 1..194: mol_type = genomic DNA
ctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatct

SEQ ID NO: 2577 - DNA, 481 bp, Homo sapiens; identical to SEQ ID NO: 445
  misc_feature 1..481: note = chr5:72529345-72529826
  misc_feature 1..481: note = hyper
  source 1..481: mol_type = genomic DNA

SEQ ID NO: 2578 - DNA, 374 bp, Homo sapiens; identical to SEQ ID NO: 446
  misc_feature 1..374: note = chr5:72529889-72530263
  misc_feature 1..374: note = hyper
  source 1..374: mol_type = genomic DNA

SEQ ID NO: 2579 - DNA, 35 bp, Homo sapiens; identical to SEQ ID NO: 447
  misc_feature 1..35: note = chr5:72594802-72594837
  misc_feature 1..35: note = hyper
  source 1..35: mol_type = genomic DNA

SEQ ID NO: 2580 - DNA, 71 bp, Homo sapiens; identical to SEQ ID NO: 448
  misc_feature 1..71: note = chr5:72594867-72594938
  misc_feature 1..71: note = hyper
  source 1..71: mol_type = genomic DNA

SEQ ID NO: 2581 - DNA, 383 bp, Homo sapiens; identical to SEQ ID NO: 449
  misc_feature 1..383: note = chr5:72599059-72599442
  misc_feature 1..383: note = hyper
  source 1..383: mol_type = genomic DNA

SEQ ID NO: 2582 - DNA, 371 bp, Homo sapiens; identical to SEQ ID NO: 450
  misc_feature 1..371: note = chr5:72599462-72599833
  misc_feature 1..371: note = hyper
  source 1..371: mol_type = genomic DNA

SEQ ID NO: 2583 - DNA, 126 bp, Homo sapiens
  misc_feature 1..126: note = chr5:75380067-75380193
  misc_feature 1..126: note = hyper
  source 1..126: mol_type = genomic DNA
caggcgaagcagacccgaggctgtgaagctcagaggggagagggaccaatcgcagtaaataagctaccgaggtaatcttagatggcgatgagggcagcaaaagccatcagccgaccctctgaccct

SEQ ID NO: 2584 - DNA, 452 bp, Homo sapiens
  misc_feature 1..452: note = chr5:75380422-75380874
  misc_feature 1..452: note = hyper
  source 1..452: mol_type = genomic DNA
gggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcggagagcggcgacccggcggggcagaggggggcgggaggactgcggcggcgcggggcggcgaggaaagccccgcacggcctgggctggcgggcaggcggctccgcagtgcgccgcagtgccgggaaggagccgcagctaccgggcgctccccgggggaccgaggagatgaggcgtcttttaaggctcatgagagccttaaggagatgagaccgggatgccgtgatggtctcctctcccgctgaacctaatcc

SEQ ID NO: 2585 - DNA, 92 bp, Homo sapiens; identical to SEQ ID NO: 451
  misc_feature 1..92: note = chr5:76249579-76249671
  misc_feature 1..92: note = hyper
  source 1..92: mol_type = genomic DNA

SEQ ID NO: 2586 - DNA, 212 bp, Homo sapiens; identical to SEQ ID NO: 452
  misc_feature 1..212: note = chr5:76249695-76249907
  misc_feature 1..212: note = hyper
  source 1..212: mol_type = genomic DNA

SEQ ID NO: 2587 - DNA, 174 bp, Homo sapiens; identical to SEQ ID NO: 453
  misc_feature 1..174: note = chr5:76249944-76250118
  misc_feature 1..174: note = hyper
  source 1..174: mol_type = genomic DNA

SEQ ID NO: 2588 - DNA, 345 bp, Homo sapiens; identical to SEQ ID NO: 454
  misc_feature 1..345: note = chr5:76923679-76924024
  misc_feature 1..345: note = hyper
  source 1..345: mol_type = genomic DNA

SEQ ID NO: 2589 - DNA, 214 bp, Homo sapiens; identical to SEQ ID NO: 455
  misc_feature 1..214: note = chr5:76924086-76924300
  misc_feature 1..214: note = hyper
  source 1..214: mol_type = genomic DNA

SEQ ID NO: 2590 - DNA, 262 bp, Homo sapiens
  misc_feature 1..262: note = chr5:76928678-76928940
  misc_feature 1..262: note = hyper
  source 1..262: mol_type = genomic DNA
caattgagctgttagcggtcttaggcggagagcatctctcaggaggaaaggaaggcacagcgagaagacctaaggccgaaagtcgctgtgcagcacccacccaaggctggactcgggggaggtagacgggacggtgtctgtgactaaacggttcccacaccttacacgccgcaccgggattatgttttgaaaggtgtcttataaaatcaagaccggttcctaacaacctgcaagtgccagtgaatcccgaaatgtttgtttg

SEQ ID NO: 2591 - DNA, 984 bp, Homo sapiens
  misc_feature 1..984: note = chr5:76932282-76933266
  misc_feature 1..984: note = hyper
  source 1..984: mol_type = genomic DNA
tatttgtcaataatgcgagcaggagttgaggtgtgcgctcggctgggccgcccgggggggcgctgaggttgccttctcaggcggaggaggcgaaccctgtagcccgacaacgccgggcttcgattttgaggagcttcttccgggatgtcgctatactggccggagacgggccttgcgtgtccattgggggatggcgatggggaccagtttccgggtagagaaggagataactcgatacaggaacgcacaggcagcctgaaagcagcccaggatctcgacaggggaagggaagaccctgctccctttgcccaaatcctcccgccctgtccttgccttctgtcccagatcccaagcccctcgtacctgcactcgggactcggtcagcccgatacgcagtgccagctcctcacgcataaagatgtcggggtagtgagtcttggcgaagctcctctccaactcgttgagctgtgcgggggtgaagcgcgtccggtggcgcttctgcttctgttggccctgctgctggccggcttggctggggttcgggccgccctggggcccgggctgcttgtccgggtctttggcgctcaccgccagcgaggccggagtagagcccactgtggtgatgtcctccccgggcagcagagtggctccctccactgggtcagagttgggcgccaggtcccccggatggcccccggggtcggagccccccacgcccagcctacacttcaccgcctcccggtggcccagaagctcggcggcatctttcatacctgaggaggcaaggggatcgcggtcactactttcttggcgatgccaggaggggctgtcttccccgcgcagccttccttcaacccgtcctcggccccctccgcacccgcgcttgtcctaaggaagaaactcccagggtattcagctgggttccccagaatttggacagccgggttggaataatatctcccggccccttgccctcgccgcagc

SEQ ID NO: 2592 - DNA, 323 bp, Homo sapiens; identical to SEQ ID NO: 456
  misc_feature 1..323: note = chr5:76934331-76934654
  misc_feature 1..323: note = hyper
  source 1..323: mol_type = genomic DNA

SEQ ID NO: 2593 - DNA, 194 bp, Homo sapiens; identical to SEQ ID NO: 457
  misc_feature 1..194: note = chr5:76934676-76934870
  misc_feature 1..194: note = hyper
  source 1..194: mol_type = genomic DNA

SEQ ID NO: 2594 - DNA, 602 bp, Homo sapiens; identical to SEQ ID NO: 458
  misc_feature 1..602: note = chr5:76936119-76936721
  misc_feature 1..602: note = hyper
  source 1..602: mol_type = genomic DNA

SEQ ID NO: 2595 - DNA, 182 bp, Homo sapiens; identical to SEQ ID NO: 459
  misc_feature 1..182: note = chr5:77140529-77140711
  misc_feature 1..182: note = hyper
  source 1..182: mol_type = genomic DNA

SEQ ID NO: 2596 - DNA, 101 bp, Homo sapiens; identical to SEQ ID NO: 460
  misc_feature 1..101: note = chr5:77147549-77147650
  misc_feature 1..101: note = hyper
  source 1..101: mol_type = genomic DNA

SEQ ID NO: 2597 - DNA, 260 bp, Homo sapiens; identical to SEQ ID NO: 461
  misc_feature 1..260: note = chr5:77147872-77148132
  misc_feature 1..260: note = hyper
  source 1..260: mol_type = genomic DNA

SEQ ID NO: 2598 - DNA, 280 bp, Homo sapiens; identical to SEQ ID NO: 462
  misc_feature 1..280: note = chr5:77148393-77148673
  misc_feature 1..280: note = hyper
  source 1..280: mol_type = genomic DNA

SEQ ID NO: 2599 - DNA, 367 bp, Homo sapiens; identical to SEQ ID NO: 463
  misc_feature 1..367: note = chr5:77268367-77268734
  misc_feature 1..367: note = hyper
  source 1..367: mol_type = genomic DNA

SEQ ID NO: 2600 - DNA, 227 bp, Homo sapiens; identical to SEQ ID NO: 464
  misc_feature 1..227: note = chr5:77268735-77268962
  misc_feature 1..227: note = hyper
  source 1..227: mol_type = genomic DNA

SEQ ID NO: 2601 - DNA, 583 bp, Homo sapiens
  misc_feature 1..583: note = chr5:79864862-79865445
  misc_feature 1..583: note = hyper
  source 1..583: mol_type = genomic DNA
acccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 2602 - DNA, 71 bp, Homo sapiens
  misc_feature 1..71: note = chr5:79865522-79865593
  misc_feature 1..71: note = hyper
  source 1..71: mol_type = genomic DNA
cgcatcctcctcgacaccccgcggccgggcagccctcgccggttcccgccgctcggcgaggctgagaagga

SEQ ID NO: 2603 - DNA, 315 bp, Homo sapiens
  misc_feature 1..315: note = chr5:79866099-79866414
  misc_feature 1..315: note = hyper
  source 1..315: mol_type = genomic DNA
gcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctc

SEQ ID NO: 2604 - DNA, 105 bp, Homo sapiens
  misc_feature 1..105: note = chr5:80689690-80689795
  misc_feature 1..105: note = hyper
  source 1..105: mol_type = genomic DNA
cagggttcagctctccgcaagtaccttcctcgccttcctaccccccccagcccccagccgccgccgctcccgcagccccggtcccgcgcctccccgcagccccgg

SEQ ID NO: 2605 - DNA, 364 bp, Homo sapiens; identical to SEQ ID NO: 465
  misc_feature 1..364: note = chr5:82767429-82767793
  misc_feature 1..364: note = hyper
  source 1..364: mol_type = genomic DNA

SEQ ID NO: 2606 - DNA, 63 bp, Homo sapiens; identical to SEQ ID NO: 466
  misc_feature 1..63: note = chr5:87955602-87955665
  misc_feature 1..63: note = hyper
  source 1..63: mol_type = genomic DNA

SEQ ID NO: 2607 - DNA, 495 bp, Homo sapiens; identical to SEQ ID NO: 467
  misc_feature 1..495: note = chr5:87956168-87956663
  misc_feature 1..495: note = hyper
  source 1..495: mol_type = genomic DNA

SEQ ID NO: 2608 - DNA, 427 bp, Homo sapiens; identical to SEQ ID NO: 468
  misc_feature 1..427: note = chr5:87956679-87957106
  misc_feature 1..427: note = hyper
  source 1..427: mol_type = genomic DNA

SEQ ID NO: 2609 - DNA, 304 bp, Homo sapiens; identical to SEQ ID NO: 469
  misc_feature 1..304: note = chr5:87967773-87968077
  misc_feature 1..304: note = hyper
  source 1..304: mol_type = genomic DNA

SEQ ID NO: 2610 - DNA, 11 bp, Homo sapiens
  misc_feature 1..11: note = chr5:87968675-87968686
  misc_feature 1..11: note = hyper
  source 1..11: mol_type = genomic DNA
gcaccggctag

SEQ ID NO: 2611 - DNA, 86 bp, Homo sapiens; identical to SEQ ID NO: 471
  misc_feature 1..86: note = chr5:87968772-87968858
  misc_feature 1..86: note = hyper
  source 1..86: mol_type = genomic DNA

SEQ ID NO: 2612 - DNA, 73 bp, Homo sapiens; identical to SEQ ID NO: 472
  misc_feature 1..73: note = chr5:87970041-87970114
  misc_feature 1..73: note = hyper
  source 1..73: mol_type = genomic DNA

SEQ ID NO: 2613 - DNA, 792 bp, Homo sapiens; identical to SEQ ID NO: 473
  misc_feature 1..792: note = chr5:87970115-87970907
  misc_feature 1..792: note = hyper
  source 1..792: mol_type = genomic DNA

SEQ ID NO: 2614 - DNA, 124 bp, Homo sapiens; identical to SEQ ID NO: 474
  misc_feature 1..124: note = chr5:88185263-88185387
  misc_feature 1..124: note = hyper
  source 1..124: mol_type = genomic DNA

SEQ ID NO: 2615 - DNA, 399 bp, Homo sapiens; identical to SEQ ID NO: 475
  misc_feature 1..399: note = chr5:88185388-88185787
  misc_feature 1..399: note = hyper
  source 1..399: mol_type = genomic DNA

SEQ ID NO: 2616 - DNA, 12 bp, Homo sapiens
  misc_feature 1..12: note = chr5:92940177-92940189
  misc_feature 1..12: note = hyper
  source 1..12: mol_type = genomic DNA
ggggtgggccgg

SEQ ID NO: 2617 - DNA, 59 bp, Homo sapiens
  misc_feature 1..59: note = chr5:95769034-95769093
  misc_feature 1..59: note = hyper
  source 1..59: mol_type = genomic DNA
acctggactaagatccgaatggtattcccggcggggcggagaagcggctaaaataagca

SEQ ID NO: 2618 - DNA, 95 bp, Homo sapiens
  misc_feature 1..95: note = chr5:100238882-100238977
  misc_feature 1..95: note = hyper
  source 1..95: mol_type = genomic DNA
agggtcgctccgcgccgcctccctggggctcaggtttcttttcagatgagacaccttgtgcattggaggtggcggcagcttctgcagctgggttc

SEQ ID NO: 2619 - DNA, 44 bp, Homo sapiens
  misc_feature 1..44: note = chr5:100238978-100239022
  misc_feature 1..44: note = hyper
  source 1..44: mol_type = genomic DNA
ggggcgtcactggcccttccctcttgctaggagataaacgctgc

SEQ ID NO: 2620 - DNA, 97 bp, Homo sapiens
  misc_feature 1..97: note = chr5:100239023-100239120
  misc_feature 1..97: note = hyper
  source 1..97: mol_type = genomic DNA
caaagccaatcaccaggctgagggggcggaggctgcttggagagtaacgtccccggctctgcctgctctgtgccgggagaggaagctcacagtgcta

SEQ ID NO: 2621 - DNA, 590 bp, Homo sapiens
  misc_feature 1..590: note = chr5:100239134-100239724
  misc_feature 1..590: note = hyper
  source 1..590: mol_type = genomic DNA
cgcgcacatacacatatacatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 2622 - DNA, 248 bp, Homo sapiens; identical to SEQ ID NO: 476
  misc_feature 1..248: note = chr5:112629488-112629736
  misc_feature 1..248: note = hyper
  source 1..248: mol_type = genomic DNA

SEQ ID NO: 2623 - DNA, 571 bp, Homo sapiens
  misc_feature 1..571: note = chr5:114515009-114515580
  misc_feature 1..571: note = hyper
  source 1..571: mol_type = genomic DNA
cgttcctaaaggctccaggacaggtgtggggctgaaatcccgctcctccagcatcttcccctccctaccaaaagaaggctgctttaaatattcccggcctggagcagcagcagctaaggacctggaaagaggcccgaaaaggccagggcagggcgaacgaacgtgctgtccctatttaccggccacacgctctgactgcgggctgaccctgatcgcacacttcgagcctgttcactcgctgggcggaccctccctccacgctccgcgcccaggcaggcgaggtcacccactcgaagtcaccacgtttgagtagccctggttggtggggcagcgcccccttggccaacgccccgccctcctctccatcttccgacgctgggctctcgcccttcggcgtccgagagcccctattgctgcccagctggccccaaaagcgtccgaaagtcccctcttggcttatttcagagatgccacgcaataaagaaaaggcggctactttgcattccgcagctgctgggacgcccgggctgcgagcgcggctcctggattccagcctcccgcccttcccagg

SEQ ID NO: 2624 - DNA, 61 bp, Homo sapiens
  misc_feature 1..61: note = chr5:114515610-114515671
  misc_feature 1..61: note = hyper
  source 1..61: mol_type = genomic DNA
cgggccaggtagtgccggagtcgggggcccaggccgcggcgccccgcgcctcatcacttac

SEQ ID NO: 2625 - DNA, 173 bp, Homo sapiens; identical to SEQ ID NO: 477
  misc_feature 1..173: note = chr5:115151185-115151358
  misc_feature 1..173: note = hyper
  source 1..173: mol_type = genomic DNA

SEQ ID NO: 2626 - DNA, 736 bp, Homo sapiens; identical to SEQ ID NO: 478
  misc_feature 1..736: note = chr5:115151649-115152385
  misc_feature 1..736: note = hyper
  source 1..736: mol_type = genomic DNA

SEQ ID NO: 2627 - DNA, 61 bp, Homo sapiens; identical to SEQ ID NO: 479
  misc_feature 1..61: note = chr5:115152616-115152677
  misc_feature 1..61: note = hyper
  source 1..61: mol_type = genomic DNA

SEQ ID NO: 2628 - DNA, 47 bp, Homo sapiens
  misc_feature 1..47: note = chr5:115297186-115297233
  misc_feature 1..47: note = hyper
  source 1..47: mol_type = genomic DNA
agactccagatccagcgcagacgccaagaattcgctcaggggcacca

SEQ ID NO: 2629 - DNA, 312 bp, Homo sapiens
  misc_feature 1..312: note = chr5:119801156-119801468
  misc_feature 1..312: note = hyper
  source 1..312: mol_type = genomic DNA
tttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtgg

SEQ ID NO: 2630 - DNA, 48 bp, Homo sapiens
  misc_feature 1..48: note = chr5:122423328-122423376
  misc_feature 1..48: note = hyper
  source 1..48: mol_type = genomic DNA
tcttcggcagttctgcgagcagattaattgaaacgggcctggaacttc

SEQ ID NO: 2631 - DNA, 102 bp, Homo sapiens; identical to SEQ ID NO: 480
  misc_feature 1..102: note = chr5:127873552-127873654
  misc_feature 1..102: note = hyper
  source 1..102: mol_type = genomic DNA

SEQ ID NO: 2632 - DNA, 295 bp, Homo sapiens
  misc_feature 1..295: note = chr5:127874183-127874478
  misc_feature 1..295: note = hyper
  source 1..295: mol_type = genomic DNA
tggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggc

SEQ ID NO: 2633 - DNA, 238 bp, Homo sapiens
  misc_feature 1..238: note = chr5:127874705-127874943
  misc_feature 1..238: note = hyper
  source 1..238: mol_type = genomic DNA
cgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtc

SEQ ID NO: 2634 - DNA, 355 bp, Homo sapiens
  misc_feature 1..355: note = chr5:128795742-128796097
  misc_feature 1..355: note = hyper
  source 1..355: mol_type = genomic DNA
cagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaacc

SEQ ID NO: 2635 - DNA, 366 bp, Homo sapiens
  misc_feature 1..366: note = chr5:128796098-128796464
  misc_feature 1..366: note = hyper
  source 1..366: mol_type = genomic DNA
cgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgat

SEQ ID NO: 2636 - DNA, 667 bp, Homo sapiens
  misc_feature 1..667: note = chr5:134374791-134375458
  misc_feature 1..667: note = hyper
  source 1..667: mol_type = genomic DNA
cgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttc

SEQ ID NO: 2637 - DNA, 112 bp, Homo sapiens; identical to SEQ ID NO: 481
  misc_feature 1..112: note = chr5:134385952-134386064
  misc_feature 1..112: note = hyper
  source 1..112: mol_type = genomic DNA

SEQ ID NO: 2638 - DNA, 512 bp, Homo sapiens; identical to SEQ ID NO: 482
  misc_feature 1..512: note = chr5:134879478-134879990
  misc_feature 1..512: note = hyper
  source 1..512: mol_type = genomic DNA

SEQ ID NO: 2639 - DNA, 123 bp, Homo sapiens; identical to SEQ ID NO: 483
  misc_feature 1..123: note = chr5:135265737-135265860
  misc_feature 1..123: note = hyper
  source 1..123: mol_type = genomic DNA

SEQ ID NO: 2640 - DNA, 12 bp, Homo sapiens
  misc_feature 1..12: note = chr5:135265919-135265931
  misc_feature 1..12: note = hyper
  source 1..12: mol_type = genomic DNA
cgccaggtgggc

SEQ ID NO: 2641 - DNA, 197 bp, Homo sapiens; identical to SEQ ID NO: 485
  misc_feature 1..197: note = chr5:135265932-135266129
  misc_feature 1..197: note = hyper
  source 1..197: mol_type = genomic DNA

SEQ ID NO: 2642 - DNA, 110 bp, Homo sapiens; identical to SEQ ID NO: 486
  misc_feature 1..110: note = chr5:135266577-135266687
  misc_feature 1..110: note = hyper
  source 1..110: mol_type = genomic DNA

SEQ ID NO: 2643 - DNA, 18 bp, Homo sapiens
  misc_feature 1..18: note = chr5:136834033-136834051
  misc_feature 1..18: note = hyper
  source 1..18: mol_type = genomic DNA
cccagggccgggtggcgc

SEQ ID NO: 2644 - DNA, 108 bp, Homo sapiens
  misc_feature 1..108: note = chr5:136834289-136834397
  misc_feature 1..108: note = hyper
  source 1..108: mol_type = genomic DNA
cggccgcgagccccgggcacccaggcgtcccagcgccccagcccggaggcggggaccccgcggcgggcacgggcagcgctcgcgcacctggggcgcctgtcgcgcctc

SEQ ID NO: 2645 - DNA, 159 bp, Homo sapiens
  misc_feature 1..159: note = chr5:139227762-139227921
  misc_feature 1..159: note = hyper
  source 1..159: mol_type = genomic DNA
cgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactc

SEQ ID NO: 2646 - DNA, 52 bp, Homo sapiens
  misc_feature 1..52: note = chr5:140187094-140187146
  misc_feature 1..52: note = hyper
  source 1..52: mol_type = genomic DNA
tgatcgtagacaggccgctgcaggttttccatgtggacgtggaggtgaggga

SEQ ID NO: 2647 - DNA, 42 bp, Homo sapiens
  misc_feature 1..42: note = chr5:140604459-140604501
  misc_feature 1..42: note = hyper
  source 1..42: mol_type = genomic DNA
cgagaacaacagccccgccctgcacatcggcagcgtcagcgc

SEQ ID NO: 2648 - DNA, 134 bp, Homo sapiens
  misc_feature 1..134: note = chr5:140797076-140797210
  misc_feature 1..134: note = hyper
  source 1..134: mol_type = genomic DNA
ttttggctgtcaactcgtagtttaaaaaaaattccttgaaagaggtagagaaaagtcaagttgcagtcccacacagagcctctgggcgccgccgtcggccagtgcagagcaagcgctgacgccggggatccctc

SEQ ID NO: 2649 - DNA, 228 bp, Homo sapiens; identical to SEQ ID NO: 487
  misc_feature 1..228: note = chr5:140801034-140801262
  misc_feature 1..228: note = hyper
  source 1..228: mol_type = genomic DNA

SEQ ID NO: 2650 - DNA, 861 bp, Homo sapiens; identical to SEQ ID NO: 488
  misc_feature 1..861: note = chr5:140855598-140856459
  misc_feature 1..861: note = hyper
  source 1..861: mol_type = genomic DNA

SEQ ID NO: 2651 - DNA, 87 bp, Homo sapiens; identical to SEQ ID NO: 489
  misc_feature 1..87: note = chr5:140856546-140856633
  misc_feature 1..87: note = hyper
  source 1..87: mol_type = genomic DNA

SEQ ID NO: 2652 - DNA, 347 bp, Homo sapiens
  misc_feature 1..347: note = chr5:141262718-141263065
  misc_feature 1..347: note = hyper
  source 1..347: mol_type = genomic DNA
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtct

SEQ ID NO: 2653 - DNA, 25 bp, Homo sapiens
  misc_feature 1..25: note = chr5:141931330-141931355
  misc_feature 1..25: note = hyper
  source 1..25: mol_type = genomic DNA
ctcacttctccttctcgcccttaat

SEQ ID NO: 2654 - DNA, 60 bp, Homo sapiens
  misc_feature 1..60: note = chr5:141931424-141931484
  misc_feature 1..60: note = hyper
  source 1..60: mol_type = genomic DNA
cgccggcgccccgggtgggctcccggagcgcgcgggcctgtgacccggaggtcagagatg

SEQ ID NO: 2655 - DNA, 71 bp, Homo sapiens
  misc_feature 1..71: note = chr5:145713641-145713712
  misc_feature 1..71: note = hyper
  source 1..71: mol_type = genomic DNA
cgtgccgagccctcacggacgctcggcctctggcccctgaatccctctgggcgtctcggatcctctgagcc

SEQ ID NO: 2656 - DNA, 203 bp, Homo sapiens
  misc_feature 1..203: note = chr5:145716994-145717197
  misc_feature 1..203: note = hyper
  source 1..203: mol_type = genomic DNA
cggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagat

SEQ ID NO: 2657 - DNA, 156 bp, Homo sapiens
  misc_feature 1..156: note = chr5:145717248-145717404
  misc_feature 1..156: note = hyper
  source 1..156: mol_type = genomic DNA
cggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacc

SEQ ID NO: 2658 - DNA, 42 bp, Homo sapiens
  misc_feature 1..42: note = chr5:145719895-145719937
  misc_feature 1..42: note = hyper
  source 1..42: mol_type = genomic DNA
gaagatcgcggccatcgctgagaaactggaccttaaaaagaa

SEQ ID NO: 2659 - DNA, 280 bp, Homo sapiens
  misc_feature 1..280: note = chr5:145720018-145720298
  misc_feature 1..280: note = hyper
  source 1..280: mol_type = genomic DNA
cgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacg

SEQ ID NO: 2660 - DNA, 92 bp, Homo sapiens; identical to SEQ ID NO: 490
  misc_feature 1..92: note = chr5:145722375-145722467
  misc_feature 1..92: note = hyper
  source 1..92: mol_type = genomic DNA

SEQ ID NO: 2661 - DNA, 467 bp, Homo sapiens; identical to SEQ ID NO: 491
  misc_feature 1..467: note = chr5:145722560-145723027
  misc_feature 1..467: note = hyper
  source 1..467: mol_type = genomic DNA

SEQ ID NO: 2662 - DNA, 151 bp, Homo sapiens; identical to SEQ ID NO: 492
  misc_feature 1..151: note = chr5:145725693-145725844
  misc_feature 1..151: note = hyper
  source 1..151: mol_type = genomic DNA

SEQ ID NO: 2663 - DNA, 566 bp, Homo sapiens
  misc_feature 1..566: note = chr5:150051101-150051667
  misc_feature 1..566: note = hyper
  source 1..566: mol_type = genomic DNA
cctggtcccctgccccgctgagcttctctgcggtttattctaccccctcgttcccagatgctggccggaagcgccaggaggaaggtgactggaacagcggagtcggggacggtgagcgtggaggggagctccctggaagggaagctgggggaaggggagcgcggctgggggcgggaggtcgtcggtggcctctgagaacccgcccctgtgcccaggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggtgagtggcctcctcgggtcccgggaccagggctggggggcctgaagcatgggtgtgctccccatggggcaggaagagcacccagaaggctagtccgcccccttccccaacacacacgcgcacgcgcgcactcccctcgccagaccacgagccggaggggcgccgcgccccaggtcacacagcgagtcagccaaggc

SEQ ID NO: 2664 - DNA, 97 bp, Homo sapiens
  misc_feature 1..97: note = chr5:152870193-152870290
  misc_feature 1..97: note = hyper
  source 1..97: mol_type = genomic DNA
cagctagcatgaggacgggcttcttttcccgtgctcagttaatctggctgtcagttggtgttaacgctgcagtttaagtgttcggattccaagggaa

SEQ ID NO: 2665 - DNA, 59 bp, Homo sapiens
  misc_feature 1..59: note = chr5:153852733-153852792
  misc_feature 1..59: note = hyper
  source 1..59: mol_type = genomic DNA
agctagaccagggtgcgcattcttcccgtgcctaggatacttcacggtgctaaaaatag

SEQ ID NO: 2666 - DNA, 27 bp, Homo sapiens
  misc_feature 1..27: note = chr5:153853277-153853304
  misc_feature 1..27: note = hyper
  source 1..27: mol_type = genomic DNA
gcccgcgtggcctctcggcccctgcta

SEQ ID NO: 2667 - DNA, 133 bp, Homo sapiens
  misc_feature 1..133: note = chr5:153853386-153853519
  misc_feature 1..133: note = hyper
  source 1..133: mol_type = genomic DNA
cgaggccctgccccggagctgcctgaggtctcctttcttgttcccaagccgagcgctcaggctccaggtgcgcagagcgaaagttccaagacagcctcacgggtctcccctcctccttcgcagtgagcgccgc

SEQ ID NO: 2668 - DNA, 32 bp, Homo sapiens
  misc_feature 1..32: note = chr5:153855232-153855264
  misc_feature 1..32: note = hyper
  source 1..32: mol_type = genomic DNA
gctcagcagaagctccgcgggatgcgtagcac

SEQ ID NO: 2669 - DNA, 375 bp, Homo sapiens; identical to SEQ ID NO: 493
  misc_feature 1..375: note = chr5:158527442-158527817
  misc_feature 1..375: note = hyper
  source 1..375: mol_type = genomic DNA

SEQ ID NO: 2670 - DNA, 251 bp, Homo sapiens; identical to SEQ ID NO: 494
  misc_feature 1..251: note = chr5:158527818-158528069
  misc_feature 1..251: note = hyper
  source 1..251: mol_type = genomic DNA

SEQ ID NO: 2671 - DNA, 28 bp, Homo sapiens
  misc_feature 1..28: note = chr5:159399072-159399100
  misc_feature 1..28: note = hyper
  source 1..28: mol_type = genomic DNA
tcgcctgggcggctgcgcctacacctac

SEQ ID NO: 2672 - DNA, 210 bp, Homo sapiens
  misc_feature 1..210: note = chr5:160975724-160975934
  misc_feature 1..210: note = hyper
  source 1..210: mol_type = genomic DNA
ggacttcagagccagcgttcctaaccactgaactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcc

SEQ ID NO: 2673 - DNA, 15 bp, Homo sapiens
  misc_feature 1..15: note = chr5:160975955-160975970
  misc_feature 1..15: note = hyper
  source 1..15: mol_type = genomic DNA
cggaagtagctccac

SEQ ID NO: 2674 - DNA, 177 bp, Homo sapiens
  misc_feature 1..177: note = chr5:167956090-167956267
  misc_feature 1..177: note = hyper
  source 1..177: mol_type = genomic DNA
tggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttc

SEQ ID NO: 2675 - DNA, 31 bp, Homo sapiens
  misc_feature 1..31: note = chr5:167956413-167956444
  misc_feature 1..31: note = hyper
  source 1..31: mol_type = genomic DNA
cggacaaccgccgggacgaccacccagagcc

SEQ ID NO: 2676 - DNA, 235 bp, Homo sapiens
  misc_feature 1..235: note = chr5:169064295-169064530
  misc_feature 1..235: note = hyper
  source 1..235: mol_type = genomic DNA
ttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagcc

SEQ ID NO: 2677 - DNA, 274 bp, Homo sapiens
  misc_feature 1..274: note = chr5:169064531-169064805
  misc_feature 1..274: note = hyper
  source 1..274: mol_type = genomic DNA
aggctcggggagaggacggcgggaccccaccccgcaggctaagcacagccctcgccctctcgcctgctgagggaaccttagacatttccgagatagggtcaagacctgcgcttgacaactcagttcttcgcgccaaactcggcgtccccaggagtgccccagctcgccgcgtgggagacttggccttgtagagggagctccactctcccctggctcagccttggcctgcccaccatgcatacttccaccccctccaaagcgacacccatttgcc

SEQ ID NO: 2678 - DNA, 378 bp, Homo sapiens
  misc_feature 1..378: note = chr5:170108034-170108412
  misc_feature 1..378: note = hyper
  source 1..378: mol_type = genomic DNA
ccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccgagagatttgaaaaagccgggctgaaacagcgtggtattggtccccgcctccccagtcgcgccccagtgctgcgctgtccgtcgtgctgaaatgtggtgcgcctggggagtgcgggagccaggaagt

SEQ ID NO: 2679 - DNA, 100 bp, Homo sapiens; identical to SEQ ID NO: 495
  misc_feature 1..100: note = chr5:170735131-170735231
  misc_feature 1..100: note = hyper
  source 1..100: mol_type = genomic DNA

SEQ ID NO: 2680 - DNA, 116 bp, Homo sapiens; identical to SEQ ID NO: 496
  misc_feature 1..116: note = chr5:170736715-170736831
  misc_feature 1..116: note = hyper
  source 1..116: mol_type = genomic DNA

SEQ ID NO: 2681 - DNA, 454 bp, Homo sapiens; identical to SEQ ID NO: 497
  misc_feature 1..454: note = chr5:170737281-170737735
  misc_feature 1..454: note = hyper
  source 1..454: mol_type = genomic DNA

SEQ ID NO: 2682 - DNA, 69 bp, Homo sapiens; identical to SEQ ID NO: 498
  misc_feature 1..69: note = chr5:170737795-170737864
  misc_feature 1..69: note = hyper
  source 1..69: mol_type = genomic DNA

SEQ ID NO: 2683 - DNA, 755 bp, Homo sapiens; identical to SEQ ID NO: 499
  misc_feature 1..755: note = chr5:170737935-170738690
  misc_feature 1..755: note = hyper
  source 1..755: mol_type = genomic DNA

SEQ ID NO: 2684 - DNA, 1116 bp, Homo sapiens; identical to SEQ ID NO: 500
  misc_feature 1..1116: note = chr5:170738823-170739939
  misc_feature 1..1116: note = hyper
  source 1..1116: mol_type = genomic DNA

SEQ ID NO: 2685 - DNA, 23 bp, Homo sapiens
  misc_feature 1..23: note = chr5:170740455-170740478
  misc_feature 1..23: note = hyper
  source 1..23: mol_type = genomic DNA
aaggcaaaacactttcggggccg

SEQ ID NO: 2686 - DNA, 99 bp, Homo sapiens
  misc_feature 1..99: note = chr5:170740574-170740673
  misc_feature 1..99: note = hyper
  source 1..99: mol_type = genomic DNA
cgtgctccgagccttcgttctatgcgggctgcgggactgtattcacctgcagggctggaggaaggggagggcgcctgagaaacaccttgaacccccagc

SEQ ID NO: 2687 - DNA, 125 bp, Homo sapiens
  misc_feature 1..125: note = chr5:170740674-170740799
  misc_feature 1..125: note = hyper
  source 1..125: mol_type = genomic DNA
ctcccgccgtcacctccacctccaagcccagctagcctgggatctgcgcctttcaggacataaagacacccagggagggactagggtgactcagaacttcgggtctcttccgtgagtgttttcct

SEQ ID NO: 2688 - DNA, 741 bp, Homo sapiens
  misc_feature 1..741: note = chr5:170741487-170742228
  misc_feature 1..741: note = hyper
  source 1..741: mol_type = genomic DNA
ccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagc

SEQ ID NO: 2689 - DNA, 152 bp, Homo sapiens; identical to SEQ ID NO: 501
  misc_feature 1..152: note = chr5:170742448-170742600
  misc_feature 1..152: note = hyper
  source 1..152: mol_type = genomic DNA

SEQ ID NO: 2690 - DNA, 166 bp, Homo sapiens; identical to SEQ ID NO: 502
  misc_feature 1..166: note = chr5:170742672-170742838
  misc_feature 1..166: note = hyper
  source 1..166: mol_type = genomic DNA

SEQ ID NO: 2691 - DNA, 342 bp, Homo sapiens; identical to SEQ ID NO: 503
  misc_feature 1..342: note = chr5:170743138-170743480
  misc_feature 1..342: note = hyper
  source 1..342: mol_type = genomic DNA

SEQ ID NO: 2692 - DNA, 482 bp, Homo sapiens; identical to SEQ ID NO: 504
  misc_feature 1..482: note = chr5:170743646-170744128
  misc_feature 1..482: note = hyper
  source 1..482: mol_type = genomic DNA

SEQ ID NO: 2693 - DNA, 171 bp, Homo sapiens; identical to SEQ ID NO: 505
  misc_feature 1..171: note = chr5:172659855-172660026
  misc_feature 1..171: note = hyper
  source 1..171: mol_type = genomic DNA

SEQ ID NO: 2694 - DNA, 77 bp, Homo sapiens; identical to SEQ ID NO: 506
  misc_feature 1..77: note = chr5:172660141-172660218
  misc_feature 1..77: note = hyper
  source 1..77: mol_type = genomic DNA

SEQ ID NO: 2695 - DNA, 82 bp, Homo sapiens
  misc_feature 1..82: note = chr5:172660919-172661001
  misc_feature 1..82: note = hyper
  source 1..82: mol_type = genomic DNA
gcgcctgcggcctcccgggaatcgcccgggctcctgccttgggctggggggtctcccagaaggcccctttctgcagcggggc

SEQ ID NO: 2696 - DNA, 20 bp, Homo sapiens
  misc_feature 1..20: note = chr5:172661126-172661146
  misc_feature 1..20: note = hyper
  source 1..20: mol_type = genomic DNA
cgcgccggcaagttgtgctg

SEQ ID NO: 2697 - DNA, 359 bp, Homo sapiens
  misc_feature 1..359: note = chr5:172661471-172661830
  misc_feature 1..359: note = hyper
  source 1..359: mol_type = genomic DNA
acccaggagcagagccgaagccgcccggggctttgttaggccggggggaaacgttttttggtctcttgcttctgatcctttcaatccggcatttcctctgaacctccgattggacgcggggcgcgggagcctggcgacaacaccaggcatcttacattctgaaccccccgccgcagcccagccctcggcccaagggcgcgtgtctcctcctcctggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaa

SEQ ID NO: 2698 - DNA, 149 bp, Homo sapiens
  misc_feature 1..149: note = chr5:172670933-172671082
  misc_feature 1..149: note = hyper
  source 1..149: mol_type = genomic DNA
ccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggaca

SEQ ID NO: 2699 - DNA, 87 bp, Homo sapiens; identical to SEQ ID NO: 507
  misc_feature 1..87: note = chr5:172671395-172671482
  misc_feature 1..87: note = hyper
  source 1..87: mol_type = genomic DNA

SEQ ID NO: 2700 - DNA, 153 bp, Homo sapiens; identical to SEQ ID NO: 508
  misc_feature 1..153: note = chr5:172671639-172671792
  misc_feature 1..153: note = hyper
  source 1..153: mol_type = genomic DNA

SEQ ID NO: 2701 - DNA, 156 bp, Homo sapiens
  misc_feature 1..156: note = chr5:174115433-174115589
  misc_feature 1..156: note = hyper
  source 1..156: mol_type = genomic DNA
atcaattagcattgccgttgccaaaacttgcttcccaccgagcccaaaagccgccggcggcacatcccagcggcctccctcctcccgggctgggattcgcctctgcaagaaacgtcatgttttctctcccagacatcgttccgggagccccagatg

SEQ ID NO: 2702 - DNA, 279 bp, Homo sapiens
  misc_feature 1..279: note = chr5:174159299-174159578
  misc_feature 1..279: note = hyper
  source 1..279: mol_type = genomic DNA
ggagaaaagggctgcatcttgcgtggctggcgggttagactggaatccgtctggggaactgcgcaccatccccatcgctccagacgccgaaacaaaacctgaggctcggagaggggaaaaagagttgttcaggctcgaacatacgcatcccagcctcataggtggatggggttaccgagctgagaaccaagccggaggtccgcgaagccgggccgcccccttgctctgggcctcccttcaagcctgcagtctggggatgggttccgagtcaccgcggtc

SEQ ID NO: 2703 - DNA, 1140 bp, Homo sapiens
  misc_feature 1..1140: note = chr5:174870738-174871878
  misc_feature 1..1140: note = hyper
  source 1..1140: mol_type = genomic DNA
ttggaatgtggacttcgctgggggcagcggctccgaaacgttgaggaagcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcaccagcaagcgcacaggccggcggggttcccgcggggcacagcccaccccgcccgcgcgtcccctcccctgccctgggggcggtcctcgcttgacaggcagagttgcgggcgacagccgcacgtggtccccctggatggttctgcgggcgaggtgggcggaggacgccccggtgagtgcttgccctccctggttacctcgccagtctccggatccccgcgcagcacgcgcagggcccgcgaggcaaatccaatgtcagaacctcaagtaagcttgagtcccctgaaagcaaagctcagccccgacatccagcgcctcttggggtcaacccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtg

SEQ ID NO: 2704 - DNA, 241 bp, Homo sapiens
  misc_feature 1..241: note = chr5:175085074-175085315
  misc_feature 1..241: note = hyper
  source 1..241: mol_type = genomic DNA
catccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccac

SEQ ID NO: 2705 - DNA, 79 bp, Homo sapiens
  misc_feature 1..79: note = chr5:175085524-175085603
  misc_feature 1..79: note = hyper
  source 1..79: mol_type = genomic DNA
cgaaacagtccccgttttgtctccgggtctgggtggtggcattttctcgcggcgatgtgtctgtcggagcatggagcaa

SEQ ID NO: 2706 - DNA, 30 bp, Homo sapiens
  misc_feature 1..30: note = chr5:175223920-175223950
  misc_feature 1..30: note = hyper
  source 1..30: mol_type = genomic DNA
cctggagctctcagccgccggcggctcttc

SEQ ID NO: 2707 - DNA, 272 bp, Homo sapiens
  misc_feature 1..272: note = chr5:176046306-176046578
  misc_feature 1..272: note = hyper
  source 1..272: mol_type = genomic DNA
gagagagggcctctgcggcaagagggcaggggcggggcctcgcgcagggactgcctatgccaataaaggcagcgcatggggggcggtgcctctgcgcggagccagcagtatctccgcccccatctttctcactctgaggcggtgttgggggccccctagtgctgatcctgatccgctcaaggctcccgggcggcatcccagacctctgcgggccctcgcccacctcaaactttcggcctcaaacattccggcgccttcgtgggggtgggagg

SEQ ID NO: 2708 - DNA, 458 bp, Homo sapiens
  misc_feature 1..458: note = chr5:176056505-176056963
  misc_feature 1..458: note = hyper
  source 1..458: mol_type = genomic DNA
cagccccagaaaccccgccccttacccaccgacgtagaggacgccctccttggtcttctccgccgcctcggtgaccccctgcttggttttctccgcggctgccacaacgccctccttggccatggacaggcccttcatgaacacgtccatcctggcggcctggggagggcgatacacgggcaccggtgcactggccccgcactctcaccccagcccctcccgcgggacgcagatgcccccctactcccgagaccgcggcgcccttctggaccctgagccccctcccgctttccccccatcccaccccactccccagtgcgaagcctcagggccgcggagagtcctagcgtccttgaaacctggggacgcgggaggggccactgcctcggttatccgggccctgcaaactgcagccccgtcgaaccggagtgctgggttcggcgcgaatatccaggacc

SEQ ID NO: 2709 - DNA, 125 bp, Homo sapiens
  misc_feature 1..125: note = chr5:176107360-176107485
  misc_feature 1..125: note = hyper
  source 1..125: mol_type = genomic DNA
gccggctcccgggcgcggggcggtgtctcagggaggcgtctcagccgagctgcagggcgaggggagcgagccgggtcccgggggaaggcatccggtcagggcctcgcccacccggatggctcctg

SEQ ID NO: 2710 - DNA, 69 bp, Homo sapiens
  misc_feature 1..69: note = chr5:176107517-176107586
  misc_feature 1..69: note = hyper
  source 1..69: mol_type = genomic DNA
cgcgaggattggagactggggacccggcagcagagggtccaggcagaaaagctccgtgtggcccccagg

SEQ ID NO: 2711 - DNA, 95 bp, Homo sapiens
  misc_feature 1..95: note = chr5:177411327-177411422
  misc_feature 1..95: note = hyper
  source 1..95: mol_type = genomic DNA
actcttgtggagacccggacgtcaggcgtggcgcgttggggaagcagctccacggggacccaggaggcgccggccgggttgagccgggttggttc

SEQ ID NO: 2712 - DNA, 15 bp, Homo sapiens
  misc_feature 1..15: note = chr5:177411507-177411522
  misc_feature 1..15: note = hyper
  source 1..15: mol_type = genomic DNA
cgcggagatgggcca

SEQ ID NO: 2713 - DNA, 303 bp, Homo sapiens; identical to SEQ ID NO: 509
  misc_feature 1..303: note = chr5:178016681-178016984
  misc_feature 1..303: note = hyper
  source 1..303: mol_type = genomic DNA

SEQ ID NO: 2714 - DNA, 52 bp, Homo sapiens; identical to SEQ ID NO: 510
  misc_feature 1..52: note = chr5:178017519-178017571
  misc_feature 1..52: note = hyper
  source 1..52: mol_type = genomic DNA

SEQ ID NO: 2715 - DNA, 111 bp, Homo sapiens; identical to SEQ ID NO: 511
  misc_feature 1..111: note = chr5:178017572-178017683
  misc_feature 1..111: note = hyper
  source 1..111: mol_type = genomic DNA

SEQ ID NO: 2716 - DNA, 100 bp, Homo sapiens
  misc_feature 1..100: note = chr5:178770805-178770905
  misc_feature 1..100: note = hyper
  source 1..100: mol_type = genomic DNA
cggctaggccggccacgtctccgacgtagagacagctcccgagcaggggctccacgcgggtggtgcccttctcgccctgccactccatagtggccccggg

SEQ ID NO: 2717 - DNA, 433 bp, Homo sapiens
  misc_feature 1..433: note = chr5:178771198-178771631
  misc_feature 1..433: note = hyper
  source 1..433: mol_type = genomic DNA
cggagccccagtgcctcagagacccgccggcaagccacgcccccccagaccccgccccactgcgaagggaaggggcattccgccaggcgaccccagaagccagcctgcacctccccggctttcctgcaaccgggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggag

SEQ ID NO: 2718 - DNA, 58 bp, Homo sapiens
  misc_feature 1..58: note = chr5:178771723-178771781
  misc_feature 1..58: note = hyper
  source 1..58: mol_type = genomic DNA
cgaggactgggaggggtggaacagggtccctccgatctccggggattccctgcggggc

SEQ ID NO: 2719 - DNA, 78 bp, Homo sapiens
  misc_feature 1..78: note = chr5:178771782-178771860
  misc_feature 1..78: note = hyper
  source 1..78: mol_type = genomic DNA
ccccaaccaatccttagggcccaaggctacgcgctcggcagccggctcctccggagcgtccccggacgcgagccccgg

SEQ ID NO: 2720 - skipped

SEQ ID NO: 2721 - DNA, 546 bp, Homo sapiens
  misc_feature 1..546: note = chr5:178772184-178772730
  misc_feature 1..546: note = hyper
  source 1..546: mol_type = genomic DNA
acctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggc

SEQ ID NO: 2722 - DNA, 58 bp, Homo sapiens
  misc_feature 1..58: note = chr5:178772778-178772836
  misc_feature 1..58: note = hyper
  source 1..58: mol_type = genomic DNA
cggcgccggccgaacgtccccacctagagagcccttggggtgccgggtcccacccatc

SEQ ID NO: 2723 - DNA, 240 bp, Homo sapiens
  misc_feature 1..240: note = chr5:178957706-178957946
  misc_feature 1..240: note = hyper
  source 1..240: mol_type = genomic DNA
ctgcgggcggcccagcgctcgcccccctcggccccacgtactcttcctgcctcgcccccatcgccctcctccggcttcccgcgcctcccggggctctgcgcttgcgtccagggcgccctctccggggacaatgggcgggtgcttcgcaggctgcagtcagggccgacttcacccggcgaggacagggcgaggcgctgggcccagaggtatgtttgaaacgattcgcgtatgtgaatctac

SEQ ID NO: 2724 - DNA, 699 bp, Homo sapiens
  misc_feature 1..699: note = chr5:179780528-179781227
  misc_feature 1..699: note = hyper
  source 1..699: mol_type = genomic DNA
gtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacggggtgctgagaagtcagacgggccgcgtaaggggcagagcgaggggtccggcatcactcgcgcgctccggaaacccgcgtgagccgctgttcctgccgcgctcccatctgagtgacaggcttgtttcagagctccgcagacctctaagcctggccctcaccctgcgtggagagaacgcccgggcttggcggagagacgagaaaaccgaggctcccggaggcagacaaggactctgccaaaaccggacgccgcggcggtggcagaattcgaccctgggatttgccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcact

SEQ ID NO: 2725 - DNA, 153 bp, Homo sapiens
  misc_feature 1..153: note = chr5:180017536-180017689
  misc_feature 1..153: note = hyper
  source 1..153: mol_type = genomic DNA
agttttgaggctggccgggaagggatgcccgcgcaggaagggcacccggggtgcccactttaccagcagggccttcagggccttcacggcccccacggcctggggacccagctcagccacacacttctgggagccctctatgaggtggttcac

SEQ ID NO: 2726 - DNA, 442 bp, Homo sapiens
  misc_feature 1..442: note = chr5:180017690-180018132
  misc_feature 1..442: note = hyper
  source 1..442: mol_type = genomic DNA
gggatgcccaggctgctcagcaggagcttcagcgggttgagggtgccgagggggttggccagggtcccggccccggcctccgccgccgactccagcgcagcgacaggctgggccacaggcttggccgagcccactaagaaagcagcagctgcaagcgaacagggaggggtcaccgcctgcgcgccggggtccccagaaggcaggtccaggacgcgcccccgcgggaggcgcccaggaaccgtcgcgccctgcccggctccccgaccgcccctccctcctgcgccgaggcctgccaggtgcgagcccccgggacacaggcgggtctggggaggcggccccgccaggagacgctgcagggtcaccggagtggcctgagggtggcggaaggaccggtgaactctgtgcagggtccgggacaggcccccaagggaggggacactcg

SEQ ID NO: 2727 - DNA, 126 bp, Homo sapiens
  misc_feature 1..126: note = chr5:180018484-180018610
  misc_feature 1..126: note = hyper
  source 1..126: mol_type = genomic DNA
ggggaacctgcggctgcccgggcaaggccacgaggcttcttatacccggtcctcgcccctccagcgccggcctcgcccgcgctcctgagaaagccctgcccgctccgctcacggccgtgccctggc

SEQ ID NO: 2728 - DNA, 44 bp, Homo sapiens; identical to SEQ ID NO: 512
  misc_feature 1..44: note = chr5:180075814-180075858
  misc_feature 1..44: note = hyper
  source 1..44: mol_type = genomic DNA

SEQ ID NO: 2729 - DNA, 405 bp, Homo sapiens; identical to SEQ ID NO: 513
  misc_feature 1..405: note = chr5:180076053-180076458
  misc_feature 1..405: note = hyper
  source 1..405: mol_type = genomic DNA

SEQ ID NO: 2730 - DNA, 314 bp, Homo sapiens; identical to SEQ ID NO: 514
  misc_feature 1..314: note = chr5:180076532-180076846
  misc_feature 1..314: note = hyper
  source 1..314: mol_type = genomic DNA

SEQ ID NO: 2731 - DNA, 153 bp, Homo sapiens
  misc_feature 1..153: note = chr5:180101015-180101168
  misc_feature 1..153: note = hyper
  source 1..153: mol_type = genomic DNA
cgcagccccgcgcccctctggctcctgttcccgggcgcggggagaaggcggcggggcgcgcctgggcccgcgcgggtgcgaacgcgaggtctttcctgggtgctcccaggtcggaggattcccagggcgggggccatcagggtggcgaggaac

SEQ ID NO: 2732 - DNA, 135 bp, Homo sapiens
  misc_feature 1..135: note = chr5:180531170-180531305
  misc_feature 1..135: note = hyper
  source 1..135: mol_type = genomic DNA
ccacaccctctcgtccggtctcccatgcccccttatgctaccgcgtcgggcatgaaaacttccttttctttcttctccttctttccttccttttgagacagggtcttgctctgtctccgccgctggagtgcagtc

SEQ ID NO: 2733 - DNA, 210 bp, Homo sapiens
  misc_feature 1..210: note = chr5:180600858-180601068
  misc_feature 1..210: note = hyper
  source 1..210: mol_type = genomic DNA
cattggaacctgggacgaactgaacccacttcacttgctgtggacaccagcgccgacgaacttcgcacaaagcccgtccactggacagctgcgcgctgccaaatggaatccagatcccgagcaagggtgcggcccagggagagttccaaggaactgggggacaaaatgggcaaaccacaacaagctggcagcggtgggattcgaacccac

SEQ ID NO: 2734 - DNA, 90 bp, Homo sapiens
  misc_feature 1..90: note = chr5:180601128-180601218
  misc_feature 1..90: note = hyper
  source 1..90: mol_type = genomic DNA
ctccgggggttcacctgcatcttttccttccttataaaacatccccagggttcccgggccaacaaggcgttggggcgaatccacagggca

SEQ ID NO: 2735 - DNA, 534 bp, Homo sapiens; identical to SEQ ID NO: 515
  misc_feature 1..534: note = chr6:391209-391743
  misc_feature 1..534: note = hyper
  source 1..534: mol_type = genomic DNA

SEQ ID NO: 2736 - DNA, 20 bp, Homo sapiens
  misc_feature 1..20: note = chr6:391744-391764
  misc_feature 1..20: note = hyper
  source 1..20: mol_type = genomic DNA
cactctcagtttcaccgctc

SEQ ID NO: 2737 - DNA, 135 bp, Homo sapiens; identical to SEQ ID NO: 517
  misc_feature 1..135: note = chr6:391765-391900
  misc_feature 1..135: note = hyper
  source 1..135: mol_type = genomic DNA

SEQ ID NO: 2738 - DNA, 25 bp, Homo sapiens
  misc_feature 1..25: note = chr6:392409-392434
  misc_feature 1..25: note = hyper
  source 1..25: mol_type = genomic DNA
gctctcccgggcctgctccggggtc

SEQ ID NO: 2739 - DNA, 372 bp, Homo sapiens; identical to SEQ ID NO: 519
  misc_feature 1..372: note = chr6:392587-392959
  misc_feature 1..372: note = hyper
  source 1..372: mol_type = genomic DNA

SEQ ID NO: 2740 - DNA, 115 bp, Homo sapiens; identical to SEQ ID NO: 520
  misc_feature 1..115: note = chr6:393124-393239
  misc_feature 1..115: note = hyper
  source 1..115: mol_type = genomic DNA

SEQ ID NO: 2741 - DNA, 233 bp, Homo sapiens; identical to SEQ ID NO: 521
  misc_feature 1..233: note = chr6:393240-393473
  misc_feature 1..233: note = hyper
  source 1..233: mol_type = genomic DNA

SEQ ID NO: 2742 - DNA, 277 bp, Homo sapiens
  misc_feature 1..277: note = chr6:1378199-1378476
  misc_feature 1..277: note = hyper
  source 1..277: mol_type = genomic DNA
catattggaggaagtcggccggcagcttcaccctcctgcgggaaaatgcaaagtccatcaccaatagtcggtctaccgcagagaagtctgcaaatcccaggggcctggaactctaaaaaggccattcaagcctcaggtggactccacgtttctccatttccctgcccttccgcttttctttccttaacaagcttcttataacatttgcgtttgatgaggttcaagaggtcacttcccctccctctccgccctcctcgctcggcggagcggccgcgtc

SEQ ID NO: 2743 - DNA, 21 bp, Homo sapiens
  misc_feature 1..21: note = chr6:1383859-1383880
  misc_feature 1..21: note = hyper
  source 1..21: mol_type = genomic DNA
ggggcccggggcctttggcca

SEQ ID NO: 2744 - DNA, 53 bp, Homo sapiens; identical to SEQ ID NO: 522
  misc_feature 1..53: note = chr6:1384127-1384180
  misc_feature 1..53: note = hyper
  source 1..53: mol_type = genomic DNA

SEQ ID NO: 2745 - DNA, 19 bp, Homo sapiens
  misc_feature 1..19: note = chr6:1384625-1384644
  misc_feature 1..19: note = hyper
  source 1..19: mol_type = genomic DNA
cgagcgttgccacagccgg

SEQ ID NO: 2746 - DNA, 261 bp, Homo sapiens; identical to SEQ ID NO: 524
  misc_feature 1..261: note = chr6:1625257-1625518
  misc_feature 1..261: note = hyper
  source 1..261: mol_type = genomic DNA

SEQ ID NO: 2747 - DNA, 260 bp, Homo sapiens; identical to SEQ ID NO: 525
  misc_feature 1..260: note = chr6:6003269-6003529
  misc_feature 1..260: note = hyper
  source 1..260: mol_type = genomic DNA

SEQ ID NO: 2748 - DNA, 395 bp, Homo sapiens; identical to SEQ ID NO: 526
  misc_feature 1..395: note = chr6:6004349-6004744
  misc_feature 1..395: note = hyper
  source 1..395: mol_type = genomic DNA

SEQ ID NO: 2749 - DNA, 329 bp, Homo sapiens; identical to SEQ ID NO: 527
  misc_feature 1..329: note = chr6:6004836-6005165
  misc_feature 1..329: note = hyper
  source 1..329: mol_type = genomic DNA

SEQ ID NO: 2750 - DNA, 192 bp, Homo sapiens; identical to SEQ ID NO: 528
  misc_feature 1..192: note = chr6:6006691-6006883
  misc_feature 1..192: note = hyper
  source 1..192: mol_type = genomic DNA

SEQ ID NO: 2751 - DNA, 352 bp, Homo sapiens
  misc_feature 1..352: note = chr6:6007318-6007670
  misc_feature 1..352: note = hyper
  source 1..352: mol_type = genomic DNA
accttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctc

SEQ ID NO: 2752 - DNA, 102 bp, Homo sapiens
  misc_feature 1..102: note = chr6:6007671-6007773
  misc_feature 1..102: note = hyper
  source 1..102: mol_type = genomic DNA
attaattcgaaagcgctcctcggccgcccgccccctgcgcttgcctaccctctttttctccaacccagcagctgagctctgggcgcagcctggagcgcgtga

SEQ ID NO: 2753 - DNA, 274 bp, Homo sapiens
  misc_feature 1..274: note = chr6:6007833-6008107
  misc_feature 1..274: note = hyper
  source 1..274: mol_type = genomic DNA
cgcgcgcgcgcacgcccgccagccgcgccgagcgcccccatgcccgcccgcacacaaggcacgcgagcgcgcgcacacgcccaggccccgggggtttggtttgcacacgtggggccccagaaataaacaccgaatgtcctctgaattttacccacctgcgatgccccagcgggccaaaggccgcttcaagggacacagcgacacctgttttagggggcgagtagggcaccggggaaggagcctctgataagacagttttcggatactagtgatt

SEQ ID NO: 2754 - DNA, 86 bp, Homo sapiens; identical to SEQ ID NO: 529
  misc_feature 1..86: note = chr6:10381507-10381593
  misc_feature 1..86: note = hyper
  source 1..86: mol_type = genomic DNA

SEQ ID NO: 2755 - DNA, 138 bp, Homo sapiens; identical to SEQ ID NO: 530
  misc_feature 1..138: note = chr6:10381831-10381969
  misc_feature 1..138: note = hyper
  source 1..138: mol_type = genomic DNA

SEQ ID NO: 2756 - DNA, 184 bp, Homo sapiens
  misc_feature 1..184: note = chr6:10382722-10382906
  misc_feature 1..184: note = hyper
  source 1..184: mol_type = genomic DNA
tattaagggagacttcgaaggcctgttagcaggtgactgcggcaggggcaggggcgcatcagctgtccggcttggaccggcgtgggcgtgggctgggggcttttccgatttgctgagtcagccgcgggcgccgcgggctttggtgtttccagcccaagcgactgtgcttcgctgactggtgtgt

SEQ ID NO: 2757 - DNA, 1050 bp, Homo sapiens; identical to SEQ ID NO: 531
  misc_feature 1..1050: note = chr6:10390023-10391073
  misc_feature 1..1050: note = hyper
  source 1..1050: mol_type = genomic DNA

SEQ ID NO: 2758 - DNA, 65 bp, Homo sapiens
  misc_feature 1..65: note = chr6:10417158-10417223
  misc_feature 1..65: note = hyper
  source 1..65: mol_type = genomic DNA
ctgagcacaattcctcggctgaaccgggctggaggcttggcgccgccctccgtccagaaaatggt

SEQ ID NO: 2759 - DNA, 103 bp, Homo sapiens; identical to SEQ ID NO: 532
  misc_feature 1..103: note = chr6:10417427-10417530
  misc_feature 1..103: note = hyper
  source 1..103: mol_type = genomic DNA

SEQ ID NO: 2760 - DNA, 363 bp, Homo sapiens; identical to SEQ ID NO: 533
  misc_feature 1..363: note = chr6:10419077-10419440
  misc_feature 1..363: note = hyper
  source 1..363: mol_type = genomic DNA

SEQ ID NO: 2761 - DNA, 56 bp, Homo sapiens; identical to SEQ ID NO: 534
  misc_feature 1..56: note = chr6:10419476-10419532
  misc_feature 1..56: note = hyper
  source 1..56: mol_type = genomic DNA

SEQ ID NO: 2762 - DNA, 96 bp, Homo sapiens; identical to SEQ ID NO: 535
  misc_feature 1..96: note = chr6:10421356-10421452
  misc_feature 1..96: note = hyper
  source 1..96: mol_type = genomic DNA

SEQ ID NO: 2763 - DNA, 568 bp, Homo sapiens; identical to SEQ ID NO: 536
  misc_feature 1..568: note = chr6:10421548-10422116
  misc_feature 1..568: note = hyper
  source 1..568: mol_type = genomic DNA

SEQ ID NO: 2764 - DNA, 306 bp, Homo sapiens
  misc_feature 1..306: note = chr6:10422355-10422661
  misc_feature 1..306: note = hyper
  source 1..306: mol_type = genomic DNA
cgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcact

SEQ ID NO: 2765 - DNA, 161 bp, Homo sapiens
  misc_feature 1..161: note = chr6:10425629-10425790
  misc_feature 1..161: note = hyper
  source 1..161: mol_type = genomic DNA
cgcgacatctcttggcggcgttgaccgtttgcccgggacactggtttagaagcacggcatagggtgtctctacatcttagaaatcaagacagcctctaggttagaataaagtttactctggactgggcataactccactccacctctgcgattcttcttct

SEQ ID NO: 2766 - DNA, 54 bp, Homo sapiens
  misc_feature 1..54: note = chr6:10425838-10425892
  misc_feature 1..54: note = hyper
  source 1..54: mol_type = genomic DNA
cgctactttaacgtctcagtctcgttcgctaagcccatgcgcctgggacttgtt

SEQ ID NO: 2767 - DNA, 393 bp, Homo sapiens
  misc_feature 1..393: note = chr6:10426185-10426578
  misc_feature 1..393: note = hyper
  source 1..393: mol_type = genomic DNA
ggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggct

SEQ ID NO: 2768 - DNA, 210 bp, Homo sapiens
  misc_feature 1..210: note = chr6:10881854-10882064
  misc_feature 1..210: note = hyper
  source 1..210: mol_type = genomic DNA
gactcttcaagaactcgaatgccattctccctccttcggatggacagcgccccgcgtgcccgcacacacccggttcacttacctgaggcatctgcggatcgttgatgtcccagctgagctgcatcccgtaggagcacacgccgaccgcttcctgcaccgcggccgccggcatctgcccaactcgctcgcgctttccgcccagggttctga

SEQ ID NO: 2769 - DNA, 16 bp, Homo sapiens
  misc_feature 1..16: note = chr6:10887169-10887185
  misc_feature 1..16: note = hyper
  source 1..16: mol_type = genomic DNA
gtaaacttcagggggc

SEQ ID NO: 2770 - DNA, 486 bp, Homo sapiens
  misc_feature 1..486: note = chr6:10887186-10887672
  misc_feature 1..486: note = hyper
  source 1..486: mol_type = genomic DNA
gattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcggtgagtgacccccgaagggcccggaccttctgtccacagtgctagggcgcgcgagggcgcggggtccctggggctcaggttctgccgccttgaggtgttcgctcagagaccgggtgctgggcatagtcccccgccacctccttgggtttgctcggagtgtattggcagcctgcggggagaccaggcagaatagaaacctcggatccctagctaaatagcgctcagggaaaggggaaccggagaattcgtgttcggaaagcaatgagatagttcttttctagttgctttgcgtattttcctagcc

SEQ ID NO: 2771 - DNA, 102 bp, Homo sapiens
  misc_feature 1..102: note = chr6:19691895-19691997
  misc_feature 1..102: note = hyper
  source 1..102: mol_type = genomic DNA
ctgagaaaatgtccccgctcggggctgctccgccatctgggccgcgggctgggcgcgcggctcccgcccccagctccttggcagaggcgccggaggaagggg

SEQ ID NO: 2772 - DNA, 44 bp, Homo sapiens
  misc_feature 1..44: note = chr6:19692142-19692186
  misc_feature 1..44: note = hyper
  source 1..44: mol_type = genomic DNA
cgtcccgagggctctcccttttcccagagcgcataccaaaggca

SEQ ID NO: 2773 - DNA, 80 bp, Homo sapiens
  misc_feature 1..80: note = chr6:26184021-26184101
  misc_feature 1..80: note = hyper
  source 1..80: mol_type = genomic DNA
gcatgcctgagccagcgaaatccgctcccgccccgaagaagggctccaagaaggccgtgaccaaggcgcagaagaaggac

SEQ ID NO: 2774 - DNA, 163 bp, Homo sapiens
  misc_feature 1..163: note = chr6:26188740-26188903
  misc_feature 1..163: note = hyper
  source 1..163: mol_type = genomic DNA
attgccgagatcgcgccattgattactccagcatgggcgacacagcaagagtgaaaataaactttaatacactatcctcaccggccagtaagatatgaagccaaggcgtaataagaccatttaacttgaaaaccggagctactaaacacgtgaaactacactt

SEQ ID NO: 2775 - DNA, 436 bp, Homo sapiens
  misc_feature 1..436: note = chr6:26240682-26241118
  misc_feature 1..436: note = hyper
  source 1..436: mol_type = genomic DNA
tttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagc

SEQ ID NO: 2776 - DNA, 41 bp, Homo sapiens
  misc_feature 1..41: note = chr6:26250098-26250139
  misc_feature 1..41: note = hyper
  source 1..41: mol_type = genomic DNA
tacttttagtgaagacgggttttcactatgttaggcagact

SEQ ID NO: 2777 - DNA, 486 bp, Homo sapiens
  misc_feature 1..486: note = chr6:26250199-26250685
  misc_feature 1..486: note = hyper
  source 1..486: mol_type = genomic DNA
ggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttgggcatgatagtcactcgcttggcgtggatagcacacaggttggtgtcctcaaagagccccaccaggtaagcctcgcaggcctcctgcagcgccatcacagccgagctctggaagcgcaggtcggtcttgaagtcctgcgcgatctcacgtaccagacgctggaatggtagcttgcgaatcagtagctcagtcgatttctgatagcggcggatttcac

SEQ ID NO: 2778 - DNA, 154 bp, Homo sapiens
  misc_feature 1..154: note = chr6:26250686-26250840
  misc_feature 1..154: note = hyper
  source 1..154: mol_type = genomic DNA
gagggcgacagtaccaggcctgtagcggtggggcttcttcacgccaccggtggctggcgcgcttttgcgagccgccttagtggccagctgcttgcgcggggctttgccgccagtggacttacgagctgtttgcttcgtgcgtgccataggaatg

SEQ ID NO: 2779 - DNA, 128 bp, Homo sapiens
  misc_feature 1..128: note = chr6:26251054-26251182
  misc_feature 1..128: note = hyper
  source 1..128: mol_type = genomic DNA
tgcctacctgtattacgtaccttcattgattttattttaatcagtttgtttgggattatgtttgacagacggaaatgaacgttctgcagttccggagcgattcaaaaataccgcgtttgagagtgatt

SEQ ID NO: 2780 - DNA, 325 bp, Homo sapiens
  misc_feature 1..325: note = chr6:26251641-26251966
  misc_feature 1..325: note = hyper
  source 1..325: mol_type = genomic DNA
ttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaacggccagctgtgctgttgagccttcactttggggtgtattcttactcctttatcttgttgcaatgcctgatccagctaagtccgctcccgccccgaagaagggctccaagaaggcggtgaccaaggcgcagaagaaggatggcaagaagc

SEQ ID NO: 2781 - DNA, 208 bp, Homo sapiens
  misc_feature 1..208: note = chr6:26271371-26271579
  misc_feature 1..208: note = hyper
  source 1..208: mol_type = genomic DNA
tcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggt

SEQ ID NO: 2782 - DNA, 157 bp, Homo sapiens; identical to SEQ ID NO: 537
  misc_feature 1..157: note = chr6:26327825-26327982
  misc_feature 1..157: note = hyper
  source 1..157: mol_type = genomic DNA

SEQ ID NO: 2783 - DNA, 85 bp, Homo sapiens
  misc_feature 1..85: note = chr6:26328331-26328416
  misc_feature 1..85: note = hyper
  source 1..85: mol_type = genomic DNA
tttctataggtataacgcctgtcttcgttcgtcagagggccagtggcgcaatggataacgcgtctgactacggatcagaagattc

SEQ ID NO: 2784 - DNA, 240 bp, Homo sapiens; identical to SEQ ID NO: 538
  misc_feature 1..240: note = chr6:26501949-26502189
  misc_feature 1..240: note = hyper
  source 1..240: mol_type = genomic DNA

SEQ ID NO: 2785 - DNA, 277 bp, Homo sapiens
  misc_feature 1..277: note = chr6:26577158-26577435
  misc_feature 1..277: note = hyper
  source 1..277: mol_type = genomic DNA
atactgctttaaagccgatcgtagtttaaaaaatgagcattaatataattaattaaaaccaaatctcctaaatggaacaagacttaaaaacccagaaacttccaggacgcacattattttggggattctagagaacgcagaactacgtgtctaaaaaggacagcgttccgtgtccttcgatagctcagttggtagagcggaggactgtaggctcattaagcaaggtatccttaggtcgctggttcgaatccggctcggaggacggtagttttgacct

SEQ ID NO: 2786 - DNA, 102 bp, Homo sapiens
  misc_feature 1..102: note = chr6:27064667-27064769
  misc_feature 1..102: note = hyper
  source 1..102: mol_type = genomic DNA
gctggctcccaggtgcgctatccgacgcagcgagacgcggtgagcctacagaagggctgaccaggctcacctgacgccccaggtcgacagcaaaccccgtgc

SEQ ID NO: 2787 - DNA, 233 bp, Homo sapiens
  misc_feature 1..233: note = chr6:27064770-27065003
  misc_feature 1..233: note = hyper
  source 1..233: mol_type = genomic DNA
ccccgttggcccggtcacgcccgcagcctgctcaggcgcctcctgcctcgggaccaggaagcggaagaaagggagagaccggcccggcaattacgtttctatcatgtcttgaacatttgtgtgagtcccacgaaagctaagcccgtttattccccctcgaagcgtttccactcagttcttgatcattcatgtgaaaacgagccatctccacgtctcccaaacgtcttcaaacc

SEQ ID NO: 2788 - DNA, 264 bp, Homo sapiens
  misc_feature 1..264: note = chr6:27065004-27065268
  misc_feature 1..264: note = hyper
  source 1..264: mol_type = genomic DNA
tttcctaagtcttgtaaggccgcctgtgggttcctattacaaactctgaaataaaatactcgggaaacgtgggttatcaagacgaggtggccgagtggttaaggcgatggactgctaatccattgtgctctgcacgcgtgggttcgaatcccaccctcgtcgggggaggtcttttaatacgaagaggaggaaacaacacccaagtccagccaacttccctttcaactctcctggaattcaggtccctggcgttggagaggaaaa

SEQ ID NO: 2789 - DNA, 79 bp, Homo sapiens
  misc_feature 1..79: note = chr6:27205332-27205411
  misc_feature 1..79: note = hyper
  source 1..79: mol_type = genomic DNA
gaaggtgagaaccctcgtggcccgtacggggatcgaacccgcgaccttggcgttattagcaccacgctctaaccaactg

SEQ ID NO: 2790 - DNA, 15 bp, Homo sapiens
  misc_feature 1..15: note = chr6:27228172-27228187
  misc_feature 1..15: note = hyper
  source 1..15: mol_type = genomic DNA
gaagagcccacctgc

SEQ ID NO: 2791 - DNA, 170 bp, Homo sapiens; identical to SEQ ID NO: 540
  misc_feature 1..170: note = chr6:27228289-27228459
  misc_feature 1..170: note = hyper
  source 1..170: mol_type = genomic DNA

SEQ ID NO: 2792 - DNA, 103 bp, Homo sapiens
  misc_feature 1..103: note = chr6:27247636-27247739
  misc_feature 1..103: note = hyper
  source 1..103: mol_type = genomic DNA
ggaaagggtggctttcggcaaagtctcggcctcgccttgaccctccaggaaaaatgttcctgagcggaaagatcgttcaagttgcctgcgaaccaagtccttg

SEQ ID NO: 2793 - DNA, 153 bp, Homo sapiens
  misc_feature 1..153: note = chr6:27256079-27256232
  misc_feature 1..153: note = hyper
  source 1..153: mol_type = genomic DNA
cctttctaggaatcccgggcgcagcgcgggggtcgggactccgacctgtatttccaggcggaggtttccctgggtcaggcggccactctctgccagagattgtcagttatccaactgtcaatagagccgccgctccagcgagtttaatttagg

SEQ ID NO: 2794 - DNA, 725 bp, Homo sapiens; identical to SEQ ID NO: 541
  misc_feature 1..725: note = chr6:27279795-27280520
  misc_feature 1..725: note = hyper
  source 1..725: mol_type = genomic DNA

SEQ ID NO: 2795 - DNA, 498 bp, Homo sapiens
  misc_feature 1..498: note = chr6:27463133-27463631
  misc_feature 1..498: note = hyper
  source 1..498: mol_type = genomic DNA
ttccacataatttttcgctccctccacctaagacacaaatcagcggaagcgattccgtgcctggaatcccctacgaacaccgtcgttcaccgaggagctttgggctcctggaagtccgaacaccccggatcagaggagagttggccatgactccccgtcggtaccggctgggtttggtgccagctatggcgagtacagaagcctggccggtcccggggcaggcaggcgctcgctggatgttattcgactgactggatatttgctggaaacgttaatgcttgtgcgatgaggactctctctaattgcagggcgctcaattaccaaggatagcctgacttcctttcctagaattctcatttcaccttagcatttccaaaaaaactcaccaaagacagaagtttgcacacgtcacctgacacgtcatttcaccaatctatcaaagggtgaagttccacagctgtagtcgtggccgagtggttaaggcgatggactagaaat

SEQ ID NO: 2796 - DNA, 123 bp, Homo sapiens; identical to SEQ ID NO: 542
  misc_feature 1..123: note = chr6:27512761-27512884
  misc_feature 1..123: note = hyper
  source 1..123: mol_type = genomic DNA

SEQ ID NO: 2797 - DNA, 151 bp, Homo sapiens; identical to SEQ ID NO: 543
  misc_feature 1..151: note = chr6:27512994-27513145
  misc_feature 1..151: note = hyper
  source 1..151: mol_type = genomic DNA

SEQ ID NO: 2798 - DNA, 138 bp, Homo sapiens
  misc_feature 1..138: note = chr6:27513349-27513487
  misc_feature 1..138: note = hyper
  source 1..138: mol_type = genomic DNA
ctgaatgagctctttcgttcgtgagcagaggccctgacgagactgaagaccaactatttccgagcgctccactcaaccattataagttcaccccagccgtcagcgatggcgtaggtaggtagtcgtggccgagtggtt

SEQ ID NO: 2799 - DNA, 385 bp, Homo sapiens
  misc_feature 1..385: note = chr6:27533992-27534377
  misc_feature 1..385: note = hyper
  source 1..385: mol_type = genomic DNA
ctccccctctgctgtcgggtgcagacacgaggtagcctccaggtgacaacacgggtggtgagagccgccgcatgaatccacactgcggctgaaggtcaagaattggcggtagcccatcggtagcccagagacccaaactgtgtccgatgtgagtgaaggtcaccccagatcagtgcgtcagttccgttttggcggccaaatttctgacgatcccatgtaagaaatgccacacctgtcaataggagcgactcacgcgctgggtctctttctcggatcgggtcgccaccccagtgccgggactatgctaaagactagagtctcagacttggaatttcgaggaaggtgttccaaaacgctgcgctccctccggcgagggacaagagca

SEQ ID NO: 2800 - DNA, 19 bp, Homo sapiens
  misc_feature 1..19: note = chr6:27835078-27835097
  misc_feature 1..19: note = hyper
  source 1..19: mol_type = genomic DNA
ccacgtcgtagccaccggc

SEQ ID NO: 2801 - DNA, 884 bp, Homo sapiens
  misc_feature 1..884: note = chr6:27839689-27840573
  misc_feature 1..884: note = hyper
  source 1..884: mol_type = genomic DNA
ctctcccctcggatgcggcgcgcaagctggatgtctttaggcataatagtgacgcgtttggcgtgaatggcgcacaggttggtatcctcaaatagccccaccaggtaggcctcgcaagcctcctgcagcgccatcaccgccgagctctggaagcgcagatcggtcttaaagtcctgtgcgatctcccgtaccaagcgctgaaaaggtagcttccggattagcagctcggtcgacttctggtagcggcggatctcgcgcagggccacggtgccggggcggtagcggtggggcttcttgacgccaccggtggccggagcgctcttgcgagccgccttggtggccagctgcttgcgcggcgctttgccgccggtggacttgcgagctgtttgctttgttcgtgccatggctaagtagacgtacctactcaacacaaatgagagaaaaaaactgatcatcccggtatttatagctgccctcgcgttctgattggacagtagactgtgccatgccacgtctcacacacggaattggctcccagtttaatctgctagtgaaagggagacattccgcctctgttttgggtcaagaaacgtaaaatggttttgctagctaaagaaaaacaaaaacggaaacaaaaaaaaatcccccaaaagtctaggatttttcatgcatcaaaatcctgtttaaatataagcttgataaatctaaacttgccttgcactattttaattacgaggtgtcattactgatttgacaaaaagttaaagaacgtaaaggaaaagtgaaactagagtaaatttgtaaatggaggcattgaaggggatatgaaattcgagcgttgtggtatgccagtatttctcaaatttaaacgtacttaatgtttt

SEQ ID NO: 2802 - DNA, 446 bp, Homo sapiens
  misc_feature 1..446: note = chr6:28175836-28176282
  misc_feature 1..446: note = hyper
  source 1..446: mol_type = genomic DNA
gcttctgaaatacagcgtgatggttaagagcatgggccgtggaaacagacccggggaaagcctcagctcggccactctttgccgcgtgaccctgggtggcaccttctaagggtgattctgggattctatgaattaatgcatggaaagcgcttgcgagagcgctagccggagtccgcgctatttaggtgtttgccaatattattgttgttgttaaggtgtgagggatcttggaagacagaagccaggaataaagtaaacctacagagacgtccctccccaaaccccggccgctacccctgcaagaccttgtggagcatgttaggtttcgtggcgtcgccaagttgtacctcctgcgcttcgccgcagataaagccccagcttagagcatggggtcgcaaccacccagagccttcagaccagtgagcactttccgcacaggtttgaat

SEQ ID NO: 2803 - DNA, 225 bp, Homo sapiens; identical to SEQ ID NO: 544
  misc_feature 1..225: note = chr6:28367054-28367279
  misc_feature 1..225: note = hyper
  source 1..225: mol_type = genomic DNA

SEQ ID NO: 2804 - DNA, 67 bp, Homo sapiens; identical to SEQ ID NO: 545
  misc_feature 1..67: note = chr6:28367280-28367347
  misc_feature 1..67: note = hyper
  source 1..67: mol_type = genomic DNA

SEQ ID NO: 2805 - DNA, 81 bp, Homo sapiens; identical to SEQ ID NO: 546
  misc_feature 1..81: note = chr6:28367490-28367571
  misc_feature 1..81: note = hyper
  source 1..81: mol_type = genomic DNA

SEQ ID NO: 2806 - DNA, 243 bp, Homo sapiens; identical to SEQ ID NO: 547
  misc_feature 1..243: note = chr6:28367572-28367815
  misc_feature 1..243: note = hyper
  source 1..243: mol_type = genomic DNA

SEQ ID NO: 2807 - DNA, 16 bp, Homo sapiens
  misc_feature 1..16: note = chr6:28411014-28411030
  misc_feature 1..16: note = hyper
  source 1..16: mol_type = genomic DNA
agcccttccaggctgc

SEQ ID NO: 2808 - DNA, 57 bp, Homo sapiens; identical to SEQ ID NO: 549
  misc_feature 1..57: note = chr6:28411031-28411088
  misc_feature 1..57: note = hyper
  source 1..57: mol_type = genomic DNA

SEQ ID NO: 2809 - DNA, 241 bp, Homo sapiens; identical to SEQ ID NO: 550
  misc_feature 1..241: note = chr6:28411151-28411392
  misc_feature 1..241: note = hyper
  source 1..241: mol_type = genomic DNA

SEQ ID NO: 2810 - DNA, 187 bp, Homo sapiens; identical to SEQ ID NO: 551
  misc_feature 1..187: note = chr6:36252984-36253171
  misc_feature 1..187: note = hyper
  source 1..187: mol_type = genomic DNA

SEQ ID NO: 2811 - DNA, 15 bp, Homo sapiens
  misc_feature 1..15: note = chr6:41605937-41605952
  misc_feature 1..15: note = hyper
  source 1..15: mol_type = genomic DNA
cagagagcagggagt

SEQ ID NO: 2812 - DNA, 320 bp, Homo sapiens
  misc_feature 1..320: note = chr6:41606037-41606357
  misc_feature 1..320: note = hyper
  source 1..320: mol_type = genomic DNA
cggacagacgtgtccggctcctggctgggccaagcccggcgcgggggaggggacccgcagaggggcgactgagaaggcgaggagggggcggggagagggtgggccagggaagaggggaggggagaggcgagtaggggaggagcgaggggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatc

SEQ ID NO: 2813 - DNA, 42 bp, Homo sapiens
  misc_feature 1..42: note = chr6:41606527-41606569
  misc_feature 1..42: note = hyper
  source 1..42: mol_type = genomic DNA
cgccctatggagcccccagcgcagccccgggcccaggtagga

SEQ ID NO: 2814 - DNA, 460 bp, Homo sapiens
  misc_feature 1..460: note = chr6:50681604-50682064
  misc_feature 1..460: note = hyper
  source 1..460: mol_type = genomic DNA
aggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgaggtattattacttttttttttttttttttttgagcgcgcgtgtgtgtggcggcggcggcggtggcggcggtggcggcggcggtggcagcctcccctgtctctaatctatattggaccgttacgtttaattataatctgtctttcgggggaagttaaggaaggaaaggggagaaagttcgttatgacatctgtcgccagggagggcaactctctgccacgttaagaaacatttgccataatgagcgggaaaacataatc

SEQ ID NO: 2815 - DNA, 20 bp, Homo sapiens
  misc_feature 1..20: note = chr6:50682319-50682339
  misc_feature 1..20: note = hyper
  source 1..20: mol_type = genomic DNA
tgattttgagcagcccgggc

SEQ ID NO: 2816 - DNA, 236 bp, Homo sapiens
  misc_feature 1..236: note = chr6:50682448-50682684
  misc_feature 1..236: note = hyper
  source 1..236: mol_type = genomic DNA
cgcggccccggagtcagttgcaaacctggatcccaacgccaagctccctgcacaagttgggcaggggctgtgtgtgtgtctgtgtgtgtgtgtctgtgcgtgtgtgtgcgtgtgtggtgtcacccgcacctatatagggtgggggattttttttccgctctctcgactgtgaggacgaggccgcccacccccagttcgcctgtttgcaaaggctctctggtgaagacgctgagacc

SEQ ID NO: 2817 - DNA, 230 bp, Homo sapiens
  misc_feature 1..230: note = chr6:50682711-50682941
  misc_feature 1..230: note = hyper
  source 1..230: mol_type = genomic DNA
cgctcgctttccttggagtgccagagaaagctcctggctccgggagagcggcgccttggttgcaaaatgacaaacctcaagtttttctgctctcccttttccccctcttccttccagatacgtcacgacggatcaaacagctaccgtttgatgcagcttggctgtctggagtcagtagccaattccactgtcgcctattcctcctcctctcctttaacttactccaccac

SEQ ID NO: 2818 - DNA, 64 bp, Homo sapiens
  misc_feature 1..64: note = chr6:50682991-50683055
  misc_feature 1..64: note = hyper
  source 1..64: mol_type = genomic DNA
cgctccaccaccagtccttccattacgagtttcagcacagccacccggccgtcacccccgacgc

SEQ ID NO: 2819 - DNA, 304 bp, Homo sapiens; identical to SEQ ID NO: 552
  misc_feature 1..304: note = chr6:50691909-50692213
  misc_feature 1..304: note = hyper
  source 1..304: mol_type = genomic DNA

SEQ ID NO: 2820 - DNA, 213 bp, Homo sapiens; identical to SEQ ID NO: 553
  misc_feature 1..213: note = chr6:50692299-50692512
  misc_feature 1..213: note = hyper
  source 1..213: mol_type = genomic DNA

SEQ ID NO: 2821 - DNA, 318 bp, Homo sapiens; identical to SEQ ID NO: 554
  misc_feature 1..318: note = chr6:50791177-50791495
  misc_feature 1..318: note = hyper
  source 1..318: mol_type = genomic DNA

SEQ ID NO: 2822 - DNA, 36 bp, Homo sapiens; identical to SEQ ID NO: 555
  misc_feature 1..36: note = chr6:50791550-50791586
  misc_feature 1..36: note = hyper
  source 1..36: mol_type = genomic DNA

SEQ ID NO: 2823 - DNA, 216 bp, Homo sapiens; identical to SEQ ID NO: 556
  misc_feature 1..216: note = chr6:50804152-50804368
  misc_feature 1..216: note = hyper
  source 1..216: mol_type = genomic DNA

SEQ ID NO: 2824 - DNA, 87 bp, Homo sapiens; identical to SEQ ID NO: 557
  misc_feature 1..87: note = chr6:50810627-50810714
  misc_feature 1..87: note = hyper
  source 1..87: mol_type = genomic DNA

SEQ ID NO: 2825 - DNA, 490 bp, Homo sapiens; identical to SEQ ID NO: 558
  misc_feature 1..490: note = chr6:50813325-50813815
  misc_feature 1..490: note = hyper
  source 1..490: mol_type = genomic DNA

SEQ ID NO: 2826 - DNA, 527 bp, Homo sapiens; identical to SEQ ID NO: 559
  misc_feature 1..527: note = chr6:56818720-56819247
  misc_feature 1..527: note = hyper
  source 1..527: mol_type = genomic DNA

SEQ ID NO: 2827 - DNA, 83 bp, Homo sapiens
  misc_feature 1..83: note = chr6:58147428-58147511
  misc_feature 1..83: note = hyper
  source 1..83: mol_type = genomic DNA
gaaaaccgcatctcccgaaatcccagaacgtaaacgtcgcccaggtactcgctctcttgtcattctccgggatgtaaaagact

SEQ ID NO: 2828 - DNA, 214 bp, Homo sapiens
  misc_feature 1..214: note = chr6:58147762-58147976
  misc_feature 1..214: note = hyper
  source 1..214: mol_type = genomic DNA
acaggcccggcggcggagccctgctcccctcccttatcagtaccgcggttagtgctctgctttatggccgcagcaatctcagacactttcggagcgtgttttttttttcttgtcctttcgctccccttttcgggcgccagctttcaaaccagaccaaaggtgtgctttcccccattatctcccagccttctttccttttcgcctctactcaagg

SEQ ID NO: 2829 - DNA, 420 bp, Homo sapiens; identical to SEQ ID NO: 560
  misc_feature 1..420: note = chr6:62995455-62995875
  misc_feature 1..420: note = hyper
  source 1..420: mol_type = genomic DNA

SEQ ID NO: 2830 - DNA, 53 bp, Homo sapiens; identical to SEQ ID NO: 561
  misc_feature 1..53: note = chr6:62996077-62996130
  misc_feature 1..53: note = hyper
  source 1..53: mol_type = genomic DNA

SEQ ID NO: 2831 - DNA, 83 bp, Homo sapiens; identical to SEQ ID NO: 562
  misc_feature 1..83: note = chr6:62996131-62996214
  misc_feature 1..83: note = hyper
  source 1..83: mol_type = genomic DNA

SEQ ID NO: 2832 - DNA, 181 bp, Homo sapiens; identical to SEQ ID NO: 563
  misc_feature 1..181: note = chr6:62996215-62996396
  misc_feature 1..181: note = hyper
  source 1..181: mol_type = genomic DNA

SEQ ID NO: 2833 - DNA, 58 bp, Homo sapiens
  misc_feature 1..58: note = chr6:70992440-70992498
  misc_feature 1..58: note = hyper
  source 1..58: mol_type = genomic DNA
cttcgataggactcgcggcaggtgctcgaggctggaggaagcgcgggtctgagagccc

SEQ ID NO: 2834 - DNA, 150 bp, Homo sapiens; identical to SEQ ID NO: 564
  misc_feature 1..150: note = chr6:73329801-73329951
  misc_feature 1..150: note = hyper
  source 1..150: mol_type = genomic DNA

SEQ ID NO: 2835 - DNA, 164 bp, Homo sapiens; identical to SEQ ID NO: 565
  misc_feature 1..164: note = chr6:73330950-73331114
  misc_feature 1..164: note = hyper
  source 1..164: mol_type = genomic DNA

SEQ ID NO: 2836 - DNA, 123 bp, Homo sapiens; identical to SEQ ID NO: 566
  misc_feature 1..123: note = chr6:73331115-73331238
  misc_feature 1..123: note = hyper
  source 1..123: mol_type = genomic DNA

SEQ ID NO: 2837 - DNA, 390 bp, Homo sapiens; identical to SEQ ID NO: 567
  misc_feature 1..390: note = chr6:73331239-73331629
  misc_feature 1..390: note = hyper
  source 1..390: mol_type = genomic DNA

SEQ ID NO: 2838 - DNA, 329 bp, Homo sapiens
  misc_feature 1..329: note = chr6:73332136-73332465
  misc_feature 1..329: note = hyper
  source 1..329: mol_type = genomic DNA
ggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttct

SEQ ID NO: 2839 - DNA, 560 bp, Homo sapiens
  misc_feature 1..560: note = chr6:80656673-80657233
  misc_feature 1..560: note = hyper
  source 1..560: mol_type = genomic DNA
cagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctaccgtgtcgttgagtgccgtggacactacgtttaggacactacccggctccgagtccaggagccccatcgcggcgatgagcgggcgctggcggcaggagaaagcggagacccagagagagggctgaccccggaggcggtggcggccgacggggcgagcggcggccgggaacccctctaacggcggcggcccggctgcgtcttctcctgctcctcaaggcgccgcggcggcggggatgcggcagaaggcagggccaagcggaaggcgtcgtcaaggttcccgggagaaagacgaggaggtggagga

SEQ ID NO: 2840 - DNA, 272 bp, Homo sapiens; identical to SEQ ID NO: 568
  misc_feature 1..272: note = chr6:84417429-84417701
  misc_feature 1..272: note = hyper
  source 1..272: mol_type = genomic DNA

SEQ ID NO: 2841 - DNA, 100 bp, Homo sapiens
  misc_feature 1..100: note = chr6:84419102-84419202
  misc_feature 1..100: note = hyper
  source 1..100: mol_type = genomic DNA
ggcacgcactgggctcgcgcaccacgcacacctgcccgccgactgcggggggagccctgggcgttgggggcgttggccaagacgggcgagtgggcttctc

SEQ ID NO: 2842 - DNA, 126 bp, Homo sapiens
  misc_feature 1..126: note = chr6:84419203-84419329
  misc_feature 1..126: note = hyper
  source 1..126: mol_type = genomic DNA
ggttctactctgtgaaggccaaggcaagggcgtcgtcgcgcgctgcctggcggagcccagccccttccccacactgtcgctgacacgcccgcctgtcaaaggctccgaggcccagatgagcagggc

SEQ ID NO: 2843 - DNA, 61 bp, Homo sapiens
  misc_feature 1..61: note = chr6:84419330-84419391
  misc_feature 1..61: note = hyper
  source 1..61: mol_type = genomic DNA
attttaaatgtcagatcctgccggccatccgcgaccgtcacctgtgcgtcttcagctcctc

SEQ ID NO: 2844 - DNA, 110 bp, Homo sapiens
  misc_feature 1..110: note = chr6:84562820-84562930
  misc_feature 1..110: note = hyper
  source 1..110: mol_type = genomic DNA
cggaaattggctgctcgggcgaatgttgtttttctccgcagccatgtgtcgaagggcgattaacattcgctcgacaaaaccctgtcccgggccatttgggagttgcacgc

SEQ ID NO: 2845 - DNA, 354 bp, Homo sapiens
  misc_feature 1..354: note = chr6:84562931-84563285
  misc_feature 1..354: note = hyper
  source 1..354: mol_type = genomic DNA
ttcacacccggggctcagcccggtgcgccttcacgcgcagcctttttgtttatgcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccgggtaggcttccccgcgctgctctgcgcctcccagcttcccccgtctctccctcctg

SEQ ID NO: 2846 - DNA, 437 bp, Homo sapiens
  misc_feature 1..437: note = chr6:84563416-84563853
  misc_feature 1..437: note = hyper
  source 1..437: mol_type = genomic DNA
cgcaggcttctggagaccctgggtggacgccggaggcaagaaagaagaggagacgccgaaccacgccgcggaggcggtgagtgagccacgcgtctcaggccgcgcctcccacgggtgcagaagatcgaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctccagatgcccgatggccctggaatgaccgcagcctcaggaaa

SEQ ID NO: 2847 - DNA, 866 bp, Homo sapiens; identical to SEQ ID NO: 569
  misc_feature 1..866: note = chr6:85472401-85473267
  misc_feature 1..866: note = hyper
  source 1..866: mol_type = genomic DNA

SEQ ID NO: 2848 - DNA, 694 bp, Homo sapiens; identical to SEQ ID NO: 570
  misc_feature 1..694: note = chr6:85473508-85474202
  misc_feature 1..694: note = hyper
  source 1..694: mol_type = genomic DNA

SEQ ID NO: 2849 - DNA, 119 bp, Homo sapiens; identical to SEQ ID NO: 571
  misc_feature 1..119: note = chr6:85482703-85482822
  misc_feature 1..119: note = hyper
  source 1..119: mol_type = genomic DNA

SEQ ID NO: 2850 - DNA, 69 bp, Homo sapiens
  misc_feature 1..69: note = chr6:85484557-85484626
  misc_feature 1..69: note = hyper
  source 1..69: mol_type = genomic DNA
gggctgcgggcgggtgagcgccgccgggcaccgggcgggggcacgtggcgccctctggggaccgtccgc

SEQ ID NO: 2851 - DNA, 217 bp, Homo sapiens
  misc_feature 1..217: note = chr6:85484716-85484933
  misc_feature 1..217: note = hyper
  source 1..217: mol_type = genomic DNA
cgctgacccctccacctggctgaaggcagcagccctgggagactctggcactctgggccggagcaggagctgtgccccatggcaacccagactgaaagggaagccctgtctgttgctctttgctgcggattcgagggaggccgtctcgagtcgctcagaagcgacctaaagaaggcactggcctctgtgcgccgaacctccacgagatagactaagt

SEQ ID NO: 2852 - DNA, 175 bp, Homo sapiens
  misc_feature 1..175: note = chr6:88876302-88876477
  misc_feature 1..175: note = hyper
  source 1..175: mol_type = genomic DNA
ttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttc

SEQ ID NO: 2853 - DNA, 111 bp, Homo sapiens
  misc_feature 1..111: note = chr6:88876630-88876741
  misc_feature 1..111: note = hyper
  source 1..111: mol_type = genomic DNA
ggggccgggctgagctttgggaccgcgctgcgcagcccccgagccgttcgctacctggctgcggtcgcgcggccacctgtcctccgccctcggggcgccgcccagcttcgc

SEQ ID NO: 2854 - DNA, 322 bp, Homo sapiens
  misc_feature 1..322: note = chr6:88876742-88877064
  misc_feature 1..322: note = hyper
  source 1..322: mol_type = genomic DNA
ccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggactcgggggcggcagcggcgggcgcctggggagccgcggtgtgctcagcagccgcggcaggaattaggggacatgctcgttaattgtttccactatcagccgcc

SEQ ID NO: 2855 - DNA, 208 bp, Homo sapiens
  misc_feature 1..208: note = chr6:88877065-88877273
  misc_feature 1..208: note = hyper
  source 1..208: mol_type = genomic DNA
tctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgca

SEQ ID NO: 2856 - DNA, 184 bp, Homo sapiens
  misc_feature 1..184: note = chr6:94127476-94127660
  misc_feature 1..184: note = hyper
  source 1..184: mol_type = genomic DNA
tttctagcagatgtccgtccttctgcaaacgcgtaaccgccagcttggaggcacggggttctctgaatgggttcagcatctatacaggttgcagatgtggaaagtggggtcagaaggtcaggctgaaagaaggactagaatttggcgccgggtttgaggggggcttgagcgaactaagaggagt

SEQ ID NO: 2857 - DNA, 736 bp, Homo sapiens; identical to SEQ ID NO: 572
  misc_feature 1..736: note = chr6:99271926-99272662
  misc_feature 1..736: note = hyper
  source 1..736: mol_type = genomic DNA

SEQ ID NO: 2858 - DNA, 150 bp, Homo sapiens; identical to SEQ ID NO: 573
  misc_feature 1..150: note = chr6:99277180-99277330
  misc_feature 1..150: note = hyper
  source 1..150: mol_type = genomic DNA

SEQ ID NO: 2859 - DNA, 105 bp, Homo sapiens; identical to SEQ ID NO: 574
  misc_feature 1..105: note = chr6:99295759-99295864
  misc_feature 1..105: note = hyper
  source 1..105: mol_type = genomic DNA

SEQ ID NO: 2860 - DNA, 304 bp, Homo sapiens; identical to SEQ ID NO: 575
  misc_feature 1..304: note = chr6:99296061-99296365
  misc_feature 1..304: note = hyper
  source 1..304: mol_type = genomic DNA

SEQ ID NO: 2861 - DNA, 49 bp, Homo sapiens; identical to SEQ ID NO: 576
  misc_feature 1..49: note = chr6:99296407-99296456
  misc_feature 1..49: note = hyper
  source 1..49: mol_type = genomic DNA

SEQ ID NO: 2862 - DNA, 46 bp, Homo sapiens; identical to SEQ ID NO: 577
  misc_feature 1..46: note = chr6:100038661-100038707
  misc_feature 1..46: note = hyper
  source 1..46: mol_type = genomic DNA

SEQ ID NO: 2863 - DNA, 369 bp, Homo sapiens; identical to SEQ ID NO: 578
  misc_feature 1..369: note = chr6:100038785-100039154
  misc_feature 1..369: note = hyper
  source 1..369: mol_type = genomic DNA

SEQ ID NO: 2864 - DNA, 251 bp, Homo sapiens; identical to SEQ ID NO: 579
  misc_feature 1..251: note = chr6:100050858-100051109
  misc_feature 1..251: note = hyper
  source 1..251: mol_type = genomic DNA

SEQ ID NO: 2865 - DNA, 149 bp, Homo sapiens; identical to SEQ ID NO: 580
  misc_feature 1..149: note = chr6:100051359-100051508
  misc_feature 1..149: note = hyper
  source 1..149: mol_type = genomic DNA

SEQ ID NO: 2866 - DNA, 187 bp, Homo sapiens; identical to SEQ ID NO: 581
  misc_feature 1..187: note = chr6:100051771-100051958
  misc_feature 1..187: note = hyper
  source 1..187: mol_type = genomic DNA

SEQ ID NO: 2867 - DNA, 430 bp, Homo sapiens
  misc_feature 1..430: note = chr6:100061022-100061452
  misc_feature 1..430: note = hyper
  source 1..430: mol_type = genomic DNA
tgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccggga

SEQ ID NO: 2868 - DNA, 682 bp, Homo sapiens
  misc_feature 1..682: note = chr6:100061988-100062670
  misc_feature 1..682: note = hyper
  source 1..682: mol_type = genomic DNA
cggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacaga

SEQ ID NO: 2869 - skipped

SEQ ID NO: 2870 - DNA, 241 bp, Homo sapiens; identical to SEQ ID NO: 583
  misc_feature 1..241: note = chr6:100441497-100441738
  misc_feature 1..241: note = hyper
  source 1..241: mol_type = genomic DNA

SEQ ID NO: 2871 - DNA, 337 bp, Homo sapiens; identical to SEQ ID NO: 584
  misc_feature 1..337: note = chr6:100441761-100442098
  misc_feature 1..337: note = hyper
  source 1..337: mol_type = genomic DNA

SEQ ID NO: 2872 - DNA, 21 bp, Homo sapiens
  misc_feature 1..21: note = chr6:100903384-100903405
  misc_feature 1..21: note = hyper
  source 1..21: mol_type = genomic DNA
tctctttctaaatcccggctc

SEQ ID NO: 2873 - DNA, 132 bp, Homo sapiens; identical to SEQ ID NO: 585
  misc_feature 1..132: note = chr6:100912919-100913051
  misc_feature 1..132: note = hyper
  source 1..132: mol_type = genomic DNA

SEQ ID NO: 2874 - DNA, 59 bp, Homo sapiens
  misc_feature 1..59: note = chr6:101840708-101840767
  misc_feature 1..59: note = hyper
  source 1..59: mol_type = genomic DNA
caatcttggagtctgcgacctcaggttcggcgcccactagatctcgaatccaacttctt

SEQ ID NO: 2875 - DNA, 104 bp, Homo sapiens; identical to SEQ ID NO: 586
  misc_feature 1..104: note = chr6:105389509-105389613
  misc_feature 1..104: note = hyper
  source 1..104: mol_type = genomic DNA

SEQ ID NO: 2876 - DNA, 161 bp, Homo sapiens
  misc_feature 1..161: note = chr6:105401596-105401757
  misc_feature 1..161: note = hyper
  source 1..161: mol_type = genomic DNA
cggccgcctggggagcgacctgcctggagaggcgggttgcgatggcagcgctgggctacagaccccgccttatttgcggggaggagaggacgggtggagtcacttgccgcattgccacagcccctcctcctagttttaagaagaaccgaagcattgtttct

SEQ ID NO: 2877 - DNA, 83 bp, Homo sapiens; identical to SEQ ID NO: 587
  misc_feature 1..83: note = chr6:105584133-105584216
  misc_feature 1..83: note = hyper
  source 1..83: mol_type = genomic DNA

SEQ ID NO: 2878 - DNA, 103 bp, Homo sapiens; identical to SEQ ID NO: 588
  misc_feature 1..103: note = chr6:105584217-105584320
  misc_feature 1..103: note = hyper
  source 1..103: mol_type = genomic DNA

SEQ ID NO: 2879 - DNA, 185 bp, Homo sapiens; identical to SEQ ID NO: 589
  misc_feature 1..185: note = chr6:105584366-105584551
  misc_feature 1..185: note = hyper
  source 1..185: mol_type = genomic DNA

SEQ ID NO: 2880 - DNA, 1015 bp, Homo sapiens; identical to SEQ ID NO: 590
  misc_feature 1..1015: note = chr6:105584552-105585567
  misc_feature 1..1015: note = hyper
  source 1..1015: mol_type = genomic DNA

SEQ ID NO: 2881 - DNA, 427 bp, Homo sapiens; identical to SEQ ID NO: 591
  misc_feature 1..427: note = chr6:106429049-106429476
  misc_feature 1..427: note = hyper
  source 1..427: mol_type = genomic DNA

SEQ ID NO: 2882 - DNA, 35 bp, Homo sapiens; identical to SEQ ID NO: 592
  misc_feature 1..35: note = chr6:106429589-106429624
  misc_feature 1..35: note = hyper
  source 1..35: mol_type = genomic DNA

SEQ ID NO: 2883 - DNA, 1251 bp, Homo sapiens; identical to SEQ ID NO: 593
  misc_feature 1..1251: note = chr6:106441869-106443120
  misc_feature 1..1251: note = hyper
  source 1..1251: mol_type = genomic DNA

SEQ ID NO: 2884 - DNA, 715 bp, Homo sapiens
  misc_feature 1..715: note = chr6:108436072-108436787
  misc_feature 1..715: note = hyper
  source 1..715: mol_type = genomic DNA
ggcttagcctgcctgcgatttccaacttctctttccacggatcgaccgcggccttggcaaggacttgagtctgcgttccagccccttccgctcccagcgcgcacgcagcctctcgcctttgcgtcggcgggttgctggttgccggtacccgctcagcagctaggagccttggggaaccctagctcttagcttccccgtctggcgaggccagagggccaagttgctcactgggctgtgctgagggataaggggagaaaagaacggaaatcgcagctacgagggctagagggacggcgcggctgcttgaggacgggtcgcctagcggtgggcgagtagggctgtgcgtaaaaggatctagacagacagtcgtgcgcccgcagggttgcaggacaggggcaggccgagttgtggcgcgtgtgtgtttgtgtgtgctcgcctccgggttgcgcgctttcagggctttggatgccggggattttgaggacccattcaaagctccgagggggcggaggctcaagcaagccagggaaaaggtcccctaagcctcagagcctgggctgcgccccagacaaagtgcctaatgcagagtaggctcttaataggtttgcattggatctaaacgaaagctagtgaaattcgtacatgattctaatgagagatgacggccaggtgttctcagcagcccctggccctcacggggcgacctgaaagttcc

SEQ ID NO: 2885 - DNA, 15 bp, Homo sapiens
  misc_feature 1..15: note = chr6:108438142-108438157
  misc_feature 1..15: note = hyper
  source 1..15: mol_type = genomic DNA
gcagcccaactgggg

SEQ ID NO: 2886 - DNA, 303 bp, Homo sapiens; identical to SEQ ID NO: 595
  misc_feature 1..303: note = chr6:108438260-108438563
  misc_feature 1..303: note = hyper
  source 1..303: mol_type = genomic DNA

SEQ ID NO: 2887 - DNA, 567 bp, Homo sapiens; identical to SEQ ID NO: 596
  misc_feature 1..567: note = chr6:108440078-108440645
  misc_feature 1..567: note = hyper
  source 1..567: mol_type = genomic DNA

SEQ ID NO: 2888 - DNA, 223 bp, Homo sapiens; identical to SEQ ID NO: 597
  misc_feature 1..223: note = chr6:108440744-108440967
  misc_feature 1..223: note = hyper
  source 1..223: mol_type = genomic DNA

SEQ ID NO: 2889 - DNA, 822 bp, Homo sapiens
  misc_feature 1..822: note = chr6:108478874-108479696
  misc_feature 1..822: note = hyper
  source 1..822: mol_type = genomic DNA
gtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctgctgagccagacactccgcggacctgacctccgttttacccatctgtaaaatggagcagctgggcgctggcaagccgtaagtccaagagctttggctccaccagcgtgtacgacgctcatttcctttctctctccccacaccctttccaaaaactgtaagccagaaaacctggccaggcctccgcgacggcgagaaacggtcttgaaggtcggtcggtcgccgtaatgcggtccggatcgtgcacgtgctgtttcgccactgccctccggctcctccttaacaaagatgtcaaccgtgctaaatcacaggtggtgcctttgtaagaccagctattgtcccctcataagtcaagatataaaacgctttgtactgaatggcccatgatctggagcgctcaacttgggag

SEQ ID NO: 2890 - DNA, 246 bp, Homo sapiens
  misc_feature 1..246: note = chr6:108484872-108485118
  misc_feature 1..246: note = hyper
  source 1..246: mol_type = genomic DNA
gagtagaaggcagcccgcactaaggctccaggcttatttgggacctggtgggcgacggggcctcagcccctcccgcctaccctggagcttgttgccgccgttaccactgaaccagtcatgccagaaagtcatcacgatgatttcagaactgtattgtgatttatgcaaagcgcgccgataattacagccgggcgcacagaacacaggatgcatatgctgcgggtgtgtgcgcgcagtgttgtgcct

SEQ ID NO: 2891 - DNA, 494 bp, Homo sapiens
  misc_feature 1..494: note = chr6:108485513-108486007
  misc_feature 1..494: note = hyper
  source 1..494: mol_type = genomic DNA
aaagaaccccataatcgcgtccgcgttatgggggtggtggtggtaggtggctgaagcaagtggatttctggcgtgaaccagaacctgaggattccaaacggagcctggcatcttattgtgtttctcaaatcctgcccgaaattcctcccctctctgggcgccgagttcgagaaagcgctacgccgccggtcgggctagctccacaagcggctgtacaagttggctgtcaaaaaacgctgatttctcctcctgtcacctaataaacccctacgcgcttatggcctcgtcccacaatcccccaatctcgtcccaattcgaaaaaccgaggaggagggaataaactgagagataaagatccccccatcttgctctttccccgggaccccagccttggtcgcggcgccccactaaggaggacacaggctctggtgtgtgtggtgtgcgagaccccgagctcgaggccgagccaaggctgggcagaaagttgcaatcac

SEQ ID NO: 2892 - DNA, 386 bp, Homo sapiens
  misc_feature 1..386: note = chr6:108486008-108486394
  misc_feature 1..386: note = hyper
  source 1..386: mol_type = genomic DNA
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcc

SEQ ID NO: 2893 - DNA, 665 bp, Homo sapiens; identical to SEQ ID NO: 598
  misc_feature 1..665: note = chr6:108487779-108488444
  misc_feature 1..665: note = hyper
  source 1..665: mol_type = genomic DNA

SEQ ID NO: 2894 - DNA, 79 bp, Homo sapiens; identical to SEQ ID NO: 599
  misc_feature 1..79: note = chr6:108489730-108489809
  misc_feature 1..79: note = hyper
  source 1..79: mol_type = genomic DNA

SEQ ID NO: 2895 - DNA, 180 bp, Homo sapiens; identical to SEQ ID NO: 600
  misc_feature 1..180: note = chr6:108490066-108490246
  misc_feature 1..180: note = hyper
  source 1..180: mol_type = genomic DNA

SEQ ID NO: 2896 - DNA, 219 bp, Homo sapiens; identical to SEQ ID NO: 601
  misc_feature 1..219: note = chr6:108490296-108490515
  misc_feature 1..219: note = hyper
  source 1..219: mol_type = genomic DNA

SEQ ID NO: 2897 - DNA, 60 bp, Homo sapiens; identical to SEQ ID NO: 602
  misc_feature 1..60: note = chr6:108490537-108490597
  misc_feature 1..60: note = hyper
  source 1..60: mol_type = genomic DNA

SEQ ID NO: 2898 - DNA, 41 bp, Homo sapiens
  misc_feature 1..41: note = chr6:108490960-108491001
  misc_feature 1..41: note = hyper
  source 1..41: mol_type = genomic DNA
cacaatctcccctcccgccctgtgggaggggggcgccgagc

SEQ ID NO: 2899 - DNA, 551 bp, Homo sapiens; identical to SEQ ID NO: 603
  misc_feature 1..551: note = chr6:108495915-108496466
  misc_feature 1..551: note = hyper
  source 1..551: mol_type = genomic DNA

SEQ ID NO: 2900 - DNA, 460 bp, Homo sapiens
  misc_feature 1..460: note = chr6:110678940-110679400
  misc_feature 1..460: note = hyper
  source 1..460: mol_type = genomic DNA
atagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggcc

SEQ ID NO: 2901 - DNA, 265 bp, Homo sapiens
  misc_feature 1..265: note = chr6:110679401-110679666
  misc_feature 1..265: note = hyper
  source 1..265: mol_type = genomic DNA
aacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctgga

SEQ ID NO: 2902 - DNA, 208 bp, Homo sapiens; identical to SEQ ID NO: 604
  misc_feature 1..208: note = chr6:117086271-117086479
  misc_feature 1..208: note = hyper
  source 1..208: mol_type = genomic DNA

SEQ ID NO: 2903 - DNA, 160 bp, Homo sapiens; identical to SEQ ID NO: 605
  misc_feature 1..160: note = chr6:117086480-117086640
  misc_feature 1..160: note = hyper
  source 1..160: mol_type = genomic DNA

SEQ ID NO: 2904 - DNA, 55 bp, Homo sapiens
  misc_feature 1..55: note = chr6:117586007-117586062
  misc_feature 1..55: note = hyper
  source 1..55: mol_type = genomic DNA
agaaaggagcaggatcgaactttagaggggcagaagggcacggcccaagagagca

SEQ ID NO: 2905 - DNA, 310 bp, Homo sapiens; identical to SEQ ID NO: 606
  misc_feature 1..310: note = chr6:117591206-117591516
  misc_feature 1..310: note = hyper
  source 1..310: mol_type = genomic DNA

SEQ ID NO: 2906 - DNA, 218 bp, Homo sapiens
  misc_feature 1..218: note = chr6:118228651-118228869
  misc_feature 1..218: note = hyper
  source 1..218: mol_type = genomic DNA
gcggcggcggcggcacgggcgcgagggtgcgcgcactgggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgcc

SEQ ID NO: 2907 - DNA, 344 bp, Homo sapiens
  misc_feature 1..344: note = chr6:118228870-118229214
  misc_feature 1..344: note = hyper
  source 1..344: mol_type = genomic DNA
cgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcctttgggacggggttgcggccggaggagactgaggagatcgggcgacgacgcgctccgcgg

SEQ ID NO: 2908 - DNA, 37 bp, Homo sapiens; identical to SEQ ID NO: 607
  misc_feature 1..37: note = chr6:118229695-118229732
  misc_feature 1..37: note = hyper
  source 1..37: mol_type = genomic DNA

SEQ ID NO: 2909 - DNA, 91 bp, Homo sapiens; identical to SEQ ID NO: 608
  misc_feature 1..91: note = chr6:118229733-118229824
  misc_feature 1..91: note = hyper
  source 1..91: mol_type = genomic DNA

SEQ ID NO: 2910 - DNA, 35 bp, Homo sapiens
  misc_feature 1..35: note = chr6:123316972-123317007
  misc_feature 1..35: note = hyper
  source 1..35: mol_type = genomic DNA
tgtctacaacaaatgcgaaaagtacagaatgtttc

SEQ ID NO: 2911 - DNA, 642 bp, Homo sapiens
  misc_feature 1..642: note = chr6:123317072-123317714
  misc_feature 1..642: note = hyper
  source 1..642: mol_type = genomic DNA
cgtctacaacagctactctccaggctgatctggggtcttgcacacaaagggcgaagagaggggcgtggggaggctggaaagcatggttgccccgcctggcccggcgacgcccgctcagcagcctgctgaggagtggggacgaagagcagcctaaacttagggctcgggatatttcgatgccacccaaattgccgtcctaccccaacgaggcagggaaaggagcggagcgcgcgcgcgagctgagtgagtgcttacgtcgcagcgagatctgtgctgggataattagagaggagttgggctgagccgagtcctctttcagcagcagcagccggagccgccgccgcagcccggtggggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgc

SEQ ID NO: 2912 - DNA, 156 bp, Homo sapiens
  misc_feature 1..156: note = chr6:123317715-123317871
  misc_feature 1..156: note = hyper
  source 1..156: mol_type = genomic DNA
gctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcga

SEQ ID NO: 2913 - DNA, 110 bp, Homo sapiens
  misc_feature 1..110: note = chr6:126068068-126068178
  misc_feature 1..110: note = hyper
  source 1..110: mol_type = genomic DNA
cgttccctcattctttctcttttctttctctccacataacgcctcccctacacctccccacctccaatccactaccgtatttaagtcggcgggggcgctttaaagggttt

SEQ ID NO: 2914 - DNA, 104 bp, Homo sapiens
  misc_feature 1..104: note = chr6:127440406-127440510
  misc_feature 1..104: note = hyper
  source 1..104: mol_type = genomic DNA
gcctcccggggaaggcgccagcgaagaagtaagtgcagggttttttacgcgtttgctccctcccgccgcgttcacctgtcgggtcgctttgcctgtccggagcc

SEQ ID NO: 2915 - DNA, 452 bp, Homo sapiens
  misc_feature 1..452: note = chr6:127440511-127440963
  misc_feature 1..452: note = hyper
  source 1..452: mol_type = genomic DNA
gctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgag

SEQ ID NO: 2916 - DNA, 703 bp, Homo sapiens
  misc_feature 1..703: note = chr6:127441030-127441733
  misc_feature 1..703: note = hyper
  source 1..703: mol_type = genomic DNA
cgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagat

SEQ ID NO: 2917 - DNA, 764 bp, Homo sapiens
  misc_feature 1..764: note = chr6:130686429-130687193
  misc_feature 1..764: note = hyper
  source 1..764: mol_type = genomic DNA
ctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 2918 - DNA, 120 bp, Homo sapiens
  misc_feature 1..120: note = chr6:130687224-130687344
  misc_feature 1..120: note = hyper
  source 1..120: mol_type = genomic DNA
cggtggcggcgccgcctgagcggcgactccctctcccctgcccggcttgctgcgcccggtgccctccgagggcaggcgcgcctggactctgcgcccggatggcggcggccctctgtgagc

SEQ ID NO: 2919 - DNA, 63 bp, Homo sapiens
  misc_feature 1..63: note = chr6:133562374-133562437
  misc_feature 1..63: note = hyper
  source 1..63: mol_type = genomic DNA
cccccggcggcctcacgagcccgcagtagccggtggcgacgtcgcccccgccccacctccctg

SEQ ID NO: 2920 - DNA, 408 bp, Homo sapiens
  misc_feature 1..408: note = chr6:133562674-133563082
  misc_feature 1..408: note = hyper
  source 1..408: mol_type = genomic DNA
ggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcc

SEQ ID NO: 2921 - DNA, 604 bp, Homo sapiens; identical to SEQ ID NO: 609
  misc_feature 1..604: note = chr6:133563411-133564015
  misc_feature 1..604: note = hyper
  source 1..604: mol_type = genomic DNA

SEQ ID NO: 2922 - DNA, 437 bp, Homo sapiens; identical to SEQ ID NO: 610
  misc_feature 1..437: note = chr6:134210582-134211019
  misc_feature 1..437: note = hyper
  source 1..437: mol_type = genomic DNA

SEQ ID NO: 2923 - DNA, 224 bp, Homo sapiens; identical to SEQ ID NO: 611
  misc_feature 1..224: note = chr6:134211111-134211335
  misc_feature 1..224: note = hyper
  source 1..224: mol_type = genomic DNA

SEQ ID NO: 2924 - DNA, 35 bp, Homo sapiens; identical to SEQ ID NO: 612
  misc_feature 1..35: note = chr6:137244114-137244149
  misc_feature 1..35: note = hyper
  source 1..35: mol_type = genomic DNA

SEQ ID NO: 2925 - DNA, 231 bp, Homo sapiens; identical to SEQ ID NO: 613
  misc_feature 1..231: note = chr6:137244235-137244466
  misc_feature 1..231: note = hyper
  source 1..231: mol_type = genomic DNA

SEQ ID NO: 2926 - DNA, 258 bp, Homo sapiens; identical to SEQ ID NO: 614
  misc_feature 1..258: note = chr6:137809108-137809366
  misc_feature 1..258: note = hyper
  source 1..258: mol_type = genomic DNA

SEQ ID NO: 2927 - DNA, 472 bp, Homo sapiens; identical to SEQ ID NO: 615
  misc_feature 1..472: note = chr6:137809445-137809917
  misc_feature 1..472: note = hyper
  source 1..472: mol_type = genomic DNA

SEQ ID NO: 2928 - DNA, 929 bp, Homo sapiens; identical to SEQ ID NO: 616
  misc_feature 1..929: note = chr6:137810032-137810961
  misc_feature 1..929: note = hyper
  source 1..929: mol_type = genomic DNA

SEQ ID NO: 2929 - DNA, 15 bp, Homo sapiens
  misc_feature 1..15: note = chr6:137814604-137814619
  misc_feature 1..15: note = hyper
  source 1..15: mol_type = genomic DNA
cccagtgctggaagc

SEQ ID NO: 2930 - DNA, 110 bp, Homo sapiens
  misc_feature 1..110: note = chr6:137814653-137814763
  misc_feature 1..110: note = hyper
  source 1..110: mol_type = genomic DNA
cgccttgagtagcgagtggggaggccggatggtgccgatggcgggaagtgaggcggcggacagcggtgacgaggcgttgccagatgagagcgcgccgcccaagatggggt

SEQ ID NO: 2931 - DNA, 151 bp, Homo sapiens; identical to SEQ ID NO: 617
  misc_feature 1..151: note = chr6:137815020-137815171
  misc_feature 1..151: note = hyper
  source 1..151: mol_type = genomic DNA

SEQ ID NO: 2932 - DNA, 515 bp, Homo sapiens; identical to SEQ ID NO: 618
  misc_feature 1..515: note = chr6:137815224-137815739
  misc_feature 1..515: note = hyper
  source 1..515: mol_type = genomic DNA

SEQ ID NO: 2933 - DNA, 777 bp, Homo sapiens; identical to SEQ ID NO: 619
  misc_feature 1..777: note = chr6:137816459-137817236
  misc_feature 1..777: note = hyper
  source 1..777: mol_type = genomic DNA

SEQ ID NO: 2934 - DNA, 94 bp, Homo sapiens; identical to SEQ ID NO: 620
  misc_feature 1..94: note = chr6:137818505-137818599
  misc_feature 1..94: note = hyper
  source 1..94: mol_type = genomic DNA

SEQ ID NO: 2935 - DNA, 649 bp, Homo sapiens; identical to SEQ ID NO: 621
  misc_feature 1..649: note = chr6:137818618-137819267
  misc_feature 1..649: note = hyper
  source 1..649: mol_type = genomic DNA

SEQ ID NO: 2936 - DNA, 280 bp, Homo sapiens; identical to SEQ ID NO: 622
  misc_feature 1..280: note = chr6:137819268-137819548
  misc_feature 1..280: note = hyper
  source 1..280: mol_type = genomic DNA

SEQ ID NO: 2937 - DNA, 165 bp, Homo sapiens
  misc_feature 1..165: note = chr6:146755496-146755661
  misc_feature 1..165: note = hyper
  source 1..165: mol_type = genomic DNA
ggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagct

SEQ ID NO: 2938 - DNA, 52 bp, Homo sapiens; identical to SEQ ID NO: 623
  misc_feature 1..52: note = chr6:150285317-150285369
  misc_feature 1..52: note = hyper
  source 1..52: mol_type = genomic DNA

SEQ ID NO: 2939 - DNA, 342 bp, Homo sapiens; identical to SEQ ID NO: 624
  misc_feature 1..342: note = chr6:150285544-150285886
  misc_feature 1..342: note = hyper
  source 1..342: mol_type = genomic DNA

SEQ ID NO: 2940 - DNA, 429 bp, Homo sapiens; identical to SEQ ID NO: 625
  misc_feature 1..429: note = chr6:150286099-150286528
  misc_feature 1..429: note = hyper
  source 1..429: mol_type = genomic DNA

SEQ ID NO: 2941 - DNA, 74 bp, Homo sapiens
  misc_feature 1..74: note = chr6:155316256-155316330
  misc_feature 1..74: note = hyper
  source 1..74: mol_type = genomic DNA
cgatgtttcttgaattgttttatttgtgttgttccaaagaaagcgcgagggacatggtccgggaccagccggga

SEQ ID NO: 2942 - DNA, 533 bp, Homo sapiens; identical to SEQ ID NO: 626
  misc_feature 1..533: note = chr6:157556764-157557297
  misc_feature 1..533: note = hyper
  source 1..533: mol_type = genomic DNA

SEQ ID NO: 2943 - DNA, 39 bp, Homo sapiens
  misc_feature 1..39: note = chr6:159590048-159590087
  misc_feature 1..39: note = hyper
  source 1..39: mol_type = genomic DNA
ggaactacagcgctgcggaccgggtgaggggtcccggcc

SEQ ID NO: 2944 - DNA, 608 bp, Homo sapiens
  misc_feature 1..608: note = chr6:159590154-159590762
  misc_feature 1..608: note = hyper
  source 1..608: mol_type = genomic DNA
cgacttccccagccagaaaatgagagggttagacgaggggaggaacttcctcagccacttggcccggcacagcgaccgccccaagttcagaaccgctaagtcagtccggggcgctccggccccttcgtcccgcgccccgcccgcctccagcccgggccccgccgcccccgtcgcccctgtcgcccgggtcgcccccgccggccctggccccggccccgcacaccggcagggggcgcccgagcgcagctaaaaggctcggcgggaggtcggcggcctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcaggtacgcgccgcgcccgggcccccgg

SEQ ID NO: 2945 - DNA, 278 bp, Homo sapiens
  misc_feature 1..278: note = chr6:159590971-159591249
  misc_feature 1..278: note = hyper
  source 1..278: mol_type = genomic DNA
cgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgc

SEQ ID NO: 2946 - DNA, 350 bp, Homo sapiens
  misc_feature 1..350: note = chr6:166267542-166267892
  misc_feature 1..350: note = hyper
  source 1..350: mol_type = genomic DNA
ctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtg

SEQ ID NO: 2947 - DNA, 256 bp, Homo sapiens
  misc_feature 1..256: note = chr6:166402395-166402651
  misc_feature 1..256: note = hyper
  source 1..256: mol_type = genomic DNA
ggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcc

SEQ ID NO: 2948 - DNA, 49 bp, Homo sapiens
  misc_feature 1..49: note = chr6:166421943-166421992
  misc_feature 1..49: note = hyper
  source 1..49: mol_type = genomic DNA
aggagcgggtcgcgccgctgacattcgccaaggacaggatggggtgggc

SEQ ID NO: 2949 - DNA, 192 bp, Homo sapiens
  misc_feature 1..192: note = chr6:166421993-166422185
  misc_feature 1..192: note = hyper
  source 1..192: mol_type = genomic DNA
cccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggg

SEQ ID NO: 2950 - DNA, 1231 bp, Homo sapiens; identical to SEQ ID NO: 627
  misc_feature 1..1231: note = chr6:166579715-166580946
  misc_feature 1..1231: note = hyper
  source 1..1231: mol_type = genomic DNA

SEQ ID NO: 2951 - DNA, 1021 bp, Homo sapiens; identical to SEQ ID NO: 628
  misc_feature 1..1021: note = chr6:166581218-166582239
  misc_feature 1..1021: note = hyper
  source 1..1021: mol_type = genomic DNA

SEQ ID NO: 2952 - DNA, 292 bp, Homo sapiens
  misc_feature 1..292: note = chr6:166582505-166582797
  misc_feature 1..292: note = hyper
  source 1..292: mol_type = genomic DNA
caaggcctggctttgcgcttctgcacacctcgcccattcgctggacgagggcctgcctcgggtagcagcctctgtttcccggtctcctgagcgggcaccccagccccaacccctctagagaaagcctgcgcatcgggtggggcagcgagttcagaggagtcttgcgccctagcaagggggctttcccgcggacatggtatctgcgccccgcgctaagtctcccctgccccctgccccctgcccctcgcccctcgcccagccgggctcgctccggggtcgggaattgctgggg

SEQ ID NO: 2953 - DNA, 163 bp, Homo sapiens
  misc_feature 1..163: note = chr7:751986-752149
  misc_feature 1..163: note = hyper
  source 1..163: mol_type = genomic DNA
gcatccccggggggcctcccaggcccggggctcccggcgcagaccccagcccggccccgcgtacctggatgcgcggcgcccgaggccaggaggcggctgcgcggggacgcggggcgcggggacggctggcgagcgagcgagcgggtccccgcactgcagcggc

SEQ ID NO: 2954 - DNA, 112 bp, Homo sapiens
  misc_feature 1..112: note = chr7:752150-752262
  misc_feature 1..112: note = hyper
  source 1..112: mol_type = genomic DNA
ccgccctccacgcccgcccccgcgccgcgcgcagctgctgcacccccaacgccgcccgcgcgggcctgcagcccgtctccccccgaccgcctccccgcggggcccccaaccc

SEQ ID NO: 2955 - DNA, 124 bp, Homo sapiens
  misc_feature 1..124: note = chr7:1408647-1408771
  misc_feature 1..124: note = hyper
  source 1..124: mol_type = genomic DNA
gagaggggaggacagcgagggccccgggcgcggcctctcgtgtgcccccagccgcggggcgcaggcccgcagccccccaggggcgccgcagctgtcactccgcggtgagtggcgccatccggat

SEQ ID NO: 2956 - DNA, 34 bp, Homo sapiens
  misc_feature 1..34: note = chr7:1408874-1408908
  misc_feature 1..34: note = hyper
  source 1..34: mol_type = genomic DNA
cgcggaccccggcccatcccggaccccgcccacc

SEQ ID NO: 2957 - DNA, 34 bp, Homo sapiens
  misc_feature 1..34: note = chr7:4923327-4923361
  misc_feature 1..34: note = hyper
  source 1..34: mol_type = genomic DNA
ggcggcgcaacgggcggggcggggcctcaagggg

SEQ ID NO: 2958 - DNA, 386 bp, Homo sapiens
  misc_feature 1..386: note = chr7:4998201-4998587
  misc_feature 1..386: note = hyper
  source 1..386: mol_type = genomic DNA
gtgcccaagagagaccgagcgtaactgcccgagcgtagctggcctgggctccaggcgctgcgcaaagtgctctgcaaggaccagctcgcttaatcctcacggcgacccaggacacggggactcgcataacccccgttttgcaaacgtggaaatgaggttcagagaagtgaagcgacttgcccaatggcacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccg

SEQ ID NO: 2959 - DNA, 154 bp, Homo sapiens
  misc_feature 1..154: note = chr7:8473139-8473293
  misc_feature 1..154: note = hyper
  source 1..154: mol_type = genomic DNA
cgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctc

SEQ ID NO: 2960 - DNA, 607 bp, Homo sapiens; identical to SEQ ID NO: 629
  misc_feature 1..607: note = chr7:8473635-8474242
  misc_feature 1..607: note = hyper
  source 1..607: mol_type = genomic DNA

SEQ ID NO: 2961 - DNA, 47 bp, Homo sapiens; identical to SEQ ID NO: 630
  misc_feature 1..47: note = chr7:8474515-8474562
  misc_feature 1..47: note = hyper
  source 1..47: mol_type = genomic DNA

SEQ ID NO: 2962 - DNA, 264 bp, Homo sapiens; identical to SEQ ID NO: 631
  misc_feature 1..264: note = chr7:8480763-8481027
  misc_feature 1..264: note = hyper
  source 1..264: mol_type = genomic DNA

SEQ ID NO: 2963 - DNA, 61 bp, Homo sapiens
  misc_feature 1..61: note = chr7:8481642-8481703
  misc_feature 1..61: note = hyper
  source 1..61: mol_type = genomic DNA
cggggtggtggaaagcgagatggcgttgggagccagggcgttgggacggcacaagcagtgg

SEQ ID NO: 2964 - DNA, 282 bp, Homo sapiens
  misc_feature 1..282: note = chr7:8482016-8482298
  misc_feature 1..282: note = hyper
  source 1..282: mol_type = genomic DNA
cctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccc

SEQ ID NO: 2965 - DNA, 156 bp, Homo sapiens
  misc_feature 1..156: note = chr7:8482669-8482825
  misc_feature 1..156: note = hyper
  source 1..156: mol_type = genomic DNA
cgctgccgctccggctgggtccttaaagtcgagttagcactctcggtttccgcagatacctcctcaaggcccgctcgcgactgtgacgacccgcctaccccttccagctattcggggggcagctagctcccgtctctaggtccccagcatgacctg

SEQ ID NO: 2966 - DNA, 139 bp, Homo sapiens
  misc_feature 1..139: note = chr7:8482884-8483023
  misc_feature 1..139: note = hyper
  source 1..139: mol_type = genomic DNA
cgtgatcaccacggagattttgcgaatccttcttttccccaacttctccccctacccagtctcccattctttcacagttcattaaatctacccctcccccgaaacagaaacgtgaaggctgtaacgaagagctagaagt

SEQ ID NO: 2967 - DNA, 596 bp, Homo sapiens; identical to SEQ ID NO: 632
  misc_feature 1..596: note = chr7:8483358-8483954
  misc_feature 1..596: note = hyper
  source 1..596: mol_type = genomic DNA

SEQ ID NO: 2968 - DNA, 37 bp, Homo sapiens; identical to SEQ ID NO: 633
  misc_feature 1..37: note = chr7:19145857-19145894
  misc_feature 1..37: note = hyper
  source 1..37: mol_type = genomic DNA

SEQ ID NO: 2969 - DNA, 154 bp, Homo sapiens; identical to SEQ ID NO: 634
  misc_feature 1..154: note = chr7:19146031-19146185
  misc_feature 1..154: note = hyper
  source 1..154: mol_type = genomic DNA

SEQ ID NO: 2970 - DNA, 345 bp, Homo sapiens; identical to SEQ ID NO: 635
  misc_feature 1..345: note = chr7:19146237-19146582
  misc_feature 1..345: note = hyper
  source 1..345: mol_type = genomic DNA

SEQ ID NO: 2971 - DNA, 932 bp, Homo sapiens; identical to SEQ ID NO: 636
  misc_feature 1..932: note = chr7:19146942-19147874
  misc_feature 1..932: note = hyper
  source 1..932: mol_type = genomic DNA

SEQ ID NO: 2972 - skipped

SEQ ID NO: 2973 - DNA, 340 bp, Homo sapiens; identical to SEQ ID NO: 638
  misc_feature 1..340: note = chr7:19156303-19156643
  misc_feature 1..340: note = hyper
  source 1..340: mol_type = genomic DNA

SEQ ID NO: 2974 - DNA, 43 bp, Homo sapiens; identical to SEQ ID NO: 639
  misc_feature 1..43: note = chr7:19156703-19156746
  misc_feature 1..43: note = hyper
  source 1..43: mol_type = genomic DNA

SEQ ID NO: 2975 - DNA, 138 bp, Homo sapiens; identical to SEQ ID NO: 640
  misc_feature 1..138: note = chr7:19157055-19157193
  misc_feature 1..138: note = hyper
  source 1..138: mol_type = genomic DNA

SEQ ID NO: 2976 - DNA, 69 bp, Homo sapiens; identical to SEQ ID NO: 641
  misc_feature 1..69: note = chr7:19157194-19157263
  misc_feature 1..69: note = hyper
  source 1..69: mol_type = genomic DNA

SEQ ID NO: 2977 - DNA, 303 bp, Homo sapiens; identical to SEQ ID NO: 642
  misc_feature 1..303: note = chr7:19157264-19157567
  misc_feature 1..303: note = hyper
  source 1..303: mol_type = genomic DNA

SEQ ID NO: 2978 - DNA, 302 bp, Homo sapiens; identical to SEQ ID NO: 643
  misc_feature 1..302: note = chr7:19157633-19157935
  misc_feature 1..302: note = hyper
  source 1..302: mol_type = genomic DNA

SEQ ID NO: 2979 - DNA, 268 bp, Homo sapiens
  misc_feature 1..268: note = chr7:19184148-19184416
  misc_feature 1..268: note = hyper
  source 1..268: mol_type = genomic DNA
aaagtctgccatttgcgaggagggttcacttcccacccacccagcccacggaagctcttaggagcagcctgaacggccccgactcagcctcacgctctctgacttccccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctc

SEQ ID NO: 2980 - DNA, 156 bp, Homo sapiens; identical to SEQ ID NO: 644
  misc_feature 1..156: note = chr7:20816291-20816447
  misc_feature 1..156: note = hyper
  source 1..156: mol_type = genomic DNA

SEQ ID NO: 2981 - DNA, 70 bp, Homo sapiens; identical to SEQ ID NO: 645
  misc_feature 1..70: note = chr7:20823261-20823331
  misc_feature 1..70: note = hyper
  source 1..70: mol_type = genomic DNA

SEQ ID NO: 2982 - DNA, 497 bp, Homo sapiens; identical to SEQ ID NO: 646
  misc_feature 1..497: note = chr7:20823382-20823879
  misc_feature 1..497: note = hyper
  source 1..497: mol_type = genomic DNA

SEQ ID NO: 2983 - DNA, 90 bp, Homo sapiens; identical to SEQ ID NO: 647
  misc_feature 1..90: note = chr7:20823919-20824009
  misc_feature 1..90: note = hyper
  source 1..90: mol_type = genomic DNA

SEQ ID NO: 2984 - DNA, 275 bp, Homo sapiens
  misc_feature 1..275: note = chr7:20824475-20824750
  misc_feature 1..275: note = hyper
  source 1..275: mol_type = genomic DNA
cgcgccggccagcggcgacggggccgagtccgggtaggagccgggtagcactggcttgaagccgtccatgaggtgctgcccggcggggctgagcaggtgcgaggaggcgccgctgctgaaggccgagtgactcaggcccgagtaatccgagttgtagcctccgagcggcgagtgcagcgaggtttggagccccccggcggcagggtgcagcgagccgggcagcgcagccgcgctgttcgggttctgcacgtcgatccagccggcccccacgtccc

SEQ ID NO: 2985 - DNA, 545 bp, Homo sapiens; identical to SEQ ID NO: 648
  misc_feature 1..545: note = chr7:22589325-22589870
  misc_feature 1..545: note = hyper
  source 1..545: mol_type = genomic DNA

SEQ ID NO: 2986 - DNA, 98 bp, Homo sapiens
  misc_feature 1..98: note = chr7:23287253-23287351
  misc_feature 1..98: note = hyper
  source 1..98: mol_type = genomic DNA
ctgggcctgggattgcggggacgggacgggtgggaagcggccaaaggcgcagcggcttctggtcagagccgcagaggcctgagacgtgggccgcgccc

SEQ ID NO: 2987 - DNA, 92 bp, Homo sapiens
  misc_feature 1..92: note = chr7:23287532-23287624
  misc_feature 1..92: note = hyper
  source 1..92: mol_type = genomic DNA
ggcactgtgatggtcccgcttcccacacgaggccacgggccacagagtgggcaaggaactcgccccaagccacacagcgggtaagttgagga

SEQ ID NO: 2988 - DNA, 159 bp, Homo sapiens; identical to SEQ ID NO: 649
  misc_feature 1..159: note = chr7:25896441-25896600
  misc_feature 1..159: note = hyper
  source 1..159: mol_type = genomic DNA

SEQ ID NO: 2989 - DNA, 278 bp, Homo sapiens; identical to SEQ ID NO: 650
  misc_feature 1..278: note = chr7:25896660-25896938
  misc_feature 1..278: note = hyper
  source 1..278: mol_type = genomic DNA

SEQ ID NO: 2990 - DNA, 505 bp, Homo sapiens; identical to SEQ ID NO: 651
  misc_feature 1..505: note = chr7:27135266-27135771
  misc_feature 1..505: note = hyper
  source 1..505: mol_type = genomic DNA

SEQ ID NO: 2991 - DNA, 445 bp, Homo sapiens; identical to SEQ ID NO: 652
  misc_feature 1..445: note = chr7:27135979-27136424
  misc_feature 1..445: note = hyper
  source 1..445: mol_type = genomic DNA

SEQ ID NO: 2992 - DNA, 324 bp, Homo sapiens; identical to SEQ ID NO: 653
  misc_feature 1..324: note = chr7:27136425-27136749
  misc_feature 1..324: note = hyper
  source 1..324: mol_type = genomic DNA

SEQ ID NO: 2993 - DNA, 699 bp, Homo sapiens; identical to SEQ ID NO: 654
  misc_feature 1..699: note = chr7:27190372-27191071
  misc_feature 1..699: note = hyper
  source 1..699: mol_type = genomic DNA

SEQ ID NO: 2994 - DNA, 16 bp, Homo sapiens
  misc_feature 1..16: note = chr7:27195586-27195602
  misc_feature 1..16: note = hyper
  source 1..16: mol_type = genomic DNA
atgctatgggctccac

SEQ ID NO: 2995 - DNA, 27 bp, Homo sapiens
  misc_feature 1..27: note = chr7:27195866-27195893
  misc_feature 1..27: note = hyper
  source 1..27: mol_type = genomic DNA
cgcctttggcgaggtcactgcagagcc

SEQ ID NO: 2996 - skipped

SEQ ID NO: 2997 - DNA, 132 bp, Homo sapiens; identical to SEQ ID NO: 658
  misc_feature 1..132: note = chr7:27196154-27196286
  misc_feature 1..132: note = hyper
  source 1..132: mol_type = genomic DNA

SEQ ID NO: 2998 - DNA, 351 bp, Homo sapiens; identical to SEQ ID NO: 659
  misc_feature 1..351: note = chr7:27196287-27196638
  misc_feature 1..351: note = hyper
  source 1..351: mol_type = genomic DNA

SEQ ID NO: 2999 - DNA, 324 bp, Homo sapiens; identical to SEQ ID NO: 660
  misc_feature 1..324: note = chr7:27212660-27212984
  misc_feature 1..324: note = hyper
  source 1..324: mol_type = genomic DNA

SEQ ID NO: 3000 - DNA, 796 bp, Homo sapiens; identical to SEQ ID NO: 661
  misc_feature 1..796: note = chr7:27213188-27213984
  misc_feature 1..796: note = hyper
  source 1..796: mol_type = genomic DNA

SEQ ID NO: 3001 - DNA, 277 bp, Homo sapiens; identical to SEQ ID NO: 662
  misc_feature 1..277: note = chr7:27213985-27214262
  misc_feature 1..277: note = hyper
  source 1..277: mol_type = genomic DNA

SEQ ID NO: 3002 - DNA, 633 bp, Homo sapiens
  misc_feature 1..633: note = chr7:27223976-27224609
  misc_feature 1..633: note = hyper
  source 1..633: mol_type = genomic DNA
ataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggg

SEQ ID NO: 3003 - DNA, 680 bp, Homo sapiens
  misc_feature 1..680: note = chr7:27232300-27232980
  misc_feature 1..680: note = hyper
  source 1..680: mol_type = genomic DNA
ggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccgcagccccgactggcccgcgtgccgtcagagggaggcccgctttacaccggcctgagcctccattttgagtagggggttcttgtagaagcgtggagggtttggggccgcgcctctgtccccgaggggcgcgacatcaggtagctctccgagttcacacccca

SEQ ID NO: 3004 - DNA, 378 bp, Homo sapiens; identical to SEQ ID NO: 663
  misc_feature 1..378: note = chr7:27244932-27245310
  misc_feature 1..378: note = hyper
  source 1..378: mol_type = genomic DNA

SEQ ID NO: 3005 - DNA, 437 bp, Homo sapiens; identical to SEQ ID NO: 664
  misc_feature 1..437: note = chr7:27264875-27265312
  misc_feature 1..437: note = hyper
  source 1..437: mol_type = genomic DNA

SEQ ID NO: 3006 - DNA, 46 bp, Homo sapiens
  misc_feature 1..46: note = chr7:27265538-27265584
  misc_feature 1..46: note = hyper
  source 1..46: mol_type = genomic DNA
aaatgcagaggaagccggggacactgaagcccgggtggttgcagtg

SEQ ID NO: 3007 - DNA, 132 bp, Homo sapiens; identical to SEQ ID NO: 665
  misc_feature 1..132: note = chr7:27279237-27279369
  misc_feature 1..132: note = hyper
  source 1..132: mol_type = genomic DNA

SEQ ID NO: 3008 - DNA, 18 bp, Homo sapiens
  misc_feature 1..18: note = chr7:27279453-27279471
  misc_feature 1..18: note = hyper
  source 1..18: mol_type = genomic DNA
cgccgggcctggagcggc

SEQ ID NO: 3009 - DNA, 118 bp, Homo sapiens
  misc_feature 1..118: note = chr7:27285707-27285825
  misc_feature 1..118: note = hyper
  source 1..118: mol_type = genomic DNA
cgcctcgcccttcagcggctcgctgcgcccgctcgacacgttccgcgtgctgtcgcagccctacccgcggcccgaactgctgtgcgccttccgccacccgccgctctaccccgggccc

SEQ ID NO: 3010 - DNA, 173 bp, Homo sapiens; identical to SEQ ID NO: 667
  misc_feature 1..173: note = chr7:27290946-27291119
  misc_feature 1..173: note = hyper
  source 1..173: mol_type = genomic DNA

SEQ ID NO: 3011 - DNA, 537 bp, Homo sapiens; identical to SEQ ID NO: 668
  misc_feature 1..537: note = chr7:27291314-27291851
  misc_feature 1..537: note = hyper
  source 1..537: mol_type = genomic DNA

SEQ ID NO: 3012 - DNA, 38 bp, Homo sapiens
  misc_feature 1..38: note = chr7:28449253-28449291
  misc_feature 1..38: note = hyper
  source 1..38: mol_type = genomic DNA
ttgtaaacattttggcggaccagagggaagtccggccc

SEQ ID NO: 3013 - DNA, 124 bp, Homo sapiens
  misc_feature 1..124: note = chr7:28449658-28449782
  misc_feature 1..124: note = hyper
  source 1..124: mol_type = genomic DNA
cgaggacgccgggtcacctagggggcgggtgggcgcgcgcgcagggggctcgctctccccggtgcggagctgcagctgccacctctcccgccgggctgccggctgcagcgggtgggcgcgcgcc

SEQ ID NO: 3014 - DNA, 184 bp, Homo sapiens
  misc_feature 1..184: note = chr7:28449857-28450041
  misc_feature 1..184: note = hyper
  source 1..184: mol_type = genomic DNA
cgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcggcagaatcacttg

SEQ ID NO: 3015 - DNA, 332 bp, Homo sapiens
  misc_feature 1..332: note = chr7:29185865-29186197
  misc_feature 1..332: note = hyper
  source 1..332: mol_type = genomic DNA
atttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctc

SEQ ID NO: 3016 - DNA, 476 bp, Homo sapiens; identical to SEQ ID NO: 669
  misc_feature 1..476: note = chr7:30721202-30721678
  misc_feature 1..476: note = hyper
  source 1..476: mol_type = genomic DNA

SEQ ID NO: 3017 - DNA, 89 bp, Homo sapiens
  misc_feature 1..89: note = chr7:32110706-32110795
  misc_feature 1..89: note = hyper
  source 1..89: mol_type = genomic DNA
cgtctgccgggcacacgctgggctccgaccccggccgggcacactcacccccgcagggcagccgcggccaccaccgacctgcggagctg

SEQ ID NO: 3018 - DNA, 73 bp, Homo sapiens
  misc_feature 1..73: note = chr7:32338145-32338218
  misc_feature 1..73: note = hyper
  source 1..73: mol_type = genomic DNA
cctccggccccagcccgacccctgagctccccctgcccgcttagaaaggaactctgaccgccaccggagaggg

SEQ ID NO: 3019 - DNA, 305 bp, Homo sapiens
  misc_feature 1..305: note = chr7:32338283-32338588
  misc_feature 1..305: note = hyper
  source 1..305: mol_type = genomic DNA
cgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctc

SEQ ID NO: 3020 - DNA, 237 bp, Homo sapiens; identical to SEQ ID NO: 670
  misc_feature 1..237: note = chr7:32467419-32467656
  misc_feature 1..237: note = hyper
  source 1..237: mol_type = genomic DNA

SEQ ID NO: 3021 - DNA, 69 bp, Homo sapiens; identical to SEQ ID NO: 671
  misc_feature 1..69: note = chr7:32467946-32468015
  misc_feature 1..69: note = hyper
  source 1..69: mol_type = genomic DNA

SEQ ID NO: 3022 - DNA, 266 bp, Homo sapiens; identical to SEQ ID NO: 672
  misc_feature 1..266: note = chr7:33943692-33943958
  misc_feature 1..266: note = hyper
  source 1..266: mol_type = genomic DNA

SEQ ID NO: 3023 - DNA, 554 bp, Homo sapiens
  misc_feature 1..554: note = chr7:35225280-35225834
  misc_feature 1..554: note = hyper
  source 1..554: mol_type = genomic DNA
aagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgtt

SEQ ID NO: 3024 - DNA, 420 bp, Homo sapiens
  misc_feature 1..420: note = chr7:35226044-35226464
  misc_feature 1..420: note = hyper
  source 1..420: mol_type = genomic DNA
cgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcc

SEQ ID NO: 3025 - DNA, 296 bp, Homo sapiens; identical to SEQ ID NO: 673
  misc_feature 1..296: note = chr7:35293182-35293478
  misc_feature 1..296: note = hyper
  source 1..296: mol_type = genomic DNA

SEQ ID NO: 3026 - DNA, 110 bp, Homo sapiens; identical to SEQ ID NO: 674
  misc_feature 1..110: note = chr7:35294031-35294141
  misc_feature 1..110: note = hyper
  source 1..110: mol_type = genomic DNA

SEQ ID NO: 3027 - DNA, 73 bp, Homo sapiens
  misc_feature 1..73: note = chr7:35294502-35294575
  misc_feature 1..73: note = hyper
  source 1..73: mol_type = genomic DNA
cgaaccttatggtagcgcccggactaagcggacacagacccctctggttttacaaaggcggctgtgacgagga

SEQ ID NO: 3028 - DNA, 53 bp, Homo sapiens; identical to SEQ ID NO: 675
  misc_feature 1..53: note = chr7:35296952-35297005
  misc_feature 1..53: note = hyper
  source 1..53: mol_type = genomic DNA

SEQ ID NO: 3029 - DNA, 217 bp, Homo sapiens; identical to SEQ ID NO: 676
  misc_feature 1..217: note = chr7:35297137-35297354
  misc_feature 1..217: note = hyper
  source 1..217: mol_type = genomic DNA

SEQ ID NO: 3030 - DNA, 547 bp, Homo sapiens; identical to SEQ ID NO: 677
  misc_feature 1..547: note = chr7:35297470-35298017
  misc_feature 1..547: note = hyper
  source 1..547: mol_type = genomic DNA

SEQ ID NO: 3031 - DNA, 500 bp, Homo sapiens; identical to SEQ ID NO: 678
  misc_feature 1..500: note = chr7:35301244-35301744
  misc_feature 1..500: note = hyper
  source 1..500: mol_type = genomic DNA

SEQ ID NO: 3032 - DNA, 147 bp, Homo sapiens; identical to SEQ ID NO: 679
  misc_feature 1..147: note = chr7:37487113-37487260
  misc_feature 1..147: note = hyper
  source 1..147: mol_type = genomic DNA

SEQ ID NO: 3033 - DNA, 74 bp, Homo sapiens; identical to SEQ ID NO: 680
  misc_feature 1..74: note = chr7:37487380-37487454
  misc_feature 1..74: note = hyper
  source 1..74: mol_type = genomic DNA

SEQ ID NO: 3034 - DNA, 71 bp, Homo sapiens; identical to SEQ ID NO: 681
  misc_feature 1..71: note = chr7:37487755-37487826
  misc_feature 1..71: note = hyper
  source 1..71: mol_type = genomic DNA

SEQ ID NO: 3035 - DNA, 878 bp, Homo sapiens
  misc_feature 1..878: note = chr7:37488141-37489019
  misc_feature 1..878: note = hyper
  source 1..878: mol_type = genomic DNA
aaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacc

SEQ ID NO: 3036 - DNA, 268 bp, Homo sapiens; identical to SEQ ID NO: 682
  misc_feature 1..268: note = chr7:38670396-38670664
  misc_feature 1..268: note = hyper
  source 1..268: mol_type = genomic DNA

SEQ ID NO: 3037 - DNA, 15 bp, Homo sapiens
  misc_feature 1..15: note = chr7:43152193-43152208
  misc_feature 1..15: note = hyper
  source 1..15: mol_type = genomic DNA
gggaggggatgcaag

SEQ ID NO: 3038 - DNA, 502 bp, Homo sapiens
  misc_feature 1..502: note = chr7:43152413-43152915
  misc_feature 1..502: note = hyper
  source 1..502: mol_type = genomic DNA
cgccagggtcccctccccagccagtcccaggcgcccggtgcactatgcggggcacgtgcgccccccagctctaatctgcgcgctgacaggagcatgatctgtgcccaggccagggctgccaaggtaagcgggcgtagcgcggggacactgtctgccgccccttcccccccgcccttctctgggcggcttccccgccgcacgcgaggccccggcagcgccctcccttctcggggccgagatccaccctcctccccaccctctcgcttctcccgcgaggttcaattgtcagcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcc

SEQ ID NO: 3039 - DNA, 279 bp, Homo sapiens
  misc_feature 1..279: note = chr7:45613535-45613814
  misc_feature 1..279: note = hyper
  source 1..279: mol_type = genomic DNA
ccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccgg

SEQ ID NO: 3040 - DNA, 880 bp, Homo sapiens
  misc_feature 1..880: note = chr7:45613857-45614737
  misc_feature 1..880: note = hyper
  source 1..880: mol_type = genomic DNA
cgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtca

SEQ ID NO: 3041 - DNA, 198 bp, Homo sapiens; identical to SEQ ID NO: 683
  misc_feature 1..198: note = chr7:49812820-49813018
  misc_feature 1..198: note = hyper
  source 1..198: mol_type = genomic DNA

SEQ ID NO: 3042 - DNA, 197 bp, Homo sapiens; identical to SEQ ID NO: 684
  misc_feature 1..197: note = chr7:49813809-49814006
  misc_feature 1..197: note = hyper
  source 1..197: mol_type = genomic DNA

SEQ ID NO: 3043 - DNA, 134 bp, Homo sapiens; identical to SEQ ID NO: 685
  misc_feature 1..134: note = chr7:49815116-49815250
  misc_feature 1..134: note = hyper
  source 1..134: mol_type = genomic DNA

SEQ ID NO: 3044 - DNA, 109 bp, Homo sapiens; identical to SEQ ID NO: 686
  misc_feature 1..109: note = chr7:49815656-49815765
  misc_feature 1..109: note = hyper
  source 1..109: mol_type = genomic DNA

SEQ ID NO: 3045 - DNA, 256 bp, Homo sapiens
  misc_feature 1..256: note = chr7:50343234-50343490
  misc_feature 1..256: note = hyper
  source 1..256: mol_type = genomic DNA
gccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttac

SEQ ID NO: 3046 - DNA, 320 bp, Homo sapiens
  misc_feature 1..320: note = chr7:50343974-50344294
  misc_feature 1..320: note = hyper
  source 1..320: mol_type = genomic DNA
ggctgcggggcaggtcgagcagggaccgccagcgtgcgtcaccccaaagtttgcggggtggcagggcgcgcgctctggccacccgccgctctgggcggcagctggtggcaacgcaagggcgcggcgggggcggccggcgcggagggggccaggtacggggcccgcgggcggcgctgtgcgcgcggggcagccggtcggccgggagcgcgaaagcctggtctgagccggctgggggcggggagtgtggcggagaaatggggaacaatgcgagtgagcaacttcaggaagtcattgtgaaagaaagctgggaagagctccgc

SEQ ID NO: 3047 - DNA, 36 bp, Homo sapiens
  misc_feature 1..36: note = chr7:50344295-50344331
  misc_feature 1..36: note = hyper
  source 1..36: mol_type = genomic DNA
gccaagttagcaggacactctaacaagtgactgcgc

SEQ ID NO: 3048 - DNA, 406 bp, Homo sapiens
  misc_feature 1..406: note = chr7:50344332-50344738
  misc_feature 1..406: note = hyper
  source 1..406: mol_type = genomic DNA
gcccgcgcccggggcggtgactgcggcaagccccctgggtccccgcgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacactt

SEQ ID NO: 3049 - DNA, 289 bp, Homo sapiens
  misc_feature 1..289: note = chr7:54612441-54612730
  misc_feature 1..289: note = hyper
  source 1..289: mol_type = genomic DNA
ggaggacctggatcccggggccgagggggccggcgcgcaggtagcggagcccgccgaccccgcgtctccccttcgctcgcccggtcctcagggtgtccggcccggggctgggggccgaggtgctgcctggacacccctggggacctgcccggttctgtggaagcgagtgacccccagggcttctagggagggaaagggaatttgtcctggggacgcgaagttaaaacccagaaggaagtcctgctgcccagtttcttcctgttaaaccgggaagcgcctcctcctgtaa

SEQ ID NO: 3050 - DNA, 180 bp, Homo sapiens
  misc_feature 1..180: note = chr7:64974270-64974450
  misc_feature 1..180: note = hyper
  source 1..180: mol_type = genomic DNA
cgggggctaaaagccgcaaaaagccgcggaggggggagcgaaaagcagtgggagctggggcaaaaaaccacaaaaagccgaggcagcggcggcagaaaacctcggcagcgggggcaaaaagctgcagcggcaaaaagcggcgacgggggcaaaaagccgcggtggcaaaaatgcgcggcg

SEQ ID NO: 3051 - DNA, 480 bp, Homo sapiens
  misc_feature 1..480: note = chr7:64974510-64974990
  misc_feature 1..480: note = hyper
  source 1..480: mol_type = genomic DNA
cacaaaaagccgcggcagcggcggcagaaaacctcggcagcgggggcaaaaagccacggtggcgggggtaaaaagcagcggtggcaagaagccgcgacggtgggggcaagaagccgcggcggcccaggcaaaaggccgcaaaagccgcggcgacgggggcgaaaagccgcggcggcggaggcaaaaagccgcgacggcagggggcaaaaagctgcaaaagcctcggtgcgggtgaaaaaagtcgcggcgagaaaaagccgctgaggcgggggcaaaaagccgcggcggcaggggcgaaaaccagcaaaaagccgccgcggtgggggcaaaaagcagtgggagctggggtaaaaaaccacaaaaaaccgcggcagcggcggcagcaagccacggcggcgggggcaaaaagccgcggcggcaaaaacccggggtggcaaaaagccgcggcgccgggggacgaaaagcttcaaaggccgcttc

SEQ ID NO: 3052 - DNA, 235 bp, Homo sapiens
  misc_feature 1..235: note = chr7:70596453-70596688
  misc_feature 1..235: note = hyper
  source 1..235: mol_type = genomic DNA
cgcggtccccactctccagaagcccccgccctgcccgggtgcgcgcgcgcacgagtcggcgaaccggggagctgtgcgctcggcagcctgcgggcggcggcggcggccgccgacagcctctcggggacagggtggcgaagagcggcggaggaggagctggcgccgccgccgctcccctcgggccgcgccccgccctccgccgccacctgcgcgtcccctccgggctcctcagctc

SEQ ID NO: 3053 - DNA, 126 bp, Homo sapiens
  misc_feature 1..126: note = chr7:71800631-71800757
  misc_feature 1..126: note = hyper
  source 1..126: mol_type = genomic DNA
gggaactgcaggcaccgcttcacccaggagctacgggcttcgacccaaatggaagaaaggcgccttcctcacacaagcctcgtccaagaaaaaagagcagtgggaaacgatggtgggctggtggcc

SEQ ID NO: 3054 - DNA, 40 bp, Homo sapiens
  misc_feature 1..40: note = chr7:71800933-71800973
  misc_feature 1..40: note = hyper
  source 1..40: mol_type = genomic DNA
cgctagtccggagaaactaggaacccgagtaaacccagac

SEQ ID NO: 3055 - DNA, 72 bp, Homo sapiens; identical to SEQ ID NO: 687
  misc_feature 1..72: note = chr7:71802451-71802523
  misc_feature 1..72: note = hyper
  source 1..72: mol_type = genomic DNA

SEQ ID NO: 3056 - DNA, 95 bp, Homo sapiens; identical to SEQ ID NO: 688
  misc_feature 1..95: note = chr7:71802577-71802672
  misc_feature 1..95: note = hyper
  source 1..95: mol_type = genomic DNA

SEQ ID NO: 3057 - DNA, 644 bp, Homo sapiens; identical to SEQ ID NO: 689
  misc_feature 1..644: note = chr7:79083190-79083834
  misc_feature 1..644: note = hyper
  source 1..644: mol_type = genomic DNA

SEQ ID NO: 3058 - DNA, 510 bp, Homo sapiens
  misc_feature 1..510: note = chr7:86273208-86273718
  misc_feature 1..510: note = hyper
  source 1..510: mol_type = genomic DNA
ccctctccaggggctcgcagtgtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgac

SEQ ID NO: 3059 - DNA, 13 bp, Homo sapiens
  misc_feature 1..13: note = chr7:86273719-86273732
  misc_feature 1..13: note = hyper
  source 1..13: mol_type = genomic DNA
gcttcagcctggt

SEQ ID NO: 3060 - DNA, 335 bp, Homo sapiens; identical to SEQ ID NO: 690
  misc_feature 1..335: note = chr7:87229568-87229903
  misc_feature 1..335: note = hyper
  source 1..335: mol_type = genomic DNA

SEQ ID NO: 3061 - DNA, 131 bp, Homo sapiens
  misc_feature 1..131: note = chr7:87230213-87230344
  misc_feature 1..131: note = hyper
  source 1..131: mol_type = genomic DNA
ctgtggcaaagagagcgaagcggctgtgctcagcccacgccccggcgctgttcctgcccagccaatcagcctcaccacagatgactgctcccggcccggattgactgaatgctgattcctcgagaaactgc

SEQ ID NO: 3062 - DNA, 178 bp, Homo sapiens
  misc_feature 1..178: note = chr7:87230345-87230523
  misc_feature 1..178: note = hyper
  source 1..178: mol_type = genomic DNA
aaacaggttgaatttccaggaggaatgttctggcttccgttgcacctctctagaaagggcaagtagagaaacgcgcatcagctgaatcattggggacatttcaacttatgtagacacgtctttcaaagttcacataagtcttcatatccatataactacaggacgtagttaagggaaa

SEQ ID NO: 3063 - DNA, 40 bp, Homo sapiens
  misc_feature 1..40: note = chr7:88388606-88388646
  misc_feature 1..40: note = hyper
  source 1..40: mol_type = genomic DNA
cctcctgggcagccccgagcccacagctcccagcagaggc

SEQ ID NO: 3064 - DNA, 255 bp, Homo sapiens
  misc_feature 1..255: note = chr7:88388647-88388902
  misc_feature 1..255: note = hyper
  source 1..255: mol_type = genomic DNA
ctaactgccctcctcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcagg

SEQ ID NO: 3065 - DNA, 207 bp, Homo sapiens
  misc_feature 1..207: note = chr7:88389046-88389253
  misc_feature 1..207: note = hyper
  source 1..207: mol_type = genomic DNA
cgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctgg

SEQ ID NO: 3066 - DNA, 467 bp, Homo sapiens
  misc_feature 1..467: note = chr7:89950183-89950650
  misc_feature 1..467: note = hyper
  source 1..467: mol_type = genomic DNA
tcaatttcaggctagcgcctctccctgtgcccccagccctgggtcaggtcacctgggcgcagaagagggaggccacgcgggagtcgaggacctctggtcgccgtccgaggagcgcgtcccggcgcggtgtcctgggtgcgctacgctcgttgggaggaggacggggcgcctcctgcccacgaggaaccagaggtttcagcggggacgacccctgcccagggcgccctctgcccagcggacccacttcccgaggcaggcgaactgggcgaggcagcgctgtgtcacccaccccgagcgctcaccgggcgcccaagctcgctcagcggaaccgtctcggccgcggtgcgcttcggcgctgggaggctctggctggcactggctcaccgcgggtggagctgccggttctgctgcggccacgcggggttcccgagacagacccgccgctgggaccgcgatccttttctaga

SEQ ID NO: 3067 - DNA, 402 bp, Homo sapiens
  misc_feature 1..402: note = chr7:94284694-94285096
  misc_feature 1..402: note = hyper
  source 1..402: mol_type = genomic DNA
agcatttcatgattccgcttccctgctccgtaaaaccgaagaaaaccgagatttccgtcaccgagaaatgcacttagcaagagggggaaattcggtgttttaaatgtcacatttttgtgttctctaccactatcaagaaaaggaaaaaagatgtgtttgtgtagcggggacgcagcttgacacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaa

SEQ ID NO: 3068 - DNA, 96 bp, Homo sapiens; identical to SEQ ID NO: 691
  misc_feature 1..96: note = chr7:96621715-96621811
  misc_feature 1..96: note = hyper
  source 1..96: mol_type = genomic DNA

SEQ ID NO: 3069 - DNA, 180 bp, Homo sapiens
  misc_feature 1..180: note = chr7:96622169-96622349
  misc_feature 1..180: note = hyper
  source 1..180: mol_type = genomic DNA
acttctgcatgaaaccgaaacggccagggaggggcggagtgggccgaggctgagggagcggcggtgttgacgccctcttcccacccaggatcgatcgatcggtagggaattttttatctttgggaaggagaggtgaggaagcggacctaaaacgaggggaaaattcgaatttaatatcct

SEQ ID NO: 3070 - DNA, 112 bp, Homo sapiens
  misc_feature 1..112: note = chr7:96625974-96626086
  misc_feature 1..112: note = hyper
  source 1..112: mol_type = genomic DNA
gagcctgacaggtcccgggtcccaggtcccaggcagccccggccggggcagggccaagaccgcgtgcccaggacaagtaagtaactcaaacccgacccggcaagcgtggccc

SEQ ID NO: 3071 - DNA, 340 bp, Homo sapiens; identical to SEQ ID NO: 692
  misc_feature 1..340: note = chr7:96636033-96636373
  misc_feature 1..340: note = hyper
  source 1..340: mol_type = genomic DNA

SEQ ID NO: 3072 - DNA, 65 bp, Homo sapiens
  misc_feature 1..65: note = chr7:96636595-96636660
  misc_feature 1..65: note = hyper
  source 1..65: mol_type = genomic DNA
cgggcacaggggccccgctccgcccggacagctgccgccttgctgcgctgcgcaccccagagagc

SEQ ID NO: 3073 - DNA, 370 bp, Homo sapiens
  misc_feature 1..370: note = chr7:96647849-96648219
  misc_feature 1..370: note = hyper
  source 1..370: mol_type = genomic DNA
ctggcacaccgcgggcgcgggtttctcccagtcggagtcgccagaaataaagcgctagctctcggtgtaatggaaactcccgaaatccttacaagcaaagaaagaaaagcaggaagtggatatcttcatctcttccccaatccccctattctctgtgagcgcagaaaacaaaatggggcaccctttggcttcccgcccccccccccgccccccgcaaaccttcctattgccccctcttccccgcacccagtgctccttccgagaaagtacggctggagcggactggggagacggaaatattgagtcgcggccgctgggggtgccggaggaggggtgcacaggccaggctgccgggcgtagttctgcctcg

SEQ ID NO: 3074 - DNA, 240 bp, Homo sapiens; identical to SEQ ID NO: 693
  misc_feature 1..240: note = chr7:96653580-96653820
  misc_feature 1..240: note = hyper
  source 1..240: mol_type = genomic DNA

SEQ ID NO: 3075 - DNA, 131 bp, Homo sapiens; identical to SEQ ID NO: 694
  misc_feature 1..131: note = chr7:96653862-96653993
  misc_feature 1..131: note = hyper
  source 1..131: mol_type = genomic DNA

SEQ ID NO: 3076 - DNA, 63 bp, Homo sapiens
  misc_feature 1..63: note = chr7:97361360-97361423
  misc_feature 1..63: note = hyper
  source 1..63: mol_type = genomic DNA
ggctgggataaataccgcaaggcactgagcaggcgaaagagcgcgctcggacctccttcccgg

SEQ ID NO: 3077 - DNA, 507 bp, Homo sapiens
  misc_feature 1..507: note = chr7:97362198-97362705
  misc_feature 1..507: note = hyper
  source 1..507: mol_type = genomic DNA
ttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagcc

SEQ ID NO: 3078 - DNA, 222 bp, Homo sapiens
  misc_feature 1..222: note = chr7:97362706-97362928
  misc_feature 1..222: note = hyper
  source 1..222: mol_type = genomic DNA
gcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgc

SEQ ID NO: 3079 - DNA, 223 bp, Homo sapiens; identical to SEQ ID NO: 695
  misc_feature 1..223: note = chr7:98245856-98246079
  misc_feature 1..223: note = hyper
  source 1..223: mol_type = genomic DNA

SEQ ID NO: 3080 - DNA, 204 bp, Homo sapiens; identical to SEQ ID NO: 696
  misc_feature 1..204: note = chr7:98246304-98246508
  misc_feature 1..204: note = hyper
  source 1..204: mol_type = genomic DNA

SEQ ID NO: 3081 - DNA, 1085 bp, Homo sapiens; identical to SEQ ID NO: 697
  misc_feature 1..1085: note = chr7:98246533-98247618
  misc_feature 1..1085: note = hyper
  source 1..1085: mol_type = genomic DNA

SEQ ID NO: 3082 - DNA, 390 bp, Homo sapiens
  misc_feature 1..390: note = chr7:103085842-103086232
  misc_feature 1..390: note = hyper
  source 1..390: mol_type = genomic DNA
gcttcgagagttcagcgtgtcagagcctctatgatggcagagcacctgccgcgatgcctgattggtagggagaaggatttcccgggagggggccaataccaaattttagggctgttaggctctgagcagtcccttcgtgaccggataagtcagagacccggggtttgagccttgcccggcgctgagcggagggcccagtttcgggaccacagccttgctccctgggagctccgggcggccaatgccgggcaagcccagcccggcacaggaggaggcagggcccgtctccggaaagagggccagaggcagaactgagggcctggttttgtgtaattcgatttggatacaaacaggccagacccaaactggaaacggcgaagggctggatta

SEQ ID NO: 3083 - DNA, 554 bp, Homo sapiens
  misc_feature 1..554: note = chr7:103629059-103629613
  misc_feature 1..554: note = hyper
  source 1..554: mol_type = genomic DNA
ctggctggtgagcagcgggaactttgcggtcgagcggcgcggggcagccacagacctgggcgcttcaatctgtcaccagcctgcccgcaaagcccagcgacagcccccaacgcccccccggggacccatctggggggaccgggagcaggacaaaggtctgaaatccaagtcctaggagtaaagaaacaaaatgcgcaggttcaatttaaagtgcctgcggtaagtacggggagtgagggggaaagacaccggcctccaagaattctcaggcgtttagcacaagcaccagctcattaccaggagatgcgttcggggagtggggacatggagaatgaatcccaacttgtgactccattctccactaactttattctcgctccctggaccaagcgcatcgctggggccagggttgtcatggttcttgtttccaaggccccttggaagaaggaaagggatgagaaaggtgcgctggcgggcgcacccggcggcggcgagcgcggaggtgctgcggtacctaccatggtattcttgtcccggaacgtagtaggtggggt

SEQ ID NO: 3084 - DNA, 251 bp, Homo sapiens
  misc_feature 1..251: note = chr7:103968915-103969166
  misc_feature 1..251: note = hyper
  source 1..251: mol_type = genomic DNA
cgccttcagctgcagcagctgcagcggcggcggcgggaagaggggtggagggtggtgaggagggccggagcccgggccaggagggagggaggggagccgggaggctgtgccaggcgagccggaggggtgctccgcgctcccccgccctccttccgggagcgaggatgcagactctgaaactggtgctgctgggctgaggcggaggcaggggagttgcagcgcgcgaggctccgtgagtgtgtctcctgcgc

SEQ ID NO: 3085 - DNA, 355 bp, Homo sapiens
  misc_feature 1..355: note = chr7:103969167-103969522
  misc_feature 1..355: note = hyper
  source 1..355: mol_type = genomic DNA
ctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctcca

SEQ ID NO: 3086 - DNA, 15 bp, Homo sapiens
  misc_feature 1..15: note = chr7:103969562-103969577
  misc_feature 1..15: note = hyper
  source 1..15: mol_type = genomic DNA
cggcctctccatgat

SEQ ID NO: 3087 - DNA, 766 bp, Homo sapiens
  misc_feature 1..766: note = chr7:107301015-107301781
  misc_feature 1..766: note = hyper
  source 1..766: mol_type = genomic DNA
ccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtgcggggagggagggaatctcagtgtccccttccagccttgcaagcgcctttggcccctgccccagcccctcggtttgggggagatttcagaacgcggacagcgccctggctgcgggccataggggac

SEQ ID NO: 3088 - DNA, 302 bp, Homo sapiens; identical to SEQ ID NO: 698
  misc_feature 1..302: note = chr7:108097189-108097491
  misc_feature 1..302: note = hyper
  source 1..302: mol_type = genomic DNA

SEQ ID NO: 3089 - DNA, 503 bp, Homo sapiens; identical to SEQ ID NO: 699
  misc_feature 1..503: note = chr7:116962644-116963147
  misc_feature 1..503: note = hyper
  source 1..503: mol_type = genomic DNA

SEQ ID NO: 3090 - DNA, 68 bp, Homo sapiens; identical to SEQ ID NO: 700
  misc_feature 1..68: note = chr7:116963330-116963398
  misc_feature 1..68: note = hyper
  source 1..68: mol_type = genomic DNA

SEQ ID NO: 3091 - DNA, 392 bp, Homo sapiens; identical to SEQ ID NO: 701
  misc_feature 1..392: note = chr7:117119505-117119897
  misc_feature 1..392: note = hyper
  source 1..392: mol_type = genomic DNA

SEQ ID NO: 3092 - DNA, 254 bp, Homo sapiens; identical to SEQ ID NO: 702
  misc_feature 1..254: note = chr7:121939991-121940245
  misc_feature 1..254: note = hyper
  source 1..254: mol_type = genomic DNA

SEQ ID NO: 3093 - DNA, 25 bp, Homo sapiens
  misc_feature 1..25: note = chr7:121940433-121940458
  misc_feature 1..25: note = hyper
  source 1..25: mol_type = genomic DNA
cggtgtggaccgatggtggattctc

SEQ ID NO: 3094 - DNA, 306 bp, Homo sapiens; identical to SEQ ID NO: 704
  misc_feature 1..306: note = chr7:121941881-121942187
  misc_feature 1..306: note = hyper
  source 1..306: mol_type = genomic DNA

SEQ ID NO: 3095 - DNA, 15 bp, Homo sapiens
  misc_feature 1..15: note = chr7:121943974-121943989
  misc_feature 1..15: note = hyper
  source 1..15: mol_type = genomic DNA
ccgggtggcatgggc

SEQ ID NO: 3096 - DNA, 123 bp, Homo sapiens; identical to SEQ ID NO: 706
  misc_feature 1..123: note = chr7:121944176-121944299
  misc_feature 1..123: note = hyper
  source 1..123: mol_type = genomic DNA

SEQ ID NO: 3097 - DNA, 488 bp, Homo sapiens; identical to SEQ ID NO: 707
  misc_feature 1..488: note = chr7:121946495-121946983
  misc_feature 1..488: note = hyper
  source 1..488: mol_type = genomic DNA

SEQ ID NO: 3098 - DNA, 64 bp, Homo sapiens; identical to SEQ ID NO: 708
  misc_feature 1..64: note = chr7:121947097-121947161
  misc_feature 1..64: note = hyper
  source 1..64: mol_type = genomic DNA

SEQ ID NO: 3099 - DNA, 128 bp, Homo sapiens; identical to SEQ ID NO: 709
  misc_feature 1..128: note = chr7:121950137-121950265
  misc_feature 1..128: note = hyper
  source 1..128: mol_type = genomic DNA

SEQ ID NO: 3100 - DNA, 125 bp, Homo sapiens; identical to SEQ ID NO: 710
  misc_feature 1..125: note = chr7:121950428-121950553
  misc_feature 1..125: note = hyper
  source 1..125: mol_type = genomic DNA

SEQ ID NO: 3101 - DNA, 148 bp, Homo sapiens; identical to SEQ ID NO: 711
  misc_feature 1..148: note = chr7:121951863-121952011
  misc_feature 1..148: note = hyper
  source 1..148: mol_type = genomic DNA

SEQ ID NO: 3102 - DNA, 15 bp, Homo sapiens
  misc_feature 1..15: note = chr7:121952043-121952058
  misc_feature 1..15: note = hyper
  source 1..15: mol_type = genomic DNA
cgagggtgggaaggg

SEQ ID NO: 3103 - DNA, 88 bp, Homo sapiens
  misc_feature 1..88: note = chr7:121955425-121955513
  misc_feature 1..88: note = hyper
  source 1..88: mol_type = genomic DNA
tttctctctctgttccgcttgcagtttgcaagtgtatccttctgttgcatccctgaattgggacgcaggacatcgttctaggctccca

SEQ ID NO: 3104 - DNA, 124 bp, Homo sapiens; identical to SEQ ID NO: 713
  misc_feature 1..124: note = chr7:121956458-121956582
  misc_feature 1..124: note = hyper
  source 1..124: mol_type = genomic DNA

SEQ ID NO: 3105 - DNA, 123 bp, Homo sapiens; identical to SEQ ID NO: 714
  misc_feature 1..123: note = chr7:121956954-121957077
  misc_feature 1..123: note = hyper
  source 1..123: mol_type = genomic DNA

SEQ ID NO: 3106 - DNA, 153 bp, Homo sapiens; identical to SEQ ID NO: 715
  misc_feature 1..153: note = chr7:127744057-127744210
  misc_feature 1..153: note = hyper
  source 1..153: mol_type = genomic DNA

SEQ ID NO: 3107 - DNA, 459 bp, Homo sapiens; identical to SEQ ID NO: 716
  misc_feature 1..459: note = chr7:127744211-127744670
  misc_feature 1..459: note = hyper
  source 1..459: mol_type = genomic DNA

SEQ ID NO: 3108 - DNA, 835 bp, Homo sapiens
  misc_feature 1..835: note = chr7:127807845-127808680
  misc_feature 1..835: note = hyper
  source 1..835: mol_type = genomic DNA
caacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccagtttgggagggagacacgcacagtcgctcccgtccacactcctctcgtgtcctggctccatgactgggagtctggggaaagaagaatgggtgtctgagacctacccctccgccggtgtcgccccgctctttctgggcgtaggagcgggctgcctgcccctctcccgcaccttcctggtctcgggctagaactggggcttcccatcggccgcgcttcccttaggggcgccatctgaggtcggaagcaaagctggaggggcgtccaggccagaggacgcgggctggggcgggagcctcggcagcctggtgggagctggtgcccactgcagggtgcgtgtacggggctgcctgcgtgtgcttggtgtgtgtcacttctgggagcgtaccccgtgtgtccacggggtgtgtatgcgcccacggaagtcctctgtgcatgcgtgtctgtgccataggcgtgggaacacctcgtgcacccatggtacttgcccggagagtaggaagccagcgagggagcggccctgctccagggtctcttccctgctcatccctccagctggcccagattacaccctactcacacccgggtcgcggcccactttccccatagccgcagcttccggcggctgcacacttct

SEQ ID NO: 3109 - DNA, 159 bp, Homo sapiens
  misc_feature 1..159: note = chr7:127841338-127841497
  misc_feature 1..159: note = hyper
  source 1..159: mol_type = genomic DNA
cggccgcctgacctcctcttggagttcccggctcagggcagggggtcgcgtccctgcggtctctggaggccacgccccacccgggcccaccggggtgggcgtggctacgtggctccctggcgctgaggcgcctccttcccaggtgggcggggctcctgc

SEQ ID NO: 3110 - DNA, 100 bp, Homo sapiens; identical to SEQ ID NO: 717
  misc_feature 1..100: note = chr7:128337422-128337522
  misc_feature 1..100: note = hyper
  source 1..100: mol_type = genomic DNA

SEQ ID NO: 3111 - DNA, 13 bp, Homo sapiens
  misc_feature 1..13: note = chr7:128337582-128337595
  misc_feature 1..13: note = hyper
  source 1..13: mol_type = genomic DNA
cgcctggaaatac

SEQ ID NO: 3112 - DNA, 134 bp, Homo sapiens; identical to SEQ ID NO: 719
  misc_feature 1..134: note = chr7:128337787-128337921
  misc_feature 1..134: note = hyper
  source 1..134: mol_type = genomic DNA

SEQ ID NO: 3113 - DNA, 125 bp, Homo sapiens
  misc_feature 1..125: note = chr7:128430757-128430882
  misc_feature 1..125: note = hyper
  source 1..125: mol_type = genomic DNA
tggctcgcagcccaccgggtgtgggaccggaagggaagacagggcggaggagagggggtcttccggccctgaggcttgatggggccaccggagggctcctcctaagagggtccttggccctggct

SEQ ID NO: 3114 - DNA, 560 bp, Homo sapiens
  misc_feature 1..560: note = chr7:128470497-128471057
  misc_feature 1..560: note = hyper
  source 1..560: mol_type = genomic DNA
gagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccggggg

SEQ ID NO: 3115 - DNA, 90 bp, Homo sapiens
  misc_feature 1..90: note = chr7:128471125-128471215
  misc_feature 1..90: note = hyper
  source 1..90: mol_type = genomic DNA
cggggagctgagagacagggcggagggcaccccccggtatagagagaagaccctggccccggccctcccacccatcgacaagggccatgg

SEQ ID NO: 3116 - skipped

SEQ ID NO: 3117 - DNA, 854 bp, Homo sapiens; identical to SEQ ID NO: 721
  misc_feature 1..854: note = chr7:129422115-129422969
  misc_feature 1..854: note = hyper
  source 1..854: mol_type = genomic DNA

SEQ ID NO: 3118 - DNA, 299 bp, Homo sapiens; identical to SEQ ID NO: 722
  misc_feature 1..299: note = chr7:129423125-129423424
  misc_feature 1..299: note = hyper
  source 1..299: mol_type = genomic DNA

SEQ ID NO: 3119 - DNA, 1355 bp, Homo sapiens; identical to SEQ ID NO: 723
  misc_feature 1..1355: note = chr7:129424591-129425946
  misc_feature 1..1355: note = hyper
  source 1..1355: mol_type = genomic DNA

SEQ ID NO: 3120 - DNA, 164 bp, Homo sapiens
  misc_feature 1..164: note = chr7:134143807-134143971
  misc_feature 1..164: note = hyper
  source 1..164: mol_type = genomic DNA
ttgccatggctgctgcgctccccagacccccgcccagtacggtgcggccttggccgcggcgcgtacctttaaatagcccgtgaggtcggcagaaagggcgcctgcggttggcgcgccgctgcgcgaaggagccttctgattggttgcgctgggggtgccgcggc

SEQ ID NO: 3121 - DNA, 83 bp, Homo sapiens
  misc_feature 1..83: note = chr7:134143972-134144055
  misc_feature 1..83: note = hyper
  source 1..83: mol_type = genomic DNA
gccttccccaagggtcggcggggatgcttcttccgcctggtcctagtggcagcggattctttccgcccccaacgctcgcccgc

SEQ ID NO: 3122 - DNA, 76 bp, Homo sapiens
  misc_feature 1..76: note = chr7:134144056-134144132
  misc_feature 1..76: note = hyper
  source 1..76: mol_type = genomic DNA
ccccgcgtggcagaaaggagttcctcagctgctgtatctggtgggaaagcgaatgctttagcgaaaataacaggca

SEQ ID NO: 3123 - DNA, 99 bp, Homo sapiens
  misc_feature 1..99: note = chr7:136553927-136554026
  misc_feature 1..99: note = hyper
  source 1..99: mol_type = genomic DNA
ctctcccgcctctcccgcctctcccgccccacccctacagtgtctcggcatcaactaatcttttccttttcttttgcaagatcaagggagaaagagaac

SEQ ID NO: 3124 - DNA, 263 bp, Homo sapiens
  misc_feature 1..263: note = chr7:136554103-136554366
  misc_feature 1..263: note = hyper
  source 1..263: mol_type = genomic DNA
cgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcg

SEQ ID NO: 3125 - DNA, 63 bp, Homo sapiens
  misc_feature 1..63: note = chr7:136554903-136554966
  misc_feature 1..63: note = hyper
  source 1..63: mol_type = genomic DNA
acagtgcctgggcttcgccacctaactcacaatgggtcctgaaccgcccgggcagtccccggg

SEQ ID NO: 3126 - DNA, 627 bp, Homo sapiens; identical to SEQ ID NO: 724
  misc_feature 1..627: note = chr7:137531262-137531889
  misc_feature 1..627: note = hyper
  source 1..627: mol_type = genomic DNA

SEQ ID NO: 3127 - DNA, 176 bp, Homo sapiens; identical to SEQ ID NO: 725
  misc_feature 1..176: note = chr7:137531908-137532084
  misc_feature 1..176: note = hyper
  source 1..176: mol_type = genomic DNA

SEQ ID NO: 3128 - DNA, 105 bp, Homo sapiens
  misc_feature 1..105: note = chr7:139167722-139167827
  misc_feature 1..105: note = hyper
  source 1..105: mol_type = genomic DNA
cttgcagcggcagcacgtgggggagcccggggagccggcgcttccttccgcggggctggcccggccctctgcgtcgcagccgctctccgtccgggctgcagccag

SEQ ID NO: 3129 - DNA, 423 bp, Homo sapiens
  misc_feature 1..423: note = chr7:139168114-139168537
  misc_feature 1..423: note = hyper
  source 1..423: mol_type = genomic DNA
cggggcagaccccgtagcccaggctgagcggcggcacgcgcggggacccggggcgaggcgaaggcggctttttcttgctcgagggctccaggcctgcgcccgccgccttctccacggccccggccggacttgggctgctttcgggaccttcaggttgtcgcaccttcgcgggcacctgcggctgctccagcgtggggaccaggcttcccacgggctccattgggagctctgccccggcttggcctccgggcgcagcctcccaagactcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctg

SEQ ID NO: 3130 - DNA, 133 bp, Homo sapiens
  misc_feature 1..133: note = chr7:139208629-139208762
  misc_feature 1..133: note = hyper
  source 1..133: mol_type = genomic DNA
accccggtgcaggagcgcgggcgcggcgcggcggagcgccccgcatggagccggcccgggagcccccctcgcgggcccggccgccgccgcccctcgccgcgcgccccgcgcccgcccccgccgcccccaggcc

SEQ ID NO: 3131 - DNA, 113 bp, Homo sapiens
  misc_feature 1..113: note = chr7:145813015-145813128
  misc_feature 1..113: note = hyper
  source 1..113: mol_type = genomic DNA
ccccaacttcagcaccgcggacagcatcacctcccgcccagggagaggcgcgcgcctccttgctccgcccccgccccagctgatggaccccggccggtcggctcagtctccct

SEQ ID NO: 3132 - DNA, 113 bp, Homo sapiens; identical to SEQ ID NO: 726
  misc_feature 1..113: note = chr7:149112136-149112249
  misc_feature 1..113: note = hyper
  source 1..113: mol_type = genomic DNA

SEQ ID NO: 3133 - DNA, 56 bp, Homo sapiens
  misc_feature 1..56: note = chr7:149917321-149917377
  misc_feature 1..56: note = hyper
  source 1..56: mol_type = genomic DNA
cgggtctcttaccttgtggcctttccccgggggatacctgacgctattggagactc

SEQ ID NO: 3134 - DNA, 148 bp, Homo sapiens
  misc_feature 1..148: note = chr7:151106418-151106566
  misc_feature 1..148: note = hyper
  source 1..148: mol_type = genomic DNA
ctagaaaggggtctgcgggcgcaggagctggggtccgcggtctggggccggtgagctgcggcgaagaggtcagggagggagtgggagggtctaccttgcaggagcgcgcagcactggccgtccgcggtgctccagagccgggccgtgc

SEQ ID NO: 3135 - DNA, 400 bp, Homo sapiens
  misc_feature 1..400: note = chr7:151106589-151106989
  misc_feature 1..400: note = hyper
  source 1..400: mol_type = genomic DNA
cgctgcccgtcggggctcaggctcagccagttgatgcccccgcggtggtcggcgcagaccctcagggccgacccgccgccccccatcccgctggcagggcggggaacaagaaggagctgcgccccgctagggaggggcgccccggggtccgcgcggcggctccgtacgactgcggcccgcggccatcgcggggaacggggagcccgactcctgcggaggcacgcggcgaggggagggtgaaggaccctagctccccgctgcctccagcctctgggcccgcgaacccagggcgctgcggggggcggcccactcgggacctccgccctgggtagagtcctgggcgcgcgggcagagagaacccccttcccagcaccgctcggaggatccacaccccaccggg

SEQ ID NO: 3136 - DNA, 181 bp, Homo sapiens
  misc_feature 1..181: note = chr7:151107395-151107576
  misc_feature 1..181: note = hyper
  source 1..181: mol_type = genomic DNA
cgcgcgccgggaactcatttggggcgcagctccaccgacccctcggctactcgcctccaccaggcaagccaggtcctcccatgctctgagccctaaggactctgcccgaggggctctcggggacttgggggcggtcccccaatggagggtgcgacagggaaagccccgagtccgccctccc

SEQ ID NO: 3137 - DNA, 71 bp, Homo sapiens
  misc_feature 1..71: note = chr7:153583933-153584004
  misc_feature 1..71: note = hyper
  source 1..71: mol_type = genomic DNA
ctctcccttctctcgcgggcgcagccgatcaatagttaacacccggctgcggacggcggctccatccgcgg

SEQ ID NO: 3138 - DNA, 194 bp, Homo sapiens
  misc_feature 1..194: note = chr7:153749733-153749927
  misc_feature 1..194: note = hyper
  source 1..194: mol_type = genomic DNA
ggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggt

SEQ ID NO: 3139 - DNA, 2593 bp, Homo sapiens; identical to SEQ ID NO: 727
  misc_feature 1..2593: note = chr7:155164445-155167038
  misc_feature 1..2593: note = hyper
  source 1..2593: mol_type = genomic DNA

SEQ ID NO: 3140 - DNA, 51 bp, Homo sapiens; identical to SEQ ID NO: 728
  misc_feature 1..51: note = chr7:155167039-155167090
  misc_feature 1..51: note = hyper
  source 1..51: mol_type = genomic DNA

SEQ ID NO: 3141 - DNA, 487 bp, Homo sapiens; identical to SEQ ID NO: 729
  misc_feature 1..487: note = chr7:155167174-155167661
  misc_feature 1..487: note = hyper
  source 1..487: mol_type = genomic DNA

SEQ ID NO: 3142 - DNA, 634 bp, Homo sapiens
  misc_feature 1..634: note = chr7:155174224-155174858
  misc_feature 1..634: note = hyper
  source 1..634: mol_type = genomic DNA
ctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggcgtcccgggagccaggcgcgcagcggggcgagttctcgtgtccgtgtgagcgcgggcgtgtgtatgcgtgcgcgtgcacgagcgtgagtgtgcgtgagcgtgagtttgagtgtgcatgcgggtgtgaatgtgtacatgtacacgaatgtgagtgtgagtgtgcatgagcgtgagcgtgcgtgtgcgtgcgagtgtgcacgagc

SEQ ID NO: 3143 - DNA, 61 bp, Homo sapiens; identical to SEQ ID NO: 730
  misc_feature 1..61: note = chr7:155241429-155241490
  misc_feature 1..61: note = hyper
  source 1..61: mol_type = genomic DNA

SEQ ID NO: 3144 - DNA, 738 bp, Homo sapiens; identical to SEQ ID NO: 731
  misc_feature 1..738: note = chr7:155241491-155242229
  misc_feature 1..738: note = hyper
  source 1..738: mol_type = genomic DNA

SEQ ID NO: 3145 - DNA, 742 bp, Homo sapiens
  misc_feature 1..742: note = chr7:155242699-155243441
  misc_feature 1..742: note = hyper
  source 1..742: mol_type = genomic DNA
cgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaa

SEQ ID NO: 3146 - DNA, 208 bp, Homo sapiens
  misc_feature 1..208: note = chr7:155244031-155244239
  misc_feature 1..208: note = hyper
  source 1..208: mol_type = genomic DNA
gaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaa

SEQ ID NO: 3147 - DNA, 491 bp, Homo sapiens; identical to SEQ ID NO: 732
  misc_feature 1..491: note = chr7:155246989-155247480
  misc_feature 1..491: note = hyper
  source 1..491: mol_type = genomic DNA

SEQ ID NO: 3148 - DNA, 111 bp, Homo sapiens
  misc_feature 1..111: note = chr7:155249900-155250011
  misc_feature 1..111: note = hyper
  source 1..111: mol_type = genomic DNA
aaatcttaaaaatagcgatcttcctgtgcgtgtccacctacgcgccccggggtgacctggcggggctgtcgccgggtgactcacacccctgaaccgcgaagcgacagggaa

SEQ ID NO: 3149 - DNA, 100 bp, Homo sapiens
  misc_feature 1..100: note = chr7:155252162-155252262
  misc_feature 1..100: note = hyper
  source 1..100: mol_type = genomic DNA
tcatccccttccctacgatcttccaactcaggccaggccggggacgcatgccccagcccaccccagacttgtcctaccatccggttatcccggctgtgct

SEQ ID NO: 3150 - DNA, 146 bp, Homo sapiens
  misc_feature 1..146: note = chr7:155252316-155252462
  misc_feature 1..146: note = hyper
  source 1..146: mol_type = genomic DNA
cgctgaccggtgggactcaggaggatgcacacagggaaggaggaaaataaaggcgccctttccccttggctccactttgtttgccagcgccagcccgcagtggtggggctcagcccccttcctgcacacagcgaggacaagggagg

SEQ ID NO: 3151 - DNA, 423 bp, Homo sapiens; identical to SEQ ID NO: 733
  misc_feature 1..423: note = chr7:155254901-155255324
  misc_feature 1..423: note = hyper
  source 1..423: mol_type = genomic DNA

SEQ ID NO: 3152 - skipped

SEQ ID NO: 3153 - DNA, 44 bp, Homo sapiens
  misc_feature 1..44: note = chr7:155256268-155256312
  misc_feature 1..44: note = hyper
  source 1..44: mol_type = genomic DNA
cgctgtccccagtcccaccgcagtcctgccgcaggcctaaccct

SEQ ID NO: 3154 - DNA, 792 bp, Homo sapiens; identical to SEQ ID NO: 734
  misc_feature 1..792: note = chr7:155258072-155258864
  misc_feature 1..792: note = hyper
  source 1..792: mol_type = genomic DNA

SEQ ID NO: 3155 - DNA, 164 bp, Homo sapiens; identical to SEQ ID NO: 735
  misc_feature 1..164: note = chr7:155258914-155259078
  misc_feature 1..164: note = hyper
  source 1..164: mol_type = genomic DNA

SEQ ID NO: 3156 - DNA, 504 bp, Homo sapiens; identical to SEQ ID NO: 736
  misc_feature 1..504: note = chr7:155259119-155259623
  misc_feature 1..504: note = hyper
  source 1..504: mol_type = genomic DNA

SEQ ID NO: 3157 - DNA, 12 bp, Homo sapiens
  misc_feature 1..12: note = chr7:155259833-155259845
  misc_feature 1..12: note = hyper
  source 1..12: mol_type = genomic DNA
cggggattcgcc

SEQ ID NO: 3158 - DNA, 112 bp, Homo sapiens; identical to SEQ ID NO: 738
  misc_feature 1..112: note = chr7:155259846-155259958
  misc_feature 1..112: note = hyper
  source 1..112: mol_type = genomic DNA

SEQ ID NO: 3159 - DNA, 99 bp, Homo sapiens; identical to SEQ ID NO: 739
  misc_feature 1..99: note = chr7:155260038-155260137
  misc_feature 1..99: note = hyper
  source 1..99: mol_type = genomic DNA

SEQ ID NO: 3160 - DNA, 106 bp, Homo sapiens
  misc_feature 1..106: note = chr7:155260785-155260891
  misc_feature 1..106: note = hyper
  source 1..106: mol_type = genomic DNA
cctcagcctggaaggcgtcccagagaggccccacccccagcctccacggagacccaggagggaagaagagccgggacccggtagccctgaggggctgccgggcctg

SEQ ID NO: 3161 - DNA, 140 bp, Homo sapiens
  misc_feature 1..140: note = chr7:155261070-155261210
  misc_feature 1..140: note = hyper
  source 1..140: mol_type = genomic DNA
cgcggtccgggcgcgcgctgcctgcgcggaaggagccgcctccctcctttcagcgaacgcattcggggttcccccctcccgccaagtcctttgtctggaaggggactggcaggctctgtcgtcgccgtgtgcccccctcc

SEQ ID NO: 3162 - DNA, 197 bp, Homo sapiens; identical to SEQ ID NO: 740
  misc_feature 1..197: note = chr7:155301753-155301950
  misc_feature 1..197: note = hyper
  source 1..197: mol_type = genomic DNA

SEQ ID NO: 3163 - DNA, 346 bp, Homo sapiens; identical to SEQ ID NO: 741
  misc_feature 1..346: note = chr7:155302372-155302718
  misc_feature 1..346: note = hyper
  source 1..346: mol_type = genomic DNA

SEQ ID NO: 3164 - DNA, 188 bp, Homo sapiens; identical to SEQ ID NO: 742
  misc_feature 1..188: note = chr7:155302963-155303151
  misc_feature 1..188: note = hyper
  source 1..188: mol_type = genomic DNA

SEQ ID NO: 3165 - DNA, 372 bp, Homo sapiens
  misc_feature 1..372: note = chr7:155326169-155326541
  misc_feature 1..372: note = hyper
  source 1..372: mol_type = genomic DNA
gcctcagaatgacagcgaggtgcacgctccggcccgcgcagagcggggccagctccgccacccagcgcgcgggaagccccgcagcaccagcagggcccgtcgcttcgctccgtcccggtccggcgtgaaacccccgaggggaaaagcgggtatcaaatgtgaattccactcgtccacagcgccgggcgttatgaaaatctgagcacctttgaccggagaagcaatagctatgggattaaggcgaatttcttacggagaggagaaagatgtgcagtttgtaattacctgctccctgtagtacagtccgtccttcacgcctggatctaacgggacaaactctcagcggctttgctctcccggcattgtttcagc

SEQ ID NO: 3166 - DNA, 21 bp, Homo sapiens
  misc_feature 1..21: note = chr7:156794464-156794485
  misc_feature 1..21: note = hyper
  source 1..21: mol_type = genomic DNA
ccactgcgcccagcctgattt

SEQ ID NO: 3167 - DNA, 288 bp, Homo sapiens; identical to SEQ ID NO: 744
  misc_feature 1..288: note = chr7:156795067-156795355
  misc_feature 1..288: note = hyper
  source 1..288: mol_type = genomic DNA

SEQ ID NO: 3168 - DNA, 235 bp, Homo sapiens; identical to SEQ ID NO: 745
  misc_feature 1..235: note = chr7:156795401-156795636
  misc_feature 1..235: note = hyper
  source 1..235: mol_type = genomic DNA

SEQ ID NO: 3169 - DNA, 114 bp, Homo sapiens; identical to SEQ ID NO: 746
  misc_feature 1..114: note = chr7:156795899-156796013
  misc_feature 1..114: note = hyper
  source 1..114: mol_type = genomic DNA

SEQ ID NO: 3170 - DNA, 246 bp, Homo sapiens; identical to SEQ ID NO: 747
  misc_feature 1..246: note = chr7:156796494-156796740
  misc_feature 1..246: note = hyper
  source 1..246: mol_type = genomic DNA

SEQ ID NO: 3171 - DNA, 355 bp, Homo sapiens; identical to SEQ ID NO: 748
  misc_feature 1..355: note = chr7:156797005-156797360
  misc_feature 1..355: note = hyper
  source 1..355: mol_type = genomic DNA

SEQ ID NO: 3172 - DNA, 828 bp, Homo sapiens; identical to SEQ ID NO: 749
  misc_feature 1..828: note = chr7:156797607-156798435
  misc_feature 1..828: note = hyper
  source 1..828: mol_type = genomic DNA

SEQ ID NO: 3173 - DNA, 621 bp, Homo sapiens; identical to SEQ ID NO: 750
  misc_feature 1..621: note = chr7:156798526-156799147
  misc_feature 1..621: note = hyper
  source 1..621: mol_type = genomic DNA

SEQ ID NO: 3174 - DNA, 50 bp, Homo sapiens; identical to SEQ ID NO: 751
  misc_feature 1..50: note = chr7:156799290-156799340
  misc_feature 1..50: note = hyper
  source 1..50: mol_type = genomic DNA

SEQ ID NO: 3175 - DNA, 434 bp, Homo sapiens; identical to SEQ ID NO: 752
  misc_feature 1..434: note = chr7:156801438-156801872
  misc_feature 1..434: note = hyper
  source 1..434: mol_type = genomic DNA

SEQ ID NO: 3176 - DNA, 31 bp, Homo sapiens; identical to SEQ ID NO: 753
  misc_feature 1..31: note = chr7:156810491-156810522
  misc_feature 1..31: note = hyper
  source 1..31: mol_type = genomic DNA

SEQ ID NO: 3177 - DNA, 204 bp, Homo sapiens; identical to SEQ ID NO: 754
  misc_feature 1..204: note = chr7:156810597-156810801
  misc_feature 1..204: note = hyper
  source 1..204: mol_type = genomic DNA

SEQ ID NO: 3178 - DNA, 104 bp, Homo sapiens; identical to SEQ ID NO: 755
  misc_feature 1..104: note = chr7:156811302-156811406
  misc_feature 1..104: note = hyper
  source 1..104: mol_type = genomic DNA

SEQ ID NO: 3179 - DNA, 974 bp, Homo sapiens; identical to SEQ ID NO: 756
  misc_feature 1..974: note = chr7:156812852-156813826
  misc_feature 1..974: note = hyper
  source 1..974: mol_type = genomic DNA

SEQ ID NO: 3180 - DNA, 244 bp, Homo sapiens; identical to SEQ ID NO: 757
  misc_feature 1..244: note = chr7:156813986-156814230
  misc_feature 1..244: note = hyper
  source 1..244: mol_type = genomic DNA

SEQ ID NO: 3181 - DNA, 11 bp, Homo sapiens
  misc_feature 1..11: note = chr7:156871282-156871293
  misc_feature 1..11: note = hyper
  source 1..11: mol_type = genomic DNA
cgagctccaga

SEQ ID NO: 3182 - DNA, 16 bp, Homo sapiens
  misc_feature 1..16: note = chr7:157477473-157477489
  misc_feature 1..16: note = hyper
  source 1..16: mol_type = genomic DNA
gggccggggtctcctc

SEQ ID NO: 3183 - DNA, 107 bp, Homo sapiens; identical to SEQ ID NO: 759
  misc_feature 1..107: note = chr7:157477710-157477817
  misc_feature 1..107: note = hyper
  source 1..107: mol_type = genomic DNA

SEQ ID NO: 3184 - DNA, 227 bp, Homo sapiens
  misc_feature 1..227: note = chr7:157481847-157482074
  misc_feature 1..227: note = hyper
  source 1..227: mol_type = genomic DNA
cactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccc

SEQ ID NO: 3185 - DNA, 239 bp, Homo sapiens
  misc_feature 1..239: note = chr7:157483274-157483513
  misc_feature 1..239: note = hyper
  source 1..239: mol_type = genomic DNA
gggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagc

SEQ ID NO: 3186 - DNA, 99 bp, Homo sapiens
  misc_feature 1..99: note = chr7:157485503-157485602
  misc_feature 1..99: note = hyper
  source 1..99: mol_type = genomic DNA
gcccagggcaaggcccgcaaaaacccccgcaccctggctcgggggcggcgcggcggcgggcaggtcagagagaagcggtactcgggttcccccagcgcc

SEQ ID NO: 3187 - DNA, 15 bp, Homo sapiens
  misc_feature 1..15: note = chr7:157485649-157485664
  misc_feature 1..15: note = hyper
  source 1..15: mol_type = genomic DNA
cggttcctgtccctc

SEQ ID NO: 3188 - DNA, 68 bp, Homo sapiens
  misc_feature 1..68: note = chr7:157486014-157486082
  misc_feature 1..68: note = hyper
  source 1..68: mol_type = genomic DNA
agaaccctagggtggcgacagagcaaacccctccaggactggaggcccgacctccgcggtgctgggag

SEQ ID NO: 3189 - DNA, 211 bp, Homo sapiens
  misc_feature 1..211: note = chr7:157486204-157486415
  misc_feature 1..211: note = hyper
  source 1..211: mol_type = genomic DNA
cggtcgcagggccttggggcaccggggagtgggcgggtcttcccagcgacccggagcacaggggcgggcgacggcgcccccaccatggccctgcccggcccgagcgcccggcgcacctgaggtctgggccggggagcagctggggaaccgcgcgtcgcctcggggagctcccggccaggccggctccgggcagaggccagaggggccctgg

SEQ ID NO: 3190 - DNA, 28 bp, Homo sapiens
  misc_feature 1..28: note = chr7:157486475-157486503
  misc_feature 1..28: note = hyper
  source 1..28: mol_type = genomic DNA
cgccctggatcgccggagcctcatccag

SEQ ID NO: 3191 - DNA, 129 bp, Homo sapiens
  misc_feature 1..129: note = chr7:158937202-158937331
  misc_feature 1..129: note = hyper
  source 1..129: mol_type = genomic DNA
cgagtcccgcaacccggcgggaccggagctcagcgcttcacgctctccgggaggaagctccggaccccgggcgaccccgctccctctcccggaccccgcccgcgctccagcacccgggaggaaggcgaa

SEQ ID NO: 3192 - DNA, 56 bp, Homo sapiens
  misc_feature 1..56: note = chr8:687162-687218
  misc_feature 1..56: note = hyper
  source 1..56: mol_type = genomic DNA
gggggaggttctgcctccagcacccaagcggcggccgcacctcgcagtgagaccct

SEQ ID NO: 3193 - DNA, 129 bp, Homo sapiens
  misc_feature 1..129: note = chr8:687513-687642
  misc_feature 1..129: note = hyper
  source 1..129: mol_type = genomic DNA
gggctgcccgcgcgctccccaagccgggcccttccccagatgcagccgcgcgccggccgccccccagtgcgccggtgcctccctgggcgccgagtgcgcaggcgccggccgtgaagaccgaccgtgcgc

SEQ ID NO: 3194 - DNA, 139 bp, Homo sapiens
  misc_feature 1..139: note = chr8:687837-687976
  misc_feature 1..139: note = hyper
  source 1..139: mol_type = genomic DNA
gggggctgccgggagccgggcgcggggctccgagagccgtcgaggcggggagggcgcggtgtgtcggacccgcggggacgccccgagggcgtcagggttgggggcgggggcgagcgggggtcgtgccgcccgccggggc

SEQ ID NO: 3195 - DNA, 104 bp, Homo sapiens
  misc_feature 1..104: note = chr8:9762586-9762690
  misc_feature 1..104: note = hyper
  source 1..104: mol_type = genomic DNA
agaccccaacaaccccgacccctctcctacgtagacactgtgaaagcaagccacagggacaaataaaagacaatccgaataccctcagcgttccgcacgccggg

SEQ ID NO: 3196 - DNA, 540 bp, Homo sapiens
  misc_feature 1..540: note = chr8:9762751-9763291
  misc_feature 1..540: note = hyper
  source 1..540: mol_type = genomic DNA
cgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaa

SEQ ID NO: 3197 - DNA, 197 bp, Homo sapiens
  misc_feature 1..197: note = chr8:9763565-9763762
  misc_feature 1..197: note = hyper
  source 1..197: mol_type = genomic DNA
agaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtgg

SEQ ID NO: 3198 - DNA, 263 bp, Homo sapiens
  misc_feature 1..263: note = chr8:9763787-9764050
  misc_feature 1..263: note = hyper
  source 1..263: mol_type = genomic DNA
cgcttccgtttatccgtttctatcccgggaaaagggggcgcctgcccgagcccacgcgcgccgccgcatctgcagcggtcggcgccccacgctccctgaacgccccccaggcggcaccagtgccgggcagagtcccctcggcggccgcgggcgtcaaatcgacacctgactccacagctcccttccctctcctcttcttccacctccccgggggtccaggcaccgccgtgcgtccactcccggtctccacggcttaggcagac

SEQ ID NO: 3199 - DNA, 718 bp, Homo sapiens
  misc_feature 1..718: note = chr8:9764195-9764913
  misc_feature 1..718: note = hyper
  source 1..718: mol_type = genomic DNA
gggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagca

SEQ ID NO: 3200 - DNA, 141 bp, Homo sapiens
  misc_feature 1..141: note = chr8:11560711-11560852
  misc_feature 1..141: note = hyper
  source 1..141: mol_type = genomic DNA
agcgtgagagccacccgccggctgttatctggggctgaaggctgcggtaatcgatgggttatttttacgcggtaatagggccctgtgattgctctattaacctttagacctgtctgagggactctccggctcgcagccccg

SEQ ID NO: 3201 - DNA, 282 bp, Homo sapiens
  misc_feature 1..282: note = chr8:11561442-11561724
  misc_feature 1..282: note = hyper
  source 1..282: mol_type = genomic DNA
ccctgggcaccacagcgaacccaatcgacctccggctgggttgcgggtgattccccgctccctggcggtagcacttgggcattttccgcggagaccccagagcctggactttgcctgctgggggagctttccgcacagtcccgcagcctgcgcccagcggaggtgtagccggggccgcgcacccccgccccgcccttgcacgtgactcccacaggccagtcagcgccctagggccgagttgctgggccggggacccgagccgcgagctggggacttggaggc

SEQ ID NO: 3202 - DNA, 471 bp, Homo sapiens
  misc_feature 1..471: note = chr8:11561725-11562196
  misc_feature 1..471: note = hyper
  source 1..471: mol_type = genomic DNA
gccggcgcaggggccgcgagaggcttcgtcgccgctgcagctccgggggctcccaggggagcgtgcgcggaacctccaggcccagcaggtagggcttttttcttccctttctttgctccttcccgcggtcccccaaactcggagcttctccgcctttgcttgtctggaggtagagaggtagctagtgggaggaaaagagacgtgcgctactcacttcaccgaaattgcccaacccctgctctgcttttgactttgccttagcaacttctttaagtcaaagtaagacttgggggcaaaacagagaaatattggaagcgcctttggattctttccgtgtgaacttgaacgctttcaatccctgtccccgtgtgcacattctccaacccttgtttgcatatcgcaggccggggcctgggtggtgatggtggccgcgtgaagttaccgggactgacgggcccgggacaggctgca

SEQ ID NO: 3203 - DNA, 146 bp, Homo sapiens
  misc_feature 1..146: note = chr8:11562235-11562381
  misc_feature 1..146: note = hyper
  source 1..146: mol_type = genomic DNA
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccct

SEQ ID NO: 3204 - DNA, 104 bp, Homo sapiens
  misc_feature 1..104: note = chr8:11562627-11562731
  misc_feature 1..104: note = hyper
  source 1..104: mol_type = genomic DNA
tggctggggaaagagcgtggtgggggacccgcggccgatggaatccctggggcagcgcggcccgcaccgtggaggttggggaagcgcctcggggaagtgtttcc

SEQ ID NO: 3205 - DNA, 50 bp, Homo sapiens; identical to SEQ ID NO: 760
  misc_feature 1..50: note = chr8:23559552-23559602
  misc_feature 1..50: note = hyper
  source 1..50: mol_type = genomic DNA

SEQ ID NO: 3206 - DNA, 972 bp, Homo sapiens; identical to SEQ ID NO: 761
  misc_feature 1..972: note = chr8:23559665-23560637
  misc_feature 1..972: note = hyper
  source 1..972: mol_type = genomic DNA

SEQ ID NO: 3207 - DNA, 230 bp, Homo sapiens; identical to SEQ ID NO: 762
  misc_feature 1..230: note = chr8:23564830-23565060
  misc_feature 1..230: note = hyper
  source 1..230: mol_type = genomic DNA

SEQ ID NO: 3208 - DNA, 15 bp, Homo sapiens
  misc_feature 1..15: note = chr8:23566840-23566855
  misc_feature 1..15: note = hyper
  source 1..15: mol_type = genomic DNA
aacttagaatatttc

SEQ ID NO: 3209 - DNA, 15 bp, Homo sapiens
  misc_feature 1..15: note = chr8:23566900-23566915
  misc_feature 1..15: note = hyper
  source 1..15: mol_type = genomic DNA
cgctgggttctcgcc

SEQ ID NO: 3210 - DNA, 54 bp, Homo sapiens
  misc_feature 1..54: note = chr8:23567116-23567170
  misc_feature 1..54: note = hyper
  source 1..54: mol_type = genomic DNA
cttcctggcttgctgcgaggatgaaatgagatttttgtacgtgaaaatgctttc

SEQ ID NO: 3211 - DNA, 292 bp, Homo sapiens; identical to SEQ ID NO: 763
  misc_feature 1..292: note = chr8:23571681-23571973
  misc_feature 1..292: note = hyper
  source 1..292: mol_type = genomic DNA

SEQ ID NO: 3212 - DNA, 85 bp, Homo sapiens
  misc_feature 1..85: note = chr8:23572524-23572609
  misc_feature 1..85: note = hyper
  source 1..85: mol_type = genomic DNA
tgcgtccccagaccccgagaggggagttgcacacacattgctgaccttgagggtcagacagaccctttctcgtctagtttttagc

SEQ ID NO: 3213 - DNA, 46 bp, Homo sapiens
  misc_feature 1..46: note = chr8:23583971-23584017
  misc_feature 1..46: note = hyper
  source 1..46: mol_type = genomic DNA
tacctcttattgcagcggggatactaaggccgggacaacaaaagta

SEQ ID NO: 3214 - DNA, 308 bp, Homo sapiens
  misc_feature 1..308: note = chr8:23584093-23584401
  misc_feature 1..308: note = hyper
  source 1..308: mol_type = genomic DNA
cgcccggctgcatcctccacccggccggtttctagaaataggagataccgagaagttagggtggcccaggtctggccttagatctgcagaggggcgagtgcagattgcgcgatggcgaggctcctgcgacaaggcgaacaccaaggacgcgagctatctggaaccacaaataaaacaaattcagggacggcgttgacaccgcggccacctcctaggcgcttcttggaagggcgcggctgtggtgcccgctctgcccgtggtcccgcttacttttggactctgtcccccatggggctggggtccgggtc

SEQ ID NO: 3215 - DNA, 193 bp, Homo sapiens
  misc_feature 1..193: note = chr8:23584581-23584774
  misc_feature 1..193: note = hyper
  source 1..193: mol_type = genomic DNA
cggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagca

SEQ ID NO: 3216 - DNA, 213 bp, Homo sapiens
  misc_feature 1..213: note = chr8:24770912-24771125
  misc_feature 1..213: note = hyper
  source 1..213: mol_type = genomic DNA
gaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggc

SEQ ID NO: 3217 - DNA, 213 bp, Homo sapiens
  misc_feature 1..213: note = chr8:24771349-24771562
  misc_feature 1..213: note = hyper
  source 1..213: mol_type = genomic DNA
ggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacg

SEQ ID NO: 3218 - DNA, 276 bp, Homo sapiens
  misc_feature 1..276: note = chr8:24813188-24813464
  misc_feature 1..276: note = hyper
  source 1..276: mol_type = genomic DNA
tgaaccattcctcagcgttctgcatgttcttggcggccagcttctcgtactgcgcgcggatgtccttgagcgcggcggaaaggtcgggcttggtcacgtccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccct

SEQ ID NO: 3219 - DNA, 276 bp, Homo sapiens
  misc_feature 1..276: note = chr8:24813618-24813894
  misc_feature 1..276: note = hyper
  source 1..276: mol_type = genomic DNA
cgcccggaagcgggatggctcggagtgcttctggcgcagcaccagcagctcggcttccaggaccttgttctgctgctccagctcgtgcacgcgctcgatgaagctggcgaagcggtcattgaggtcctggagctgcgccttctcctgcgtgcggatggacttgaggtcgttgctgatggcggctacctggctcaggtcgaggttctccagactgggcatcaacgatccagagctggaggagtagctgcggcgcacggacagcgaggaagacaccgg

SEQ ID NO: 3220 - DNA, 418 bp, Homo sapiens
  misc_feature 1..418: note = chr8:24814010-24814428
  misc_feature 1..418: note = hyper
  source 1..418: mol_type = genomic DNA
cgtagctgaaggaactcatggtggcggccggtggctccccggcccgcggcggcggtgggagcccggagagagaggacaggggagagagggaagggggaggatggatggctgtgtgcggctcggcgccgttctgccacccctatttatacgccgggaggctcctgacgcagcctgcgatcgatcacggcacgccggccagtgggggcagcgcgctgctgcagccaaggcgaggattctgcgcaaaagggaaggcggggtcgagctacggcccgaggagctgcggcggtcgtcctttccactttgctcagagggccctgattttctctgagatcccatgccccctcactcatttcccttctgtactcactcacgcagcccctcccgtcctgcattgcccagaccccgtgacacttggatc

SEQ ID NO: 3221 - DNA, 514 bp, Homo sapiens; identical to SEQ ID NO: 764
  misc_feature 1..514: note = chr8:24858647-24859161
  misc_feature 1..514: note = hyper
  source 1..514: mol_type = genomic DNA

SEQ ID NO: 3222 - DNA, 276 bp, Homo sapiens
  misc_feature 1..276: note = chr8:25900417-25900693
  misc_feature 1..276: note = hyper
  source 1..276: mol_type = genomic DNA
acagggcggaatcctcgcgaccagccccggggatcgctggccaccacaaatgagatgaccgacatagggggccctccctcccagaggtgctaggtggggaaaagccaaactgttaaaaggcgagaacctcctttcctggggccaacgcgatccccactcatgctgcgttttctggcggcgccagccgaacccagtgactgtgaaacccaagttgggggacccggaaggcgccctcgagcgtgctgagtgtgtgcacacgcttcccagccaaccggt

SEQ ID NO: 3223 - DNA, 237 bp, Homo sapiens
  misc_feature 1..237: note = chr8:25900780-25901017
  misc_feature 1..237: note = hyper
  source 1..237: mol_type = genomic DNA
cggcgctggggtctcccaggttgaaccccggtgcgcaagcaccttcattcactcttttgaaaggggtaacattttggctaagctctcccccactaagtctgctccttccagcttcaacaaactttttgatcccgggaaggaaggaaagcgagggaggcgtctttaaggagcccagctaaggaaatgcgcggcacagttggctctgcggtgctgccttatttcccttagctcgcaggc

SEQ ID NO: 3224 - DNA, 178 bp, Homo sapiens
  misc_feature 1..178: note = chr8:25901018-25901196
  misc_feature 1..178: note = hyper
  source 1..178: mol_type = genomic DNA
ggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggac

SEQ ID NO: 3225 - DNA, 193 bp, Homo sapiens; identical to SEQ ID NO: 765
  misc_feature 1..193: note = chr8:37655798-37655991
  misc_feature 1..193: note = hyper
  source 1..193: mol_type = genomic DNA

SEQ ID NO: 3226 - DNA, 148 bp, Homo sapiens; identical to SEQ ID NO: 766
  misc_feature 1..148: note = chr8:37656049-37656197
  misc_feature 1..148: note = hyper
  source 1..148: mol_type = genomic DNA

SEQ ID NO: 3227 - DNA, 415 bp, Homo sapiens; identical to SEQ ID NO: 767
  misc_feature 1..415: note = chr8:37822994-37823409
  misc_feature 1..415: note = hyper
  source 1..415: mol_type = genomic DNA

SEQ ID NO: 3228 - DNA, 13 bp, Homo sapiens
  misc_feature 1..13: note = chr8:37823410-37823423
  misc_feature 1..13: note = hyper
  source 1..13: mol_type = genomic DNA
ggttggagtggca

SEQ ID NO: 3229 - DNA, 389 bp, Homo sapiens; identical to SEQ ID NO: 769
  misc_feature 1..389: note = chr8:38008209-38008598
  misc_feature 1..389: note = hyper
  source 1..389: mol_type = genomic DNA

SEQ ID NO: 3230 - DNA, 26 bp, Homo sapiens
  misc_feature 1..26: note = chr8:41165893-41165919
  misc_feature 1..26: note = hyper
  source 1..26: mol_type = genomic DNA
cagagctgccgctcccgggccagccc

SEQ ID NO: 3231 - DNA, 152 bp, Homo sapiens
  misc_feature 1..152: note = chr8:41166000-41166152
  misc_feature 1..152: note = hyper
  source 1..152: mol_type = genomic DNA
cgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggctt

SEQ ID NO: 3232 - DNA, 414 bp, Homo sapiens
  misc_feature 1..414: note = chr8:41166266-41166680
  misc_feature 1..414: note = hyper
  source 1..414: mol_type = genomic DNA
cgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgc

SEQ ID NO: 3233 - DNA, 244 bp, Homo sapiens
  misc_feature 1..244: note = chr8:41166745-41166989
  misc_feature 1..244: note = hyper
  source 1..244: mol_type = genomic DNA
cgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtg

SEQ ID NO: 3234 - DNA, 98 bp, Homo sapiens
  misc_feature 1..98: note = chr8:41167025-41167123
  misc_feature 1..98: note = hyper
  source 1..98: mol_type = genomic DNA
cgcgcagccaatcagctcccggcggggcgagccgcactcgttaccacgtccgtcaccggcgcgggagccaatcgcctccctcgcgagcgggttcggtt

SEQ ID NO: 3235 - DNA, 428 bp, Homo sapiens
  misc_feature 1..428: note = chr8:41753325-41753753
  misc_feature 1..428: note = hyper
  source 1..428: mol_type = genomic DNA
ggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggtgctgaaaggtctctgcgggcagctggcgggaggattctgcgcgccctcagcctcccggccacccgctctgcccttccagcctgccgccctgtccccttcccggccgcgcagaagcctccgtccctcctctacgcccaccgagccttccccgctcgggtgc

SEQ ID NO: 3236 - DNA, 411 bp, Homo sapiens
  misc_feature 1..411: note = chr8:41753770-41754181
  misc_feature 1..411: note = hyper
  source 1..411: mol_type = genomic DNA
cgggcgccgcgccccaccgcgtcccgggccgcccgacccctgcccccagcagccacttgcaggtgccgcggtcgctgggctttcaccgccgccccctcctaccttcttctttcggtcacgggagcggtttctccgcttcctgttggattcctccttctccttctgctcctggagggcctgcgcctcgatgtctttgattttcttcagctgtttggccgcttgagccatggcgggtcacggcgctcccgtccccgcctcctggacccctagcgctcagcgatccccgaggcgacaccccctaagaaggggaagggggtctctgctccacagaggggacagcgttcgtggcgccccgagggccggctgctgcggggtcgcgggaaggcgaaggcagttccggacgcggagggc

SEQ ID NO: 3237 - DNA, 1026 bp, Homo sapiens
  misc_feature 1..1026: note = chr8:41754182-41755208
  misc_feature 1..1026: note = hyper
  source 1..1026: mol_type = genomic DNA
aggggcggctgcccgcggcccgggatggcgctgccgccgcggccggagctcgcttgccggcgcccgggacgggctctgggcagggcccgccgcctccctccctccgcctccctccctctcctgcggcggcggcggcggcgaagcgggggggcgggggcggggaggcggctcgtactgcggcggcggcgggcggtgagcggccgcggaaggggcggattcgggcgctcagcgcgggaaggcccgggggcccggccggcgcggcgaggctgggcgcactgggcgtccgcacggggtcatggcgagcgccgagcttccgcctttgcagagccccgcgccgtcgggcggcgggaacaaagcggccgctctaccccggaccccgctgcgggccgcagggccaagccgggggaagaggggaggctgcggcgggcggcgcgccccgcgcccgggcgacccggcggaccagcgcgcctggcggcggcgagcgcggcgacatcgcgggagcggaggctcggcctagagggcgggcggcagagggcaaggaccgggcttggggagcccccgggcggtggccgctgagggcccggacgcgctactcccgagcccggggtgcggttcctccccgggcgccctcggcgtggggcgcgcgcctccggggctccctggggaagagccggttccccgcgccgcacgctgggagcttgatttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgccgcacaggagccagccggggtccccggctc

SEQ ID NO: 3238 - DNA, 140 bp, Homo sapiens
  misc_feature 1..140: note = chr8:49293385-49293525
  misc_feature 1..140: note = hyper
  source 1..140: mol_type = genomic DNA
gggcaaccagcagaacggagagggaggcgcgggggcgaaggctggcgggagccgcgctgagggcaggagcccggagccccctagggcagcgccgatccgcccgccccgtcccgccgagctgggcctccgtctgtggcctg

SEQ ID NO: 3239 - DNA, 37 bp, Homo sapiens
  misc_feature 1..37: note = chr8:49293580-49293617
  misc_feature 1..37: note = hyper
  source 1..37: mol_type = genomic DNA
cgccaaaaagagctttgcccgccgggtgatggagatc

SEQ ID NO: 3240 - DNA, 160 bp, Homo sapiens; identical to SEQ ID NO: 770
  misc_feature 1..160: note = chr8:49468668-49468828
  misc_feature 1..160: note = hyper
  source 1..160: mol_type = genomic DNA

SEQ ID NO: 3241 - DNA, 362 bp, Homo sapiens; identical to SEQ ID NO: 771
  misc_feature 1..362: note = chr8:49468829-49469191
  misc_feature 1..362: note = hyper
  source 1..362: mol_type = genomic DNA

SEQ ID NO: 3242 - DNA, 288 bp, Homo sapiens
  misc_feature 1..288: note = chr8:53477449-53477737
  misc_feature 1..288: note = hyper
  source 1..288: mol_type = genomic DNA
gtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcc

SEQ ID NO: 3243 - DNA, 150 bp, Homo sapiens
  misc_feature 1..150: note = chr8:53478480-53478630
  misc_feature 1..150: note = hyper
  source 1..150: mol_type = genomic DNA
caggaacactggccacgccgtcacgccagccgcccctgccccaggtctggaggcccgacctgctctcctaggcgcagcaccgcgttctcttccgcgtgggggagcggcgggcggaagaggtctggggctgggcaccggggacacgcgccc

SEQ ID NO: 3244 - DNA, 123 bp, Homo sapiens
  misc_feature 1..123: note = chr8:53854249-53854372
  misc_feature 1..123: note = hyper
  source 1..123: mol_type = genomic DNA
tttccctttcctatccgtgatctcccctgaaaatgtcagactcccggagcaaggaacccggagtagcccgggcgcgcggttccggcgccccctggaggagccagcggccgagtgcttagcgtc

SEQ ID NO: 3245 - DNA, 193 bp, Homo sapiens; identical to SEQ ID NO: 772
  misc_feature 1..193: note = chr8:54789613-54789806
  misc_feature 1..193: note = hyper
  source 1..193: mol_type = genomic DNA

SEQ ID NO: 3246 - DNA, 588 bp, Homo sapiens; identical to SEQ ID NO: 773
  misc_feature 1..588: note = chr8:54790022-54790610
  misc_feature 1..588: note = hyper
  source 1..588: mol_type = genomic DNA

SEQ ID NO: 3247 - DNA, 49 bp, Homo sapiens; identical to SEQ ID NO: 774
  misc_feature 1..49: note = chr8:54791897-54791946
  misc_feature 1..49: note = hyper
  source 1..49: mol_type = genomic DNA

SEQ ID NO: 3248 - DNA, 487 bp, Homo sapiens; identical to SEQ ID NO: 775
  misc_feature 1..487: note = chr8:54792184-54792671
  misc_feature 1..487: note = hyper
  source 1..487: mol_type = genomic DNA

SEQ ID NO: 3249 - DNA, 427 bp, Homo sapiens; identical to SEQ ID NO: 776
  misc_feature 1..427: note = chr8:54792701-54793128
  misc_feature 1..427: note = hyper
  source 1..427: mol_type = genomic DNA

SEQ ID NO: 3250 - DNA, 203 bp, Homo sapiens
  misc_feature 1..203: note = chr8:55366165-55366368
  misc_feature 1..203: note = hyper
  source 1..203: mol_type = genomic DNA
aagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctc

SEQ ID NO: 3251 - DNA, 562 bp, Homo sapiens
  misc_feature 1..562: note = chr8:55367063-55367625
  misc_feature 1..562: note = hyper
  source 1..562: mol_type = genomic DNA
aacacaaaagcctgccggaaatcacccagcctttgcctggtcactcaggggcccacggataagcgtggctctgattcctccaggtcagccccacggttcgccacctacccgagttaatttctgcgcccgctgaccaaaggccccaactggcaacgggcacagcttcttggtgcgctagtcgcttccttgcccagcctttagagcctcgggtccggcccaaggacccggggacgtgagcgcaattagtagccaggagccctgcgaccctggaccgtgcagtgctaacgcacccgaacggctatgcgagcggtgtactcggctcttacttgtgaaagttgtttcccccaaccccctgcgtaaatctcttgtgttgagaaaagcaaggcttgcaggaagccactccggatgtttgctgctttacatgtggcatctgtggctggctctgataacgtcccggggcaccacgtattaaagtgaagagactgaaatagaaggctccacacaccgcgcgcgggtcagcgacgtcgccgccctccacactgccccccgaaatataagacaa

SEQ ID NO: 3252 - DNA, 223 bp, Homo sapiens; identical to SEQ ID NO: 777
  misc_feature 1..223: note = chr8:55370113-55370336
  misc_feature 1..223: note = hyper
  source 1..223: mol_type = genomic DNA

SEQ ID NO: 3253 - DNA, 86 bp, Homo sapiens; identical to SEQ ID NO: 778
  misc_feature 1..86: note = chr8:55370337-55370423
  misc_feature 1..86: note = hyper
  source 1..86: mol_type = genomic DNA

SEQ ID NO: 3254 - skipped

SEQ ID NO: 3255 - DNA, 109 bp, Homo sapiens; identical to SEQ ID NO: 780
  misc_feature 1..109: note = chr8:55370567-55370676
  misc_feature 1..109: note = hyper
  source 1..109: mol_type = genomic DNA

SEQ ID NO: 3256 - DNA, 204 bp, Homo sapiens; identical to SEQ ID NO: 781
  misc_feature 1..204: note = chr8:55371172-55371376
  misc_feature 1..204: note = hyper
  source 1..204: mol_type = genomic DNA

SEQ ID NO: 3257 - DNA, 286 bp, Homo sapiens; identical to SEQ ID NO: 782
  misc_feature 1..286: note = chr8:55371439-55371725
  misc_feature 1..286: note = hyper
  source 1..286: mol_type = genomic DNA

SEQ ID NO: 3258 - DNA, 75 bp, Homo sapiens; identical to SEQ ID NO: 783
  misc_feature 1..75: note = chr8:55371993-55372068
  misc_feature 1..75: note = hyper
  source 1..75: mol_type = genomic DNA

SEQ ID NO: 3259 - DNA, 60 bp, Homo sapiens; identical to SEQ ID NO: 784
  misc_feature 1..60: note = chr8:55372416-55372476
  misc_feature 1..60: note = hyper
  source 1..60: mol_type = genomic DNA

SEQ ID NO: 3260 - DNA, 29 bp, Homo sapiens
  misc_feature 1..29: note = chr8:55379202-55379231
  misc_feature 1..29: note = hyper
  source 1..29: mol_type = genomic DNA
ctcttagcttggtgccggggcccgcccgg

SEQ ID NO: 3261 - DNA, 162 bp, Homo sapiens
  misc_feature 1..162: note = chr8:55379295-55379457
  misc_feature 1..162: note = hyper
  source 1..162: mol_type = genomic DNA
cgcggtgcaccggctcaggggcctgcctgccgcgccaaggcttcggaagttctcagcgggaccgctgggacaggctttcctctgagggaagaggaggggatttgtgcctctgcacgttctttcctgtggaggggaaaatcaaaccctgtagccgtccgctgc

SEQ ID NO: 3262 - DNA, 108 bp, Homo sapiens
  misc_feature 1..108: note = chr8:55380036-55380144
  misc_feature 1..108: note = hyper
  source 1..108: mol_type = genomic DNA
cgccgggggaggcggagcgcggggaacccgggcgccgggaaccccggacgtgggagggctgggcttctgcgcggggagacgccgggcttggcgaacatcctcaagaac

SEQ ID NO: 3263 - DNA, 54 bp, Homo sapiens
  misc_feature 1..54: note = chr8:56014131-56014185
  misc_feature 1..54: note = hyper
  source 1..54: mol_type = genomic DNA
ccgagcccgggcgcccgagttacacccattctccccaccatcgtcggccagagc

SEQ ID NO: 3264 - DNA, 368 bp, Homo sapiens
  misc_feature 1..368: note = chr8:56014376-56014744
  misc_feature 1..368: note = hyper
  source 1..368: mol_type = genomic DNA
cgttccgaaatcccgggagtgggggccttcgactgtcaccctcaggcccccttggccgctcctcccggcccttgggacccgccagggcagtcccccaacccccgcccgccgctcctctcggtcccggcccctcctccgggtccctcctcctccctcgcccctcccgagccagggtgggagcgacggcagctggaagagaagggatgaggtcatcctctccctcggagtcagctggtggaggagaggaagcgggaggagggagcgcgcgcgaggggaggagaggaatgtgcaggtccgaggagcgccgcggcggccgctgctgctcctgctgctggcggcggcggcggctcgggcggcagcagcgaagc

SEQ ID NO: 3265 - DNA, 19 bp, Homo sapiens
  misc_feature 1..19: note = chr8:56015034-56015053
  misc_feature 1..19: note = hyper
  source 1..19: mol_type = genomic DNA
ggtgtggaggcatcatggc

SEQ ID NO: 3266 - DNA, 161 bp, Homo sapiens; identical to SEQ ID NO: 786
  misc_feature 1..161: note = chr8:56015185-56015346
  misc_feature 1..161: note = hyper
  source 1..161: mol_type = genomic DNA

SEQ ID NO: 3267 - DNA, 67 bp, Homo sapiens; identical to SEQ ID NO: 787
  misc_feature 1..67: note = chr8:56015565-56015632
  misc_feature 1..67: note = hyper
  source 1..67: mol_type = genomic DNA

SEQ ID NO: 3268 - DNA, 181 bp, Homo sapiens
  misc_feature 1..181: note = chr8:57026141-57026322
  misc_feature 1..181: note = hyper
  source 1..181: mol_type = genomic DNA
ggctattggaccctgcgggcgtgcgcgtgctggcagccaccacgcgcacgatgttatcgtggcgcagccttgctacgttgagctcagcccagaaactccgccgagatgctagtcggttcttggtgcacttgttcacttgctttatggccacaggaacaccgcggtaagtcgccttgtacac

SEQ ID NO: 3269 - DNA, 55 bp, Homo sapiens
  misc_feature 1..55: note = chr8:57026501-57026556
  misc_feature 1..55: note = hyper
  source 1..55: mol_type = genomic DNA
cgctccggaggtaggggcgtagggccaggggcgagggcatcgcactttgcagggg

SEQ ID NO: 3270 - DNA, 148 bp, Homo sapiens; identical to SEQ ID NO: 788
  misc_feature 1..148: note = chr8:57069590-57069738
  misc_feature 1..148: note = hyper
  source 1..148: mol_type = genomic DNA

SEQ ID NO: 3271 - DNA, 163 bp, Homo sapiens; identical to SEQ ID NO: 789
  misc_feature 1..163: note = chr8:57069850-57070013
  misc_feature 1..163: note = hyper
  source 1..163: mol_type = genomic DNA

SEQ ID NO: 3272 - DNA, 143 bp, Homo sapiens; identical to SEQ ID NO: 790
  misc_feature 1..143: note = chr8:57070014-57070157
  misc_feature 1..143: note = hyper
  source 1..143: mol_type = genomic DNA

SEQ ID NO: 3273 - DNA, 286 bp, Homo sapiens; identical to SEQ ID NO: 791
  misc_feature 1..286: note = chr8:57358806-57359092
  misc_feature 1..286: note = hyper
  source 1..286: mol_type = genomic DNA

SEQ ID NO: 3274 - DNA, 400 bp, Homo sapiens; identical to SEQ ID NO: 792
  misc_feature 1..400: note = chr8:57359259-57359659
  misc_feature 1..400: note = hyper
  source 1..400: mol_type = genomic DNA

SEQ ID NO: 3275 - DNA, 86 bp, Homo sapiens; identical to SEQ ID NO: 793
  misc_feature 1..86: note = chr8:57360540-57360626
  misc_feature 1..86: note = hyper
  source 1..86: mol_type = genomic DNA

SEQ ID NO: 3276 - DNA, 37 bp, Homo sapiens; identical to SEQ ID NO: 794
  misc_feature 1..37: note = chr8:57360769-57360806
  misc_feature 1..37: note = hyper
  source 1..37: mol_type = genomic DNA

SEQ ID NO: 3277 - DNA, 109 bp, Homo sapiens
  misc_feature 1..109: note = chr8:65282332-65282441
  misc_feature 1..109: note = hyper
  source 1..109: mol_type = genomic DNA
cggtgggggcagcggggcgaggcgaggtcgcagggagacgaccaggcctgcttgggcctgggccgctccagccgcctcgcctcttcagggacctcgccccgggaccacc

SEQ ID NO: 3278 - DNA, 170 bp, Homo sapiens
  misc_feature 1..170: note = chr8:65286942-65287112
  misc_feature 1..170: note = hyper
  source 1..170: mol_type = genomic DNA
agaaagtagccttctcgtgcccaagaaagtgtgaatcgctgaggctcggccccatggcctggcgtgggtgctgacctcagtttaaaaccaagggcctgttttcttaccgttggggtacttgtatcaaagcacagatatgaccggtttgtgcggatcggtgtcctccaaag

SEQ ID NO: 3279 - DNA, 724 bp, Homo sapiens
  misc_feature 1..724: note = chr8:65289592-65290316
  misc_feature 1..724: note = hyper
  source 1..724: mol_type = genomic DNA
gagaggctggaagctcgacgtcttagggagctgcctgcgggcactgggttgacgccaagaggttgtcggcaagggcagggctcttgccctctgctgtacctaggctctgcaactgggggctgcgagccttctgcggctctttggtttcaaggacacagcgagctgctcaggactttgggagccaacatctgtctgactggtgacgtcagcagcccgtgtaatcctcttgtgctgaaggcagatgccttatttgtttggctggagcgagccattaatccctaattctggatcagcaagcgagggggaaagaccggaccgctccgacccaccccctccctacccccacctcccaccttaaagcaccttataccacggaaggctctcagcctcttctttcctctgcgaacgcgctgagcagcgattgaaaacgttttggtcctctgcaggtttgaacagggctagcaggtctctctccggatttctagggctatgggtatatgtaattctttctctcatcgatcgtttcgattctcttgccggtcttgcagtttgcagggtcctaaacgaagaggggtggagattcgagagtgcgggtctggcgtgtggtccaagggagggggtgaggctgggaaagggggtgcagaatgcgggaacggctgggactgcacagaaggaccatctgcggactcgttttcactgctccagctcccgaaatcgtttctct

SEQ ID NO: 3280 - DNA, 51 bp, Homo sapiens
  misc_feature 1..51: note = chr8:65488271-65488322
  misc_feature 1..51: note = hyper
  source 1..51: mol_type = genomic DNA
cttgtgtgtgcacctcgcgctgagaaggctgcctcccggggctcagggttt

SEQ ID NO: 3281 - DNA, 84 bp, Homo sapiens
  misc_feature 1..84: note = chr8:65492776-65492860
  misc_feature 1..84: note = hyper
  source 1..84: mol_type = genomic DNA
aactattcagacttgcggccagatagcgcctgcgattgtttgttaccgttttaatcctattaattaaaacgttaacctgattgg

SEQ ID NO: 3282 - DNA, 384 bp, Homo sapiens
  misc_feature 1..384: note = chr8:65493195-65493579
  misc_feature 1..384: note = hyper
  source 1..384: mol_type = genomic DNA
aggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 3283 - DNA, 149 bp, Homo sapiens
  misc_feature 1..149: note = chr8:65493806-65493955
  misc_feature 1..149: note = hyper
  source 1..149: mol_type = genomic DNA
ggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcgg

SEQ ID NO: 3284 - DNA, 25 bp, Homo sapiens
  misc_feature 1..25: note = chr8:65494076-65494101
  misc_feature 1..25: note = hyper
  source 1..25: mol_type = genomic DNA
cggcttaacatcaatgcccgagagc

SEQ ID NO: 3285 - DNA, 91 bp, Homo sapiens
  misc_feature 1..91: note = chr8:65494102-65494193
  misc_feature 1..91: note = hyper
  source 1..91: mol_type = genomic DNA
ccggcggatgcacgacctgaacgacgcgctggacgagctgcgcgcggtgatcccctacgcgcacagcccctcggtgcgaaagctctccaag

SEQ ID NO: 3286 - DNA, 173 bp, Homo sapiens
  misc_feature 1..173: note = chr8:65499750-65499923
  misc_feature 1..173: note = hyper
  source 1..173: mol_type = genomic DNA
tccacgcagcactcgcgcccaccgcgctgtttttgcttgcgcagtgctcccgaagggattcgggatccgcatccggagggattcgggatccgcatccgaagagcaccccttctctcaggacttcccctgggaccgacgtttccagtcacccctgcgggcgcaattgtccttca

SEQ ID NO: 3287 - DNA, 95 bp, Homo sapiens; identical to SEQ ID NO: 795
  misc_feature 1..95: note = chr8:67873327-67873422
  misc_feature 1..95: note = hyper
  source 1..95: mol_type = genomic DNA

SEQ ID NO: 3288 - skipped

SEQ ID NO: 3289 - DNA, 251 bp, Homo sapiens; identical to SEQ ID NO: 797
  misc_feature 1..251: note = chr8:67873800-67874051
  misc_feature 1..251: note = hyper
  source 1..251: mol_type = genomic DNA

SEQ ID NO: 3290 - DNA, 509 bp, Homo sapiens; identical to SEQ ID NO: 798
  misc_feature 1..509: note = chr8:67874164-67874673
  misc_feature 1..509: note = hyper
  source 1..509: mol_type = genomic DNA

SEQ ID NO: 3291 - DNA, 103 bp, Homo sapiens; identical to SEQ ID NO: 799
  misc_feature 1..103: note = chr8:67874755-67874858
  misc_feature 1..103: note = hyper
  source 1..103: mol_type = genomic DNA

SEQ ID NO: 3292 - DNA, 402 bp, Homo sapiens; identical to SEQ ID NO: 800
  misc_feature 1..402: note = chr8:67874859-67875261
  misc_feature 1..402: note = hyper
  source 1..402: mol_type = genomic DNA

SEQ ID NO: 3293 - DNA, 179 bp, Homo sapiens; identical to SEQ ID NO: 801
  misc_feature 1..179: note = chr8:67875262-67875441
  misc_feature 1..179: note = hyper
  source 1..179: mol_type = genomic DNA

SEQ ID NO: 3294 - DNA, 240 bp, Homo sapiens; identical to SEQ ID NO: 802
  misc_feature 1..240: note = chr8:67875442-67875682
  misc_feature 1..240: note = hyper
  source 1..240: mol_type = genomic DNA

SEQ ID NO: 3295 - DNA, 159 bp, Homo sapiens
  misc_feature 1..159: note = chr8:67940805-67940964
  misc_feature 1..159: note = hyper
  source 1..159: mol_type = genomic DNA
tgctgggcgaccagacgcgctgtccaagcgccgctcacgagaaatctcgcgacatcgcaggctgctccctccccggtgggtccttcccctgtgaggcggcggccgggcgctgatgggcactgacggtggtcactaggccgactccgactagagtcctgt

SEQ ID NO: 3296 - DNA, 258 bp, Homo sapiens
  misc_feature 1..258: note = chr8:68864545-68864803
  misc_feature 1..258: note = hyper
  source 1..258: mol_type = genomic DNA
cgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtcc

SEQ ID NO: 3297 - DNA, 202 bp, Homo sapiens
  misc_feature 1..202: note = chr8:69243284-69243486
  misc_feature 1..202: note = hyper
  source 1..202: mol_type = genomic DNA
cggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttc

SEQ ID NO: 3298 - DNA, 329 bp, Homo sapiens
  misc_feature 1..329: note = chr8:69243487-69243816
  misc_feature 1..329: note = hyper
  source 1..329: mol_type = genomic DNA
cggtcccatctgttccccatggcgtctcatccgcaaacccggatccaggcttacctggagaagaacaagatcggtcccctgtttgaggtaaggcgctgtggaggagggcagtcccgttgtctttaggggaaggggtgcagtaatgaaaacagaacactcccaatcccacccctcccagggaaggagggctagagaaccaacgcgcgggagagggcgccctgggattcactggcattcgctctgtcccggccaggtgtcctggaacgcggccgggcgggcacttagccagttacctgaacgcggacaggtgagctcgggagggcccagcc

SEQ ID NO: 3299 - DNA, 71 bp, Homo sapiens
  misc_feature 1..71: note = chr8:70946844-70946915
  misc_feature 1..71: note = hyper
  source 1..71: mol_type = genomic DNA
atccactctccctttcgcctccctagaggttgtcaggttcaagaagcggcccggagttgcaggaagggcgc

SEQ ID NO: 3300 - DNA, 568 bp, Homo sapiens
  misc_feature 1..568: note = chr8:70947090-70947658
  misc_feature 1..568: note = hyper
  source 1..568: mol_type = genomic DNA
ggcgtccatgtgttctgcaccccttctcgcccggtgcctctctcaaggcacgttttccaaagtgtgttgaattcgggaatcgatcgaaaatttcaaggccaattaaatgccctctgatgtagagctccgattaggcccgaaaggcttcaaacagcccctctagaccctcgagggtcttcgccgcggtaaccttaggcgtcccctccccgagaagtctccctgaggctttcacagagggcgggaggggctgcgctggggcctccgttcccagtgcccctgactggtggggagggatggccttagtgtctgagagcagagaccagattgactcccacttgagaccagaaaacgaagaggaagcggaacccgaggtggctgcggctcccccgggacacaaccgggagaggaagtcctggccatctgccggccccgcctgggggcatctgctcgaggatccctgggagccgttatcgtattcctcagaatctgccgtgctgtccctccgcccccaaaaccaacaggacacccattctgtgattctcttcttctccatcgcccagttggaggc

SEQ ID NO: 3301 - DNA, 23 bp, Homo sapiens
  misc_feature 1..23: note = chr8:70982262-70982285
  misc_feature 1..23: note = hyper
  source 1..23: mol_type = genomic DNA
cgctcccacaattaagacaaaac

SEQ ID NO: 3302 - DNA, 281 bp, Homo sapiens; identical to SEQ ID NO: 804
  misc_feature 1..281: note = chr8:70982286-70982567
  misc_feature 1..281: note = hyper
  source 1..281: mol_type = genomic DNA

SEQ ID NO: 3303 - DNA, 397 bp, Homo sapiens; identical to SEQ ID NO: 805
  misc_feature 1..397: note = chr8:70982850-70983247
  misc_feature 1..397: note = hyper
  source 1..397: mol_type = genomic DNA

SEQ ID NO: 3304 - DNA, 302 bp, Homo sapiens; identical to SEQ ID NO: 806
  misc_feature 1..302: note = chr8:70983568-70983870
  misc_feature 1..302: note = hyper
  source 1..302: mol_type = genomic DNA

SEQ ID NO: 3305 - DNA, 277 bp, Homo sapiens; identical to SEQ ID NO: 807
  misc_feature 1..277: note = chr8:70984016-70984293
  misc_feature 1..277: note = hyper
  source 1..277: mol_type = genomic DNA

SEQ ID NO: 3306 - DNA, 319 bp, Homo sapiens; identical to SEQ ID NO: 808
  misc_feature 1..319: note = chr8:70984343-70984662
  misc_feature 1..319: note = hyper
  source 1..319: mol_type = genomic DNA

SEQ ID NO: 3307 - DNA, 250 bp, Homo sapiens; identical to SEQ ID NO: 809
  misc_feature 1..250: note = chr8:70984744-70984994
  misc_feature 1..250: note = hyper
  source 1..250: mol_type = genomic DNA

SEQ ID NO: 3308 - DNA, 78 bp, Homo sapiens; identical to SEQ ID NO: 810
  misc_feature 1..78: note = chr8:72460433-72460511
  misc_feature 1..78: note = hyper
  source 1..78: mol_type = genomic DNA

SEQ ID NO: 3309 - DNA, 557 bp, Homo sapiens
  misc_feature 1..557: note = chr8:72468582-72469139
  misc_feature 1..557: note = hyper
  source 1..557: mol_type = genomic DNA
tgcggatcactcctgcgggcgctcgctctctccacgccgccgcccgcgcgcccgcggcagccacgagcgtcccgggcggggaaacgcgttgcctcccggcggcgcctattactagcagctgcttctgcttagcccttcgaggatcggtttgccccaacccacggcctctcccagggttcggtcttctcccgcccctccctcccttccccgcctctcccccaagctcctcagtggccgcggcccgtcaacactgtcgcgcagtcactggcgcaggttcccagctctcagctgggggtttcggggggagggagcagaaggaatgagacagaaggaacgggaggctttaagcccaccgagggaggttagaggaaggcgctgtggctgtgggattaggaggccacagacgggaaccgcgccgagctagactagctgtagaaggctgtctctccaccccgccacagcgctccgagaaggagcgggaggcctgggcaggggagaggcgctcctgcccccacccgcgccctgctggccacctgtggcgtcggggagaccacctg

SEQ ID NO: 3310 - DNA, 345 bp, Homo sapiens; identical to SEQ ID NO: 811
  misc_feature 1..345: note = chr8:72755470-72755815
  misc_feature 1..345: note = hyper
  source 1..345: mol_type = genomic DNA

SEQ ID NO: 3311 - DNA, 157 bp, Homo sapiens; identical to SEQ ID NO: 812
  misc_feature 1..157: note = chr8:72756655-72756812
  misc_feature 1..157: note = hyper
  source 1..157: mol_type = genomic DNA

SEQ ID NO: 3312 - DNA, 83 bp, Homo sapiens; identical to SEQ ID NO: 813
  misc_feature 1..83: note = chr8:72756813-72756896
  misc_feature 1..83: note = hyper
  source 1..83: mol_type = genomic DNA

SEQ ID NO: 3313 - DNA, 316 bp, Homo sapiens
  misc_feature 1..316: note = chr8:72987600-72987916
  misc_feature 1..316: note = hyper
  source 1..316: mol_type = genomic DNA
ttcttttctccagggcgccacatcttcctcaggctgcgcttcattgaccccaccccggacgccacctggtgcagctgctcaccacgcgcgcgggcacctggggcgagagagcgctgtcagcctgccaggcgctggggtccgcgcgagcccgagctctcccgcgctgcagctcacaggcagcgaaaaagtcgctctgcggaagccctggagaacttctggaaggagttctcaggcccgcgctacttttgtagtgcaggaagcaggcggggcgcggagaggaggtagaaacgcggagctccttcgcaaagagggcggc

SEQ ID NO: 3314 - DNA, 119 bp, Homo sapiens
  misc_feature 1..119: note = chr8:72987917-72988036
  misc_feature 1..119: note = hyper
  source 1..119: mol_type = genomic DNA
gcgccgcgtctgccttggactcgccccttcagggacaaagtgactcgcccgtcccgctgtcctgcagctgcagcagcgcactgacggagtcaagcgtgtcaggtcggggtggattgcag

SEQ ID NO: 3315 - DNA, 153 bp, Homo sapiens
  misc_feature 1..153: note = chr8:73449802-73449955
  misc_feature 1..153: note = hyper
  source 1..153: mol_type = genomic DNA
gaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagc

SEQ ID NO: 3316 - DNA, 90 bp, Homo sapiens
  misc_feature 1..90: note = chr8:73450026-73450116
  misc_feature 1..90: note = hyper
  source 1..90: mol_type = genomic DNA
cggggagaggctccccggagggagcggggaatcccacagccctttgtggtgcccgagcccgtgccgcctgctgagcggggtctgtgggag

SEQ ID NO: 3317 - DNA, 262 bp, Homo sapiens
  misc_feature 1..262: note = chr8:75896574-75896836
  misc_feature 1..262: note = hyper
  source 1..262: mol_type = genomic DNA
gccctggcttcgctgcgttccggagaagcagggcgggctgcttctcccggatctggcgggcctctggccacggctggttggaggtgggggtgggcgaggaggggcgctcaagtcacgtgcccgcgctggggccgcaataaatgctcgcgaacgcgagagagcgacggaagcgctaggcgcctggttctgcgcgtactggctgtacggagcaggagcaagaggtcgccgccagcctccgccgccgagcctcgttcgtgtcccc

SEQ ID NO: 3318 - DNA, 364 bp, Homo sapiens
  misc_feature 1..364: note = chr8:75896837-75897201
  misc_feature 1..364: note = hyper
  source 1..364: mol_type = genomic DNA
cccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagaggtaagggcgattctaaaatgcatcgctgagtcgtcaagctgccacc

SEQ ID NO: 3319 - DNA, 156 bp, Homo sapiens
  misc_feature 1..156: note = chr8:77585219-77585375
  misc_feature 1..156: note = hyper
  source 1..156: mol_type = genomic DNA
agcgggaagaggcagcggccacagcgaatttcagcggcagctgcagcagctagaaacaagaagcaagagtacgaggtctttaggctgcgtccccctcccgcagtcagggctgccagtgagggaaagagaagaaagggtggacggttgaaatggtga

SEQ ID NO: 3320 - DNA, 165 bp, Homo sapiens
  misc_feature 1..165: note = chr8:77586175-77586340
  misc_feature 1..165: note = hyper
  source 1..165: mol_type = genomic DNA
agttcaggctcccagcgtaaggaaaggaggaaacgacaagaatccctaagagaaaaagaggaaaaagctgtgtgctgctgaggcggggcgtgggaagacaaccacagtcaattggaaggagcccgagtcagggagcaattgctaggacttcggacagagagggca

SEQ ID NO: 3321 - DNA, 293 bp, Homo sapiens
  misc_feature 1..293: note = chr8:77590239-77590532
  misc_feature 1..293: note = hyper
  source 1..293: mol_type = genomic DNA
agtcagggtcaaaggcgtccgcggagacccgagaggagcagctgggtttcctggcgctgggagcccagaagtagggcgcaagcggccgcggcacagcggagcagccaggtccagccgctcggatcgcgctcgcgccccatagcggcccgcgggctgggctcgggctcgcccgcctccccgctcccctgccagcggcgccgcgctccgcgccccggggcccaccccacgcagtcccgccgccgcttcagcccaacagccctcctcacgctggcgcgctccgaggccaagccctg

SEQ ID NO: 3322 - DNA, 490 bp, Homo sapiens
  misc_feature 1..490: note = chr8:80523960-80524450
  misc_feature 1..490: note = hyper
  source 1..490: mol_type = genomic DNA
actgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgcccccccgcccggtgctgcatcttcattcgaaagggggtcgggtggggagcgcagcgtgacacccaggagcccaaccctgcggggacagcggcgccacgccccgcgctccccgctcccgactccccgccgcggcttccaagagag

SEQ ID NO: 3323 - DNA, 164 bp, Homo sapiens
  misc_feature 1..164: note = chr8:80803593-80803757
  misc_feature 1..164: note = hyper
  source 1..164: mol_type = genomic DNA
actctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggag

SEQ ID NO: 3324 - DNA, 199 bp, Homo sapiens
  misc_feature 1..199: note = chr8:81478156-81478355
  misc_feature 1..199: note = hyper
  source 1..199: mol_type = genomic DNA
cgtctttcctcctatcgtatgttacggttacctgcagaggctggcgtcgaaggagaggtgctatgcgaggatggccccaagttaaacagtgacagcctctgccctcccagaccccaggcgcgcgggggcgggcgcggaacaccggttccaccgccaccttcaggcctcccggtgtggcgcggttcgggacgtcacacaa

SEQ ID NO: 3325 - DNA, 448 bp, Homo sapiens; identical to SEQ ID NO: 814
  misc_feature 1..448: note = chr8:91997061-91997509
  misc_feature 1..448: note = hyper
  source 1..448: mol_type = genomic DNA

SEQ ID NO: 3326 - DNA, 479 bp, Homo sapiens; identical to SEQ ID NO: 815
  misc_feature 1..479: note = chr8:91997527-91998006
  misc_feature 1..479: note = hyper
  source 1..479: mol_type = genomic DNA

SEQ ID NO: 3327 - DNA, 202 bp, Homo sapiens; identical to SEQ ID NO: 816
  misc_feature 1..202: note = chr8:97157008-97157210
  misc_feature 1..202: note = hyper
  source 1..202: mol_type = genomic DNA

SEQ ID NO: 3328 - DNA, 232 bp, Homo sapiens; identical to SEQ ID NO: 817
  misc_feature 1..232: note = chr8:97157666-97157898
  misc_feature 1..232: note = hyper
  source 1..232: mol_type = genomic DNA

SEQ ID NO: 3329 - DNA, 122 bp, Homo sapiens; identical to SEQ ID NO: 818
  misc_feature 1..122: note = chr8:97158021-97158143
  misc_feature 1..122: note = hyper
  source 1..122: mol_type = genomic DNA

SEQ ID NO: 3330 - DNA, 204 bp, Homo sapiens; identical to SEQ ID NO: 819
  misc_feature 1..204: note = chr8:97169716-97169920
  misc_feature 1..204: note = hyper
  source 1..204: mol_type = genomic DNA

SEQ ID NO: 3331 - DNA, 13 bp, Homo sapiens
  misc_feature 1..13: note = chr8:97169921-97169934
  misc_feature 1..13: note = hyper
  source 1..13: mol_type = genomic DNA
gaagtccttgcca

SEQ ID NO: 3332 - DNA, 180 bp, Homo sapiens; identical to SEQ ID NO: 821
  misc_feature 1..180: note = chr8:97170158-97170338
  misc_feature 1..180: note = hyper
  source 1..180: mol_type = genomic DNA

SEQ ID NO: 3333 - DNA, 291 bp, Homo sapiens; identical to SEQ ID NO: 822
  misc_feature 1..291: note = chr8:97170377-97170668
  misc_feature 1..291: note = hyper
  source 1..291: mol_type = genomic DNA

SEQ ID NO: 3334 - DNA, 65 bp, Homo sapiens
  misc_feature 1..65: note = chr8:97171119-97171184
  misc_feature 1..65: note = hyper
  source 1..65: mol_type = genomic DNA
gaacctcgctgacctcgggctgcagcggcgagaccctcgagcaaggaacgcgactatgagtgaga

SEQ ID NO: 3335 - DNA, 361 bp, Homo sapiens; identical to SEQ ID NO: 823
  misc_feature 1..361: note = chr8:97171598-97171959
  misc_feature 1..361: note = hyper
  source 1..361: mol_type = genomic DNA

SEQ ID NO: 3336 - DNA, 722 bp, Homo sapiens; identical to SEQ ID NO: 824
  misc_feature 1..722: note = chr8:97172018-97172740
  misc_feature 1..722: note = hyper
  source 1..722: mol_type = genomic DNA

SEQ ID NO: 3337 - DNA, 50 bp, Homo sapiens; identical to SEQ ID NO: 825
  misc_feature 1..50: note = chr8:97172821-97172871
  misc_feature 1..50: note = hyper
  source 1..50: mol_type = genomic DNA

SEQ ID NO: 3338 - DNA, 388 bp, Homo sapiens; identical to SEQ ID NO: 826
  misc_feature 1..388: note = chr8:97173138-97173526
  misc_feature 1..388: note = hyper
  source 1..388: mol_type = genomic DNA

SEQ ID NO: 3339 - DNA, 13 bp, Homo sapiens
  misc_feature 1..13: note = chr8:97173527-97173540
  misc_feature 1..13: note = hyper
  source 1..13: mol_type = genomic DNA
gtggtaccctccc

SEQ ID NO: 3340 - DNA, 231 bp, Homo sapiens
  misc_feature 1..231: note = chr8:97506177-97506408
  misc_feature 1..231: note = hyper
  source 1..231: mol_type = genomic DNA
cgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggatt

SEQ ID NO: 3341 - DNA, 38 bp, Homo sapiens
  misc_feature 1..38: note = chr8:97506447-97506485
  misc_feature 1..38: note = hyper
  source 1..38: mol_type = genomic DNA
cgttttgccctggttgcaagcagcggctgggagcagcc

SEQ ID NO: 3342 - DNA, 580 bp, Homo sapiens
  misc_feature 1..580: note = chr8:97507115-97507695
  misc_feature 1..580: note = hyper
  source 1..580: mol_type = genomic DNA
gtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcgccctctaaagggaactgcctccttggcctcctctcgtccgcagctgcctccacctgggcgccaggagctctgtcgggccaggtggaag

SEQ ID NO: 3343 - DNA, 50 bp, Homo sapiens; identical to SEQ ID NO: 828
  misc_feature 1..50: note = chr8:98289818-98289868
  misc_feature 1..50: note = hyper
  source 1..50: mol_type = genomic DNA

SEQ ID NO: 3344 - DNA, 425 bp, Homo sapiens; identical to SEQ ID NO: 829
  misc_feature 1..425: note = chr8:98289922-98290347
  misc_feature 1..425: note = hyper
  source 1..425: mol_type = genomic DNA

SEQ ID NO: 3345 - DNA, 660 bp, Homo sapiens; identical to SEQ ID NO: 830
  misc_feature 1..660: note = chr8:99439694-99440354
  misc_feature 1..660: note = hyper
  source 1..660: mol_type = genomic DNA

SEQ ID NO: 3346 - DNA, 298 bp, Homo sapiens; identical to SEQ ID NO: 831
  misc_feature 1..298: note = chr8:99951846-99952144
  misc_feature 1..298: note = hyper
  source 1..298: mol_type = genomic DNA

SEQ ID NO: 3347 - DNA, 106 bp, Homo sapiens; identical to SEQ ID NO: 832
  misc_feature 1..106: note = chr8:99952198-99952304
  misc_feature 1..106: note = hyper
  source 1..106: mol_type = genomic DNA

SEQ ID NO: 3348 - DNA, 319 bp, Homo sapiens; identical to SEQ ID NO: 833
  misc_feature 1..319: note = chr8:99952532-99952851
  misc_feature 1..319: note = hyper
  source 1..319: mol_type = genomic DNA

SEQ ID NO: 3349 - DNA, 178 bp, Homo sapiens; identical to SEQ ID NO: 834
  misc_feature 1..178: note = chr8:99985866-99986044
  misc_feature 1..178: note = hyper
  source 1..178: mol_type = genomic DNA

SEQ ID NO: 3350 - DNA, 302 bp, Homo sapiens; identical to SEQ ID NO: 835
  misc_feature 1..302: note = chr8:99986225-99986527
  misc_feature 1..302: note = hyper
  source 1..302: mol_type = genomic DNA

SEQ ID NO: 3351 - DNA, 165 bp, Homo sapiens; identical to SEQ ID NO: 836
  misc_feature 1..165: note = chr8:99986791-99986956
  misc_feature 1..165: note = hyper
  source 1..165: mol_type = genomic DNA

SEQ ID NO: 3352 - DNA, 133 bp, Homo sapiens
  misc_feature 1..133: note = chr8:101821973-101822106
  misc_feature 1..133: note = hyper
  source 1..133: mol_type = genomic DNA
tgattggtgcagagacgctgtaaacgcacctttgcggaacacagacgacacaggaaagacgtttggcagtaatactacgacagcgaggggcccgggaagcccgcggaaacgcaggaggcggccaggagaggca

SEQ ID NO: 3353 - DNA, 930 bp, Homo sapiens
  misc_feature 1..930: note = chr8:104512023-104512953
  misc_feature 1..930: note = hyper
  source 1..930: mol_type = genomic DNA
gggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctcccc

SEQ ID NO: 3354 - DNA, 504 bp, Homo sapiens
  misc_feature 1..504: note = chr8:104513405-104513909
  misc_feature 1..504: note = hyper
  source 1..504: mol_type = genomic DNA
aggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctc

SEQ ID NO: 3355 - DNA, 16 bp, Homo sapiens
  misc_feature 1..16: note = chr8:104513910-104513926
  misc_feature 1..16: note = hyper
  source 1..16: mol_type = genomic DNA
gcgagtgctaacaccc

SEQ ID NO: 3356 - DNA, 253 bp, Homo sapiens
  misc_feature 1..253: note = chr8:105235249-105235502
  misc_feature 1..253: note = hyper
  source 1..253: mol_type = genomic DNA
cctgtgtttgaggagcgttaaaaaaaactgtgaacctgaggaaagggaaagtgactaccagaaatttaccggtttacttatctgagatgcctaactcactgcatctaattagtcaccactccctggccttaaccacgcggagggaagaggaaacagcaggagctactcggagcagctgcccgggacctgaggcgcgcgccccggagccaccagcccaccgaggtgcagccgcgccgccacctccccctccggc

SEQ ID NO: 3357 - DNA, 952 bp, Homo sapiens
  misc_feature 1..952: note = chr8:109094485-109095437
  misc_feature 1..952: note = hyper
  source 1..952: mol_type = genomic DNA
cggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtct

SEQ ID NO: 3358 - skipped

SEQ ID NO: 3359 - DNA, 117 bp, Homo sapiens
  misc_feature 1..117: note = chr8:110703765-110703882
  misc_feature 1..117: note = hyper
  source 1..117: mol_type = genomic DNA
gcgctccggtgccctcggcccctcggcctctgcagccagccgggcggctgctggggctgaggacaaaatggagagaagggcgggggaccaaagggcaggcaccgctgggtggggcgc

SEQ ID NO: 3360 - DNA, 408 bp, Homo sapiens; identical to SEQ ID NO: 837
  misc_feature 1..408: note = chr8:114444784-114445192
  misc_feature 1..408: note = hyper
  source 1..408: mol_type = genomic DNA

SEQ ID NO: 3361 - DNA, 179 bp, Homo sapiens
  misc_feature 1..179: note = chr8:114446958-114447137
  misc_feature 1..179: note = hyper
  source 1..179: mol_type = genomic DNA
tccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggc

SEQ ID NO: 3362 - DNA, 23 bp, Homo sapiens
  misc_feature 1..23: note = chr8:116660615-116660638
  misc_feature 1..23: note = hyper
  source 1..23: mol_type = genomic DNA
cgataacacgcccacagcccggg

SEQ ID NO: 3363 - DNA, 139 bp, Homo sapiens
  misc_feature 1..139: note = chr8:117950379-117950518
  misc_feature 1..139: note = hyper
  source 1..139: mol_type = genomic DNA
tccttgaattacctccgcccccgccctgaccccgccctaaacatcaaacttagaaactcatctttcagcagcagcggtagagcagtgaccaggcgtctccgcgatgggccccggggacttccgccgctgcagagagaga

SEQ ID NO: 3364 - DNA, 173 bp, Homo sapiens
  misc_feature 1..173: note = chr8:117950779-117950952
  misc_feature 1..173: note = hyper
  source 1..173: mol_type = genomic DNA
accctggccaggctgcgggcggagctggtgagagagcgggctaggcggacggctcccagggctccctctcccgggtcctctcctccagctgcagagccgctggccgcgtagcccacccgacgccttggggggcccctcaggtctggacacggcgttgacgcccccgcctcccc

SEQ ID NO: 3365 - DNA, 297 bp, Homo sapiens
  misc_feature 1..297: note = chr8:121137130-121137427
  misc_feature 1..297: note = hyper
  source 1..297: mol_type = genomic DNA
cgcacctggggggaccgccaggttcggggtaggcgagcgcgtgagcggcacggggctggcttctccacatctccggtagggcggggatgggggagaggaggaggagagaaagtgggggcgttatgggcttaggcctgcctcccacctccccacctcccgcctccgcggccaccctccgctctataattggctgccggcgggccttcctttcctcttatctgatcctgggctcccagctggagaggcggaggcagctccagggggctggaagtggaagcgcagcggcagaaggagagg

SEQ ID NO: 3366 - DNA, 45 bp, Homo sapiens
  misc_feature 1..45: note = chr8:121137638-121137683
  misc_feature 1..45: note = hyper
  source 1..45: mol_type = genomic DNA
gaaaagtggaggcagcgagccacctgcagacgcaatgcagttcca

SEQ ID NO: 3367 - DNA, 295 bp, Homo sapiens
  misc_feature 1..295: note = chr8:132052005-132052300
  misc_feature 1..295: note = hyper
  source 1..295: mol_type = genomic DNA
tcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccag

SEQ ID NO: 3368 - DNA, 118 bp, Homo sapiens
  misc_feature 1..118: note = chr8:132052398-132052516
  misc_feature 1..118: note = hyper
  source 1..118: mol_type = genomic DNA
cgctgccgctgcctccccggtgcccgtgaatgaagcgctgctccgtgatgtgtcgcaccgccgtctgccacagcagccgctgcggccgggaggcgctcctgccgtcgccggccggggg

SEQ ID NO: 3369 - DNA, 367 bp, Homo sapiens
  misc_feature 1..367: note = chr8:132052589-132052956
  misc_feature 1..367: note = hyper
  source 1..367: mol_type = genomic DNA
cgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctct

SEQ ID NO: 3370 - DNA, 777 bp, Homo sapiens; identical to SEQ ID NO: 838
  misc_feature 1..777: note = chr8:132053807-132054584
  misc_feature 1..777: note = hyper
  source 1..777: mol_type = genomic DNA

SEQ ID NO: 3371 - DNA, 164 bp, Homo sapiens; identical to SEQ ID NO: 839
  misc_feature 1..164: note = chr8:132054593-132054757
  misc_feature 1..164: note = hyper
  source 1..164: mol_type = genomic DNA

SEQ ID NO: 3372 - DNA, 293 bp, Homo sapiens; identical to SEQ ID NO: 840
  misc_feature 1..293: note = chr8:140714570-140714863
  misc_feature 1..293: note = hyper
  source 1..293: mol_type = genomic DNA

SEQ ID NO: 3373 - skipped

SEQ ID NO: 3374 - DNA, 958 bp, Homo sapiens
  misc_feature 1..958: note = chr8:143532541-143533499
  misc_feature 1..958: note = hyper
  source 1..958: mol_type = genomic DNA
cgaagcgatgcgaccgggagggcttgacggaggctgcggctccgagcccgcgtccctcctcctggccgcggcggctcctgcttggccactccccggcagcctgaagagaacgcctaatctggcaccccagccccaggccgctgggcaccttacccctttccacttttattttgggcttctaagtttcttggagcgcaggcgcctaggctgggacccgaagagccctaagccagccctctttcagcacccgtccccgccgcgacctccccgttcttcctccgggtctggggcgcagattcctgggctgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccac

SEQ ID NO: 3375 - DNA, 141 bp, Homo sapiens
  misc_feature 1..141: note = chr8:143533500-143533641
  misc_feature 1..141: note = hyper
  source 1..141: mol_type = genomic DNA
ccctcccttcggctcgctagctgctccttggcgctgctttcagacttgttgcgcctcgatctggggggcagaaggctggcccgggagacccggcggctgagggccgagccgcgaagcccagggatgcgccagagaggcgcg

SEQ ID NO: 3376 - DNA, 343 bp, Homo sapiens
  misc_feature 1..343: note = chr8:143533708-143534051
  misc_feature 1..343: note = hyper
  source 1..343: mol_type = genomic DNA
cgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcgg

SEQ ID NO: 3377 - DNA, 153 bp, Homo sapiens
  misc_feature 1..153: note = chr8:144241281-144241434
  misc_feature 1..153: note = hyper
  source 1..153: mol_type = genomic DNA
atccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 3378 - DNA, 87 bp, Homo sapiens
  misc_feature 1..87: note = chr8:144241435-144241522
  misc_feature 1..87: note = hyper
  source 1..87: mol_type = genomic DNA
ggagcgggtgggacctgccactggggggaggggcgcgtgccaggtccccacccccacccctgggctggggggccgggaaccccgggc

SEQ ID NO: 3379 - DNA, 292 bp, Homo sapiens
  misc_feature 1..292: note = chr8:144241871-144242163
  misc_feature 1..292: note = hyper
  source 1..292: mol_type = genomic DNA
gcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcct

SEQ ID NO: 3380 - DNA, 317 bp, Homo sapiens
  misc_feature 1..317: note = chr8:144328254-144328571
  misc_feature 1..317: note = hyper
  source 1..317: mol_type = genomic DNA
gacggctcgccagggcgcgcacgcggtggcggcggcggtggaggcgttgcccgcctagctaggggcccgcggcctggagaggcgtcggttctccttccgcgctgaaggcggagacagcgacttcccgtggaggcaagccgtgggcgccgcggaggcgggggctgggggtcggcggaggcgggagctgggggtcggcgggggctgggggttggcggggagcgtcctcagggacaagtctcccagcacgcggccgcgacctccccgttgggggtctggagccaggagcccacgcgcgtcggatccggagagtctggtgg

SEQ ID NO: 3381 - DNA, 933 bp, Homo sapiens
  misc_feature 1..933: note = chr8:144511184-144512117
  misc_feature 1..933: note = hyper
  source 1..933: mol_type = genomic DNA
tctaggctggcagggcgaaggtgggaacggagaaccacgttcaacgtatgtacaagcggacgcttggaaagaagttagacctggctcaagtttccttagaaatcaccgttctccgctcaacctcaggacggcgacccgggccgacgcgcgcgaacggggaccgggagcgaaggggcctccagccccgcgcccgcagacttggcaccggggccagcacggccgggccgggcctggtgtccacgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgtcgtccgctccgccgccgcccgcgaagcccgggccgcggaaagcctcgtaggctgcggcggccgccgggtggtgcgc

SEQ ID NO: 3382 - DNA, 84 bp, Homo sapiens; identical to SEQ ID NO: 841
  misc_feature 1..84: note = chr9:117876-117960
  misc_feature 1..84: note = hyper
  source 1..84: mol_type = genomic DNA

SEQ ID NO: 3383 - DNA, 144 bp, Homo sapiens
  misc_feature 1..144: note = chr9:841706-841850
  misc_feature 1..144: note = hyper
  source 1..144: mol_type = genomic DNA
cgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgac

SEQ ID NO: 3384 - DNA, 181 bp, Homo sapiens
  misc_feature 1..181: note = chr9:841851-842032
  misc_feature 1..181: note = hyper
  source 1..181: mol_type = genomic DNA
aggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgc

SEQ ID NO: 3385 - skipped

SEQ ID NO: 3386 - DNA, 30 bp, Homo sapiens; identical to SEQ ID NO: 842
  misc_feature 1..30: note = chr9:970195-970225
  misc_feature 1..30: note = hyper
  source 1..30: mol_type = genomic DNA

SEQ ID NO: 3387 - DNA, 414 bp, Homo sapiens; identical to SEQ ID NO: 843
  misc_feature 1..414: note = chr9:972345-972759
  misc_feature 1..414: note = hyper
  source 1..414: mol_type = genomic DNA

SEQ ID NO: 3388 - DNA, 175 bp, Homo sapiens
  misc_feature 1..175: note = chr9:1042326-1042501
  misc_feature 1..175: note = hyper
  source 1..175: mol_type = genomic DNA
tggaagggtctgacacggaatctgaccaaggctggaccctcaataattgtgatttcttttcccccttttccttcttggtaaaatcatcccacgaatctacgcaagtagggcccttcgtcattcttcggagtagccgcttgagggctggaaggagcagtgatagaaaccccagaga

SEQ ID NO: 3389 - DNA, 328 bp, Homo sapiens
  misc_feature 1..328: note = chr9:1042615-1042943
  misc_feature 1..328: note = hyper
  source 1..328: mol_type = genomic DNA
cggaagccgggggcgctgggtctcaggcccggatgctgagcgcggaccggcgtgtcctccccacagcgcccccgcgcggcctcctcccgctgcgccccgcacggcgacccgccgcgggtagccctggcgtttggccacgccgtcggctgaggaccgctagagctggggggagatcaaagcattcctatggggcccaaagagcctgggattgcagtgttgttagcctggcctcgccgcgtcaataaattttcggcgaaagttgggagcaggagtggaggcttggggcgggggttggtggggcgcgggggttggccggagggagggtccg

SEQ ID NO: 3390 - DNA, 274 bp, Homo sapiens; identical to SEQ ID NO: 844
  misc_feature 1..274: note = chr9:1052044-1052318
  misc_feature 1..274: note = hyper
  source 1..274: mol_type = genomic DNA

SEQ ID NO: 3391 - DNA, 263 bp, Homo sapiens
  misc_feature 1..263: note = chr9:6412587-6412850
  misc_feature 1..263: note = hyper
  source 1..263: mol_type = genomic DNA
gcctccgccaggcgacgggaaaccctcggaagtgggtttccgcgcgaaagtagcattgcggccaggcgggaaacgtgttcgcgaagcaggagggcccccggggcctttcccgggcgacccgacccgccaggccgcgtggcgggagctttcctgttgagcgcggtggagcgcacacatttccttcagttctttctcggaagtttaggccgcacccacccgcgccccctttccaggattatacaagtgcacgccagggtttctta

SEQ ID NO: 3392 - DNA, 17 bp, Homo sapiens
  misc_feature 1..17: note = chr9:6644351-6644368
  misc_feature 1..17: note = hyper
  source 1..17: mol_type = genomic DNA
aacgcaggggaagctcg

SEQ ID NO: 3393 - DNA, 268 bp, Homo sapiens; identical to SEQ ID NO: 845
  misc_feature 1..268: note = chr9:6645065-6645333
  misc_feature 1..268: note = hyper
  source 1..268: mol_type = genomic DNA

SEQ ID NO: 3394 - DNA, 345 bp, Homo sapiens
  misc_feature 1..345: note = chr9:14348107-14348452
  misc_feature 1..345: note = hyper
  source 1..345: mol_type = genomic DNA
gaaggaaatgtggtgcgccctctggggcgtgaggccgccgcggcccattctacacacctactggcattccgcttttccttactgtgcgccaggggaaggcataattcaattatatcatacaactgcagcgcacccttttccttttttgctttgaggggaattttccaattcccaaataaatacctatggctctaaagccgagttgggttctgtagtaactaccgggggtgaaaaaaaaaaaagaccccaaattggctgtgagtttacagcctgaagcagcttatttaggctcgctgagcgccgttccaaacggcagggctcacgctatttcgggagaagttggag

SEQ ID NO: 3395 - DNA, 22 bp, Homo sapiens
  misc_feature 1..22: note = chr9:17907450-17907472
  misc_feature 1..22: note = hyper
  source 1..22: mol_type = genomic DNA
cggacgccggaccaggtgggct

SEQ ID NO: 3396 - DNA, 153 bp, Homo sapiens; identical to SEQ ID NO: 846
  misc_feature 1..153: note = chr9:19789107-19789260
  misc_feature 1..153: note = hyper
  source 1..153: mol_type = genomic DNA

SEQ ID NO: 3397 - DNA, 556 bp, Homo sapiens
  misc_feature 1..556: note = chr9:21402590-21403146
  misc_feature 1..556: note = hyper
  source 1..556: mol_type = genomic DNA
tccccttccccaagacgtccccgccctgcgcccccacacaaacggaatccccaagattaaacccgtgcgatctcgagccctcaagtcccggaatcaacgggtccctctgtaaaaacaagtctcgctgaagtctctatgggaaataaaagccccaaacccaggggaaaatcccgaaaataaaaggtgccctgctggctacctgaggaagatgtctcaagggagaccacggcggagctgcctcctgagcagcaaaagagatttttttactcaggtcgaagctgcacaaagttggcgcgataagccgcgacgacgtttccctggggctgcgggacgccccgaaactcaaacccgcggttcccaaatcctgggcatcaggaaaacccattctggcgccttgctgcggccgtggtgcgcagcgctgggagctttgcgctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 3398 - DNA, 913 bp, Homo sapiens
  misc_feature 1..913: note = chr9:21974204-21975117
  misc_feature 1..913: note = hyper
  source 1..913: mol_type = genomic DNA
tcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagc

SEQ ID NO: 3399 - DNA, 418 bp, Homo sapiens
  misc_feature 1..418: note = chr9:21975190-21975608
  misc_feature 1..418: note = hyper
  source 1..418: mol_type = genomic DNA
cgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggca

SEQ ID NO: 3400 - DNA, 93 bp, Homo sapiens; identical to SEQ ID NO: 847
  misc_feature 1..93: note = chr9:29214993-29215086
  misc_feature 1..93: note = hyper
  source 1..93: mol_type = genomic DNA

SEQ ID NO: 3401 - DNA, 256 bp, Homo sapiens
  misc_feature 1..256: note = chr9:32782680-32782936
  misc_feature 1..256: note = hyper
  source 1..256: mol_type = genomic DNA
aagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactc

SEQ ID NO: 3402 - DNA, 138 bp, Homo sapiens
  misc_feature 1..138: note = chr9:32783083-32783221
  misc_feature 1..138: note = hyper
  source 1..138: mol_type = genomic DNA
cgaggggttgagagaagggcggtcggggagcccctgggcctgccgtcagtcacccggatttgtaactggagaagggtgcgggtcccggagggacatctccagctggcacctaactcctcggatcccggactgggagcc

SEQ ID NO: 3403 - DNA, 161 bp, Homo sapiens
  misc_feature 1..161: note = chr9:32783259-32783420
  misc_feature 1..161: note = hyper
  source 1..161: mol_type = genomic DNA
cgaccctggtttccgactccggccactggcagcctcgcgccccagacccttcccgggcacggaagcgggtcaggtcgccctgctcagcctccggaacggcggcggcacaaaccccggccgctcccagcagccccgacgagaccccgggcagcgcctgccgc

SEQ ID NO: 3404 - DNA, 48 bp, Homo sapiens
  misc_feature 1..48: note = chr9:32783590-32783638
  misc_feature 1..48: note = hyper
  source 1..48: mol_type = genomic DNA
cgccgggctccgcttgcacagcaccgggaccgacgggcactgctggga

SEQ ID NO: 3405 - DNA, 148 bp, Homo sapiens
  misc_feature 1..148: note = chr9:36739852-36740000
  misc_feature 1..148: note = hyper
  source 1..148: mol_type = genomic DNA
gcctccgcggctgaacggacatcctgtcagacaggcctcttaatccaatcacttacctgtggaggggagccggctgcctcctcctggcccccttcctcctcccatggcacctgcggggccacgcggggtgctccggagccagggtaca

SEQ ID NO: 3406 - skipped

SEQ ID NO: 3407 - DNA, 171 bp, Homo sapiens
  misc_feature 1..171: note = chr9:37002818-37002989
  misc_feature 1..171: note = hyper
  source 1..171: mol_type = genomic DNA
cggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaa

SEQ ID NO: 3408 - DNA, 1046 bp, Homo sapiens
  misc_feature 1..1046: note = chr9:37025306-37026352
  misc_feature 1..1046: note = hyper
  source 1..1046: mol_type = genomic DNA
agacacggacatgctcgccccgggaagctcaccttcactccagccgggtctctgctgcctttgttaaataggggacctgcggctaggaaagctggatcccaggctgttgggatgggggggagcggggtgggaggaccaggcatggggacggctcctagcccgggagcaactccctgacctgaagcccgcagagaccccgagcggcacccgagccgaggctgccgaagcctgtcaccttcctccagcctggctctgcagcaaacagaaaggaaacgcgattcgttccacttggaatttccttgaaatctccgaatctaatccggcgttaactcaccgtgagaggagcgctcatctcacaggaggctgtggtaatgggtgaattggcaggatccctgcgggccaggcagccaggccggccttgccctcgccctaaatgacccttcccgtctcctacacacgctgcgtctttcagaggcgggggtgcctgcgtggtaactaattggcttcctctttctttctttctttttcgtttcttatcctctttttttaaaggggagaagccatgagaaaaggcgtcctgcagagaaggacccaatggggtctttaagggtctctgtatgaactggccggctcctaagcagaagctgaactcagaaaccgctacttccttgatttttcaaagccccctcctcaactccaggacgcctttggagccctagccccggtgtcctcgcttagctctcaacctcttcctccacacatacagacacgggtcagggccccactatccctccaagcgccagtctggatcagccccatggctgaaaaaggcgccatcggagtaggggtgtggggcgctgtctgagactctgactggcctctccctacaacttactgccctccaactggcctggcccggagccctctacgggtccaagccagggttctccgaaagagctgaaatgtcgccgccggagccttgaaaggctgcagctcgctgcccaagctacgcgttgccggaggcgggattcccaggtgcctcagcc

SEQ ID NO: 3409 - DNA, 839 bp, Homo sapiens
  misc_feature 1..839: note = chr9:37026433-37027272
  misc_feature 1..839: note = hyper
  source 1..839: mol_type = genomic DNA
cgagatccttccggccttagtacctgacccacggtccggcacccccaacccggtcccggcgggagagtgagagaagcgagctcgccgcctacttactatgcatggatgcaaacgggtcgtgcttacagtgtatttccatcggggcgctccagactgcaggccggcccacgccgccgcctcccggcgccaaggggctgcccagggcggatagggagcctcgccaccaggccaggcactgtgcgagctgggctcagaaaacactgctggagcttcggggtctctctcagagcctccctgctggagaccgcccggagctgcgcggagaggcgggaaatggtgctagcgcacccgggctaggagcgggtgcccaactccggctggcttccctccctggctggctcaagcagcagctccgggcccagcccggggtagctgcggccaaggcgcccgcggcttcgggggcatagcgtaggggcccgcctccgggacagccagcagcccccggccccaggaaggagcagctttgaggaggccgccggaacaatcggcccttgacttcactcagggggcggagagacccgggggctgccaggctggttccgcggcctcgatgcttctgaggtccctcctcgacccctcggtctccgccagatcctttctttctctgcttctccgagtctctggggctcggacttgccccctccgcctctctccaactggctctccgacgtctcggacgaagttgcaaagaacttcctctccggcagcgcggggtcctggcgggtttggagatgcttccgcccctgacgctggggccgcgactccggagtccccgggag

SEQ ID NO: 3410 - DNA, 60 bp, Homo sapiens
  misc_feature 1..60: note = chr9:37027324-37027384
  misc_feature 1..60: note = hyper
  source 1..60: mol_type = genomic DNA
cgctgctcgcccatcgctgggaccaggaacggggacaccagcgacggactcttcctcgcc

SEQ ID NO: 3411 - DNA, 444 bp, Homo sapiens
  misc_feature 1..444: note = chr9:37027385-37027829
  misc_feature 1..444: note = hyper
  source 1..444: mol_type = genomic DNA
gggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaa

SEQ ID NO: 3412 - DNA, 874 bp, Homo sapiens; identical to SEQ ID NO: 848
  misc_feature 1..874: note = chr9:37029893-37030767
  misc_feature 1..874: note = hyper
  source 1..874: mol_type = genomic DNA

SEQ ID NO: 3413 - DNA, 432 bp, Homo sapiens
  misc_feature 1..432: note = chr9:37036462-37036894
  misc_feature 1..432: note = hyper
  source 1..432: mol_type = genomic DNA
ttaggccaagcatcacgaatcgtaggttcgccgtgctccgccgcttcgcgctctggacgctcgagaccagcgggaaacaaatgtggttcccgagggggcgcccgctggtcgtcaaaacctcgcgggcccggaggcgccgctgctgggtcagaatcgcagagcccccctcgcggggtaccgaggcccagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatccccca

SEQ ID NO: 3414 - DNA, 812 bp, Homo sapiens; identical to SEQ ID NO: 849
  misc_feature 1..812: note = chr9:37037453-37038265
  misc_feature 1..812: note = hyper
  source 1..812: mol_type = genomic DNA

SEQ ID NO: 3415 - DNA, 30 bp, Homo sapiens
  misc_feature 1..30: note = chr9:77115417-77115447
  misc_feature 1..30: note = hyper
  source 1..30: mol_type = genomic DNA
ttgacctgggctttacggtgggcccactgc

SEQ ID NO: 3416 - DNA, 522 bp, Homo sapiens; identical to SEQ ID NO: 850
  misc_feature 1..522: note = chr9:79626876-79627398
  misc_feature 1..522: note = hyper
  source 1..522: mol_type = genomic DNA

SEQ ID NO: 3417 - DNA, 199 bp, Homo sapiens; identical to SEQ ID NO: 851
  misc_feature 1..199: note = chr9:79629207-79629406
  misc_feature 1..199: note = hyper
  source 1..199: mol_type = genomic DNA

SEQ ID NO: 3418 - DNA, 350 bp, Homo sapiens
  misc_feature 1..350: note = chr9:79633334-79633684
  misc_feature 1..350: note = hyper
  source 1..350: mol_type = genomic DNA
gtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctca

SEQ ID NO: 3419 - DNA, 531 bp, Homo sapiens
  misc_feature 1..531: note = chr9:79634237-79634768
  misc_feature 1..531: note = hyper
  source 1..531: mol_type = genomic DNA
cagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctcc

SEQ ID NO: 3420 - DNA, 400 bp, Homo sapiens
  misc_feature 1..400: note = chr9:79635049-79635449
  misc_feature 1..400: note = hyper
  source 1..400: mol_type = genomic DNA
ccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtcc

SEQ ID NO: 3421 - DNA, 131 bp, Homo sapiens; identical to SEQ ID NO: 852
  misc_feature 1..131: note = chr9:79635834-79635965
  misc_feature 1..131: note = hyper
  source 1..131: mol_type = genomic DNA

SEQ ID NO: 3422 - DNA, 295 bp, Homo sapiens; identical to SEQ ID NO: 853
  misc_feature 1..295: note = chr9:79636258-79636553
  misc_feature 1..295: note = hyper
  source 1..295: mol_type = genomic DNA

SEQ ID NO: 3423 - DNA, 230 bp, Homo sapiens; identical to SEQ ID NO: 854
  misc_feature 1..230: note = chr9:79637659-79637889
  misc_feature 1..230: note = hyper
  source 1..230: mol_type = genomic DNA

SEQ ID NO: 3424 - DNA, 46 bp, Homo sapiens; identical to SEQ ID NO: 855
  misc_feature 1..46: note = chr9:79638136-79638182
  misc_feature 1..46: note = hyper
  source 1..46: mol_type = genomic DNA

SEQ ID NO: 3425 - DNA, 107 bp, Homo sapiens
  misc_feature 1..107: note = chr9:86755532-86755639
  misc_feature 1..107: note = hyper
  source 1..107: mol_type = genomic DNA
gctccccaggcaaagcggccccgccaggacgggcacggcttcgcgtcctcgctcaagtccccgatgatggccgcgtcccggcaggcacggtgcgaattgactggggt

SEQ ID NO: 3426 - DNA, 30 bp, Homo sapiens
  misc_feature 1..30: note = chr9:88137696-88137726
  misc_feature 1..30: note = hyper
  source 1..30: mol_type = genomic DNA
ggaaggccaggagaacgcggttccccttct

SEQ ID NO: 3427 - DNA, 240 bp, Homo sapiens
  misc_feature 1..240: note = chr9:88137874-88138114
  misc_feature 1..240: note = hyper
  source 1..240: mol_type = genomic DNA
cgcgcgatcgccctgtgcgcgcaggagtgacaggcgccccagctcgcgctctccagcccgccagggcccggctttggcagacccgaggctcctcacccgccctgagggacgggttgtacttactgagaactgatgcttagtaagcttaaaagccccagaaaggaagtctgtacaaatccttaatgatccagtcaattgtcgctgcataacaaaccaccccagaaccggtaacttgaaaca

SEQ ID NO: 3428 - DNA, 97 bp, Homo sapiens
  misc_feature 1..97: note = chr9:91606004-91606101
  misc_feature 1..97: note = hyper
  source 1..97: mol_type = genomic DNA
cccaagcccagacctcggacctggttccaagcctgttcccgctgggtctctgggcgcccggtttctgcacctggagctcgcccgatgaggacaaggt

SEQ ID NO: 3429 - DNA, 120 bp, Homo sapiens
  misc_feature 1..120: note = chr9:94712294-94712414
  misc_feature 1..120: note = hyper
  source 1..120: mol_type = genomic DNA
cggggtcgggcgccaccacccctttctacgatgcgtccgctcctccttctccctggcgcttcgcaaacgggtccacttcgaggacctcgtcgtcgtcctcttctccggcccggatgcgcc

SEQ ID NO: 3430 - DNA, 651 bp, Homo sapiens
  misc_feature 1..651: note = chr9:96710796-96711447
  misc_feature 1..651: note = hyper
  source 1..651: mol_type = genomic DNA
gggggagggatggggcgcccccgctcgcgactacgcctgcgactgtcctcgcgctgcgggggctgtgcgtggagcccgcggtaagctggaatatccaagccagctgcaagtggccttccgttccccacacgcctcctgcgtgctgggcccagctgggcgccgcccaaatcttctctctcccgagactctccagctccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccgcagggccacagctctcgcgagactcctgagccctctccctcccctggctgcggcccccgggctccgggaagctcagccacctgggcccacgccatatctgggtttttttcccaggactttggggatgagaagagacttgtgcatagagcggaagaggaatgggatccaagggacctttccttcaagtcc

SEQ ID NO: 3431 - DNA, 83 bp, Homo sapiens
  misc_feature 1..83: note = chr9:96711534-96711617
  misc_feature 1..83: note = hyper
  source 1..83: mol_type = genomic DNA
cgggcgccaggtagctccggtcgggcacgcgcagtccgacagactgtgtcaccttggaagacaggatgcggccctttacctag

SEQ ID NO: 3432 - DNA, 524 bp, Homo sapiens
  misc_feature 1..524: note = chr9:96716904-96717428
  misc_feature 1..524: note = hyper
  source 1..524: mol_type = genomic DNA
cgcctgcactggggatgctcactcggggtccccgggctggaggccgaagggaagcagtgaaggaaagagcgaacaccctccccgggcggcccgcgggcacgaggcctggtttctgtgaggcctggagcttgcaccctccgcctcccgcctggagggctccgagagacggtcccagaacctgcgctcccagagcagcttcccggggctgcttcgatgccggaggaggctcggggcgcccccgcggttcagctcgctgtctcccgccaagcccggcccgcgaccccgcggccgccacacgtacccaggtggctgtggaagggccgcgccgccagcagcgcctgcacgccgaacttcagcagctcgcccgccgcggcagcggcggctgcgggcgcggcgcccttgggcccgggtggctccgtgaggatctcctcaatcatgaagctgcgatagcggtgcggccggtggtccgcgcagccctcgggcgggccgaagcgcgcggcgcccggctcccccggccgctgcat

SEQ ID NO: 3433 - DNA, 85 bp, Homo sapiens
  misc_feature 1..85: note = chr9:96717449-96717534
  misc_feature 1..85: note = hyper
  source 1..85: mol_type = genomic DNA
cgcggtttggcggcggcggcggcgacggcttggctccggcgcggggcccgcgcggggctctaggccggcccgcagctcggggcgg

SEQ ID NO: 3434 - DNA, 220 bp, Homo sapiens
  misc_feature 1..220: note = chr9:96717979-96718199
  misc_feature 1..220: note = hyper
  source 1..220: mol_type = genomic DNA
tgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcgctcctcagctggg

SEQ ID NO: 3435 - skipped

SEQ ID NO: 3436 - DNA, 366 bp, Homo sapiens; identical to SEQ ID NO: 857
  misc_feature 1..366: note = chr9:96721102-96721468
  misc_feature 1..366: note = hyper
  source 1..366: mol_type = genomic DNA

SEQ ID NO: 3437 - DNA, 114 bp, Homo sapiens; identical to SEQ ID NO: 858
  misc_feature 1..114: note = chr9:96721688-96721802
  misc_feature 1..114: note = hyper
  source 1..114: mol_type = genomic DNA

SEQ ID NO: 3438 - DNA, 212 bp, Homo sapiens; identical to SEQ ID NO: 859
  misc_feature 1..212: note = chr9:98111349-98111561
  misc_feature 1..212: note = hyper
  source 1..212: mol_type = genomic DNA

SEQ ID NO: 3439 - DNA, 264 bp, Homo sapiens; identical to SEQ ID NO: 860
  misc_feature 1..264: note = chr9:98111894-98112158
  misc_feature 1..264: note = hyper
  source 1..264: mol_type = genomic DNA

SEQ ID NO: 3440 - DNA, 52 bp, Homo sapiens; identical to SEQ ID NO: 861
  misc_feature 1..52: note = chr9:98112343-98112395
  misc_feature 1..52: note = hyper
  source 1..52: mol_type = genomic DNA

SEQ ID NO: 3441 - DNA, 306 bp, Homo sapiens
  misc_feature 1..306: note = chr9:98789707-98790013
  misc_feature 1..306: note = hyper
  source 1..306: mol_type = genomic DNA
aggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccc

SEQ ID NO: 3442 - DNA, 432 bp, Homo sapiens; identical to SEQ ID NO: 862
  misc_feature 1..432: note = chr9:99639601-99640033
  misc_feature 1..432: note = hyper
  source 1..432: mol_type = genomic DNA

SEQ ID NO: 3443 - DNA, 27 bp, Homo sapiens
  misc_feature 1..27: note = chr9:99983988-99984015
  misc_feature 1..27: note = hyper
  source 1..27: mol_type = genomic DNA
tcgcgcaggacatcccggaatcgcagg

SEQ ID NO: 3444 - DNA, 40 bp, Homo sapiens
  misc_feature 1..40: note = chr9:100610095-100610135
  misc_feature 1..40: note = hyper
  source 1..40: mol_type = genomic DNA
ccctcacttccagcccgcaggctgccgcgggggtgactcc

SEQ ID NO: 3445 - DNA, 121 bp, Homo sapiens
  misc_feature 1..121: note = chr9:100610200-100610321
  misc_feature 1..121: note = hyper
  source 1..121: mol_type = genomic DNA
cggcgaaacctagagagacttgcactccaggcccggggggtgggggggcgggggagaagccttagggagagtggggaggaggccagaggagagctggctgctctctcgtgttgaggttcaa

SEQ ID NO: 3446 - DNA, 92 bp, Homo sapiens; identical to SEQ ID NO: 863
  misc_feature 1..92: note = chr9:100610725-100610817
  misc_feature 1..92: note = hyper
  source 1..92: mol_type = genomic DNA

SEQ ID NO: 3447 - DNA, 516 bp, Homo sapiens; identical to SEQ ID NO: 864
  misc_feature 1..516: note = chr9:100611124-100611640
  misc_feature 1..516: note = hyper
  source 1..516: mol_type = genomic DNA

SEQ ID NO: 3448 - DNA, 10 bp, Homo sapiens
  misc_feature 1..10: note = chr9:100613990-100614000
  misc_feature 1..10: note = hyper
  source 1..10: mol_type = genomic DNA
ttccacacac

SEQ ID NO: 3449 - DNA, 133 bp, Homo sapiens
  misc_feature 1..133: note = chr9:100614192-100614325
  misc_feature 1..133: note = hyper
  source 1..133: mol_type = genomic DNA
cgcggctctgcacccacagccccggcccgccccccccccccaccccggaaagctgcgtccgggctggagccactggaacccgcgccaaggcccggaatcctatacgtagcaggggcctcggagatcagcacac

SEQ ID NO: 3450 - DNA, 133 bp, Homo sapiens
  misc_feature 1..133: note = chr9:100615068-100615201
  misc_feature 1..133: note = hyper
  source 1..133: mol_type = genomic DNA
ccatcctgaaaggcccggggagccagtctcctggaacttctccctccccattcccacaaaaaccaagcgccctctcggccaattctcaccctctcaggacaaaaaagtgagatgagcccgtcctttcacctgc

SEQ ID NO: 3451 - DNA, 834 bp, Homo sapiens
  misc_feature 1..834: note = chr9:100615202-100616036
  misc_feature 1..834: note = hyper
  source 1..834: mol_type = genomic DNA
agtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccag

SEQ ID NO: 3452 - DNA, 199 bp, Homo sapiens
  misc_feature 1..199: note = chr9:100616270-100616469
  misc_feature 1..199: note = hyper
  source 1..199: mol_type = genomic DNA
ggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgc

SEQ ID NO: 3453 - DNA, 426 bp, Homo sapiens
  misc_feature 1..426: note = chr9:100620357-100620783
  misc_feature 1..426: note = hyper
  source 1..426: mol_type = genomic DNA
tccgggccctgcacccgccagcgtcgtgtgcaggcgtccccgggctgtggataattagacacgttcttccctcattgcccaaggctcgttagaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctcctagaagagtaaggataacatcctggaaatgacttctgtacggtttgagcccaac

SEQ ID NO: 3454 - DNA, 87 bp, Homo sapiens
  misc_feature 1..87: note = chr9:101706109-101706196
  misc_feature 1..87: note = hyper
  source 1..87: mol_type = genomic DNA
cagcgcgcgggggagcgcagggcgcggcggagtcgggtttcagagcgcgggtgactcggggcgcgggccgggagccgggattctgcc

SEQ ID NO: 3455 - DNA, 467 bp, Homo sapiens
  misc_feature 1..467: note = chr9:101706312-101706779
  misc_feature 1..467: note = hyper
  source 1..467: mol_type = genomic DNA
cgcgccttccggggctccgcagacccgcgagatggcaccaaggtaagacccgcttctctgcttcctcgcgtcccgggcccctccaatactcttgcccgcctcaccttttctccctcgggcacatcttgcaggaggaacaacgggcagtgctggtgtctgctgatgctgctctcggtctccacgcccctccctgctgtcacccagacccgcggtgcgacaggtaagcaacccggtcggagggtggcaccggctgcctccgcgcccgtgggggaagtcggttttggcggcggacgcggctgcgatgcgtgcctcattcctggacataaaagggagtcttgccactcagtgcgcactggcggtcccgcgggcggctacctcctggcagtgcaggggttatagctgtgaatgggatccctgggcagctggggcggttggagcgttgtctgggcacccgagatgtctgagct

SEQ ID NO: 3456 - DNA, 432 bp, Homo sapiens
  misc_feature 1..432: note = chr9:110228200-110228632
  misc_feature 1..432: note = hyper
  source 1..432: mol_type = genomic DNA
gggactgggtaagggcgcgggatgggatcggctctggatatgggtgccccccgagccgcgccccaccccgcgagcgctcccatttgcacctccacttgagcacggagcttcaagaacgagctattctggggtgcgggttccgacactaggccccacacggatctggggactggtttggctacgacctggcggaaggggggaaacctggcctgagaacggaaactgcgggacgatccggcggcgcacttaaatctggctccgctgcttcctcgccccgcccccgctgtcaccttcctctgcttctgcgcagcgattccacaccccactccaccccatcccacccagaccgctcacccgattctgactttgaacccaaaagcgatcaggcgtgttctgggcccggccacagccagcgggcgctctggccctcgc

SEQ ID NO: 3457 - DNA, 95 bp, Homo sapiens
  misc_feature 1..95: note = chr9:120177898-120177993
  misc_feature 1..95: note = hyper
  source 1..95: mol_type = genomic DNA
cattctcccactgcccgcaaaccttcctctcccctccatccaggccttgtgctagcactaattgctaatggacagaggggcgtcgaactccaccg

SEQ ID NO: 3458 - DNA, 66 bp, Homo sapiens
  misc_feature 1..66: note = chr9:126774554-126774620
  misc_feature 1..66: note = hyper
  source 1..66: mol_type = genomic DNA
gccaggcagctgaggcggggggcaagccctccctcggaggagccgcgcccccggccccgccggtcc

SEQ ID NO: 3459 - DNA, 92 bp, Homo sapiens
  misc_feature 1..92: note = chr9:126777655-126777747
  misc_feature 1..92: note = hyper
  source 1..92: mol_type = genomic DNA
cgcggcggccaagagcgcggggctgggcgcagcaggggccaaccctctgggtcttccctactacaatggcgtgggcactgtgcagaaggggc

SEQ ID NO: 3460 - DNA, 423 bp, Homo sapiens
  misc_feature 1..423: note = chr9:126779621-126780044
  misc_feature 1..423: note = hyper
  source 1..423: mol_type = genomic DNA
tgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccggg

SEQ ID NO: 3461 - DNA, 31 bp, Homo sapiens
  misc_feature 1..31: note = chr9:126780284-126780315
  misc_feature 1..31: note = hyper
  source 1..31: mol_type = genomic DNA
ggaccggccggacgcccggcctcccccagcc

SEQ ID NO: 3462 - DNA, 108 bp, Homo sapiens; identical to SEQ ID NO: 865
  misc_feature 1..108: note = chr9:127212898-127213006
  misc_feature 1..108: note = hyper
  source 1..108: mol_type = genomic DNA

SEQ ID NO: 3463 - DNA, 150 bp, Homo sapiens
  misc_feature 1..150: note = chr9:127265875-127266025
  misc_feature 1..150: note = hyper
  source 1..150: mol_type = genomic DNA
cggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaa

SEQ ID NO: 3464 - DNA, 438 bp, Homo sapiens
  misc_feature 1..438: note = chr9:129387866-129388304
  misc_feature 1..438: note = hyper
  source 1..438: mol_type = genomic DNA
agggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggc

SEQ ID NO: 3465 - DNA, 201 bp, Homo sapiens
  misc_feature 1..201: note = chr9:129389016-129389217
  misc_feature 1..201: note = hyper
  source 1..201: mol_type = genomic DNA
gcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtc

SEQ ID NO: 3466 - DNA, 187 bp, Homo sapiens
  misc_feature 1..187: note = chr9:129400940-129401127
  misc_feature 1..187: note = hyper
  source 1..187: mol_type = genomic DNA
aaagacctcggggcgcgtggcgcagcggcggctcggagctcccattattagctgtgctcttcggagcgcgctccgatctctcccgggggagccggtgaaaaattaacacgggccggcggcgcgggcgcccgatgtaactgtaattactccattgatattcctcacacaatagcgctgtcatcagtca

SEQ ID NO: 3467 - DNA, 93 bp, Homo sapiens
  misc_feature 1..93: note = chr9:129445473-129445566
  misc_feature 1..93: note = hyper
  source 1..93: mol_type = genomic DNA
ggctgggagaggccccgcgaggcccgcagagcgcgcccgtctcgccgcgcattccagccgcgtgattgacgcgcgtaccggggcccccgcccg

SEQ ID NO: 3468 - DNA, 69 bp, Homo sapiens
  misc_feature 1..69: note = chr9:132382286-132382355
  misc_feature 1..69: note = hyper
  source 1..69: mol_type = genomic DNA
gggaccaccccccaccggaaatgactcgggcccgccccccgggccccgcggggcctcactcagtggctc

SEQ ID NO: 3469 - DNA, 173 bp, Homo sapiens
  misc_feature 1..173: note = chr9:132382634-132382807
  misc_feature 1..173: note = hyper
  source 1..173: mol_type = genomic DNA
gacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagcccct

SEQ ID NO: 3470 - DNA, 106 bp, Homo sapiens
  misc_feature 1..106: note = chr9:133308867-133308973
  misc_feature 1..106: note = hyper
  source 1..106: mol_type = genomic DNA
ggcgtccccgccaaccgcaccgagctcagcatgctggagcccgacccccgcagccccttcgcgctgcgtccgctgcgcgcgggccttggcgcggtctacacccgtc

SEQ ID NO: 3471 - DNA, 125 bp, Homo sapiens
  misc_feature 1..125: note = chr9:133535809-133535934
  misc_feature 1..125: note = hyper
  source 1..125: mol_type = genomic DNA
gggtggattttcccccggcagatgtttcgggaggaggaggcgcgcggagctcccgggaggggggacaaatctctccctccgaggggcgagaacaggagactttcttctaaagttcaaaagaaaga

SEQ ID NO: 3472 - DNA, 149 bp, Homo sapiens
  misc_feature 1..149: note = chr9:133535971-133536120
  misc_feature 1..149: note = hyper
  source 1..149: mol_type = genomic DNA
cggacaatgggcttctttctgcgcctctgagggccggcggggcgggcagggcggggacccgtgcgctttggccccgcctgaccgactcgcacccccctcccccgcacccaggcccgggccccagagcgagggcgcaggagccgcgaagc

SEQ ID NO: 3473 - DNA, 196 bp, Homo sapiens
  misc_feature 1..196: note = chr9:133536149-133536345
  misc_feature 1..196: note = hyper
  source 1..196: mol_type = genomic DNA
cgcactgtcgggacctggctctcccggagctaagccccggcgcaccggcgagaacgaaagcgtcgtgcggggccctgggctgtcccacacgcccccgttctcataggtgcctcagccgggccgaagggacgcgcgctggtgcctcaaggggaggacgaacggacctccgggcttgggccgcggcctccttcccctc

SEQ ID NO: 3474 - DNA, 160 bp, Homo sapiens
  misc_feature 1..160: note = chr9:133536346-133536506
  misc_feature 1..160: note = hyper
  source 1..160: mol_type = genomic DNA
gcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggc

SEQ ID NO: 3475 - DNA, 238 bp, Homo sapiens
  misc_feature 1..238: note = chr9:133538169-133538407
  misc_feature 1..238: note = hyper
  source 1..238: mol_type = genomic DNA
catgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctg

SEQ ID NO: 3476 - DNA, 525 bp, Homo sapiens
  misc_feature 1..525: note = chr9:133538655-133539180
  misc_feature 1..525: note = hyper
  source 1..525: mol_type = genomic DNA
agctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggg

SEQ ID NO: 3477 - DNA, 742 bp, Homo sapiens; identical to SEQ ID NO: 866
  misc_feature 1..742: note = chr9:133541665-133542407
  misc_feature 1..742: note = hyper
  source 1..742: mol_type = genomic DNA

SEQ ID NO: 3478 - DNA, 617 bp, Homo sapiens
  misc_feature 1..617: note = chr9:135455407-135456024
  misc_feature 1..617: note = hyper
  source 1..617: mol_type = genomic DNA
ggaggacagagcggacgctctggggaccaggcggtcccgcgcatgcttggccaggggcatcgccgtggctaacaggggggttgtgtggtggcgggggctcgccgtcgatctaagtgaggatctcggtgctccgaggaagatgagattcctcaggggatgcgggcgcaggcctgggaggagtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgaccacgccaggctgcccccgggagaattctg

SEQ ID NO: 3479 - DNA, 122 bp, Homo sapiens
  misc_feature 1..122: note = chr9:135458477-135458599
  misc_feature 1..122: note = hyper
  source 1..122: mol_type = genomic DNA
cagggacatccttgccgactgcaaaccactcgcggcctgtgcaccctactctagcagcgggcagccggcagcccctgagcctgggggccgccttgcggccaaggccgcggaggactttagag

SEQ ID NO: 3480 - DNA, 91 bp, Homo sapiens
  misc_feature 1..91: note = chr9:135460069-135460160
  misc_feature 1..91: note = hyper
  source 1..91: mol_type = genomic DNA
tcagccaggctgtgccgaccatgcctggaaagtaggcaggtttaacggagcggccaggaggagatccagaggcatgcgggtgtccccaggc

SEQ ID NO: 3481 - DNA, 271 bp, Homo sapiens
  misc_feature 1..271: note = chr9:135461541-135461812
  misc_feature 1..271: note = hyper
  source 1..271: mol_type = genomic DNA
tcagttgaaaagtctcgatccctaacggctcaattaaccggattattgtttcctacagagagaaatcaccttgcattcagctgaaccccgtcactgcaaacgccacgcacaatgaaactccaccataaaagaaaacagagaaaaaagggagtaggttgggggaaagccccagtctgagccgccaattttggggaagtggtctagctggttatataatcgctttagagggagaaggagggtgagcattgagcttgttcgattaagtgttttc

SEQ ID NO: 3482 - DNA, 275 bp, Homo sapiens; identical to SEQ ID NO: 867
  misc_feature 1..275: note = chr9:135462647-135462922
  misc_feature 1..275: note = hyper
  source 1..275: mol_type = genomic DNA

SEQ ID NO: 3483 - DNA, 141 bp, Homo sapiens
  misc_feature 1..141: note = chr9:135464798-135464939
  misc_feature 1..141: note = hyper
  source 1..141: mol_type = genomic DNA
agacctctggtgccccgcatcctcatccacggactccagggcgccagcgagccgcccccgccgctgccccccctggccggcgtcctcccacgcgccgcgcagcctcggtgaggcgcccgtcggctccggggcctcctcccg

SEQ ID NO: 3484 - DNA, 144 bp, Homo sapiens
  misc_feature 1..144: note = chr9:137533823-137533967
  misc_feature 1..144: note = hyper
  source 1..144: mol_type = genomic DNA
tcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacc

SEQ ID NO: 3485 - DNA, 87 bp, Homo sapiens
  misc_feature 1..87: note = chr9:137534065-137534152
  misc_feature 1..87: note = hyper
  source 1..87: mol_type = genomic DNA
cgcgctccgcccgggcgccccgctgctgcccccgctgctgctgctgctgctgtgggcgccgcctccgagccgcgcaggtaagggcgc

SEQ ID NO: 3486 - DNA, 95 bp, Homo sapiens
  misc_feature 1..95: note = chr9:138606154-138606249
  misc_feature 1..95: note = hyper
  source 1..95: mol_type = genomic DNA
cctcctgccaggccccggggccgctttggagggagccccgccccctgcccctgcgcagcccccgccctagccccagcccggcgcagccggtcccg

SEQ ID NO: 3487 - DNA, 142 bp, Homo sapiens
  misc_feature 1..142: note = chr9:139024749-139024891
  misc_feature 1..142: note = hyper
  source 1..142: mol_type = genomic DNA
gctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcg

SEQ ID NO: 3488 - DNA, 23 bp, Homo sapiens
  misc_feature 1..23: note = chr9:140033468-140033491
  misc_feature 1..23: note = hyper
  source 1..23: mol_type = genomic DNA
gcgctccgacacacacgctcacg

SEQ ID NO: 3489 - skipped

SEQ ID NO: 3490 - DNA, 382 bp, Homo sapiens
  misc_feature 1..382: note = chr9:140033762-140034144
  misc_feature 1..382: note = hyper
  source 1..382: mol_type = genomic DNA
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcc

SEQ ID NO: 3491 - DNA, 91 bp, Homo sapiens
  misc_feature 1..91: note = chr9:140772120-140772211
  misc_feature 1..91: note = hyper
  source 1..91: mol_type = genomic DNA
ggggcggccgcggggcggggccggcgcggcagggtgggcggggccggcgcggattggccgggccccgccacgtgaccggccccttataggg

SEQ ID NO: 3492 - DNA, 545 bp, Homo sapiens; identical to SEQ ID NO: 868
  misc_feature 1..545: note = chr9:140772756-140773301
  misc_feature 1..545: note = hyper
  source 1..545: mol_type = genomic DNA

SEQ ID NO: 3493 - DNA, 239 bp, Homo sapiens
  misc_feature 1..239: note = chr10:1778844-1779083
  misc_feature 1..239: note = hyper
  source 1..239: mol_type = genomic DNA
gagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttcca

SEQ ID NO: 3494 - DNA, 29 bp, Homo sapiens
  misc_feature 1..29: note = chr10:1779111-1779140
  misc_feature 1..29: note = hyper
  source 1..29: mol_type = genomic DNA
cggagcagccatcccgccagcaccccaaa

SEQ ID NO: 3495 - DNA, 121 bp, Homo sapiens; identical to SEQ ID NO: 869
  misc_feature 1..121: note = chr10:7450069-7450190
  misc_feature 1..121: note = hyper
  source 1..121: mol_type = genomic DNA

SEQ ID NO: 3496 - DNA, 1772 bp, Homo sapiens; identical to SEQ ID NO: 870
  misc_feature 1..1772: note = chr10:7450490-7452262
  misc_feature 1..1772: note = hyper
  source 1..1772: mol_type = genomic DNA

SEQ ID NO: 3497 - DNA, 446 bp, Homo sapiens
  misc_feature 1..446: note = chr10:7452546-7452992
  misc_feature 1..446: note = hyper
  source 1..446: mol_type = genomic DNA
aatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattcca

SEQ ID NO: 3498 - DNA, 605 bp, Homo sapiens
  misc_feature 1..605: note = chr10:7453052-7453657
  misc_feature 1..605: note = hyper
  source 1..605: mol_type = genomic DNA
tttaagattttgtgtgtgtgtgtatgtgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccggg

SEQ ID NO: 3499 - DNA, 93 bp, Homo sapiens
  misc_feature 1..93: note = chr10:7453902-7453995
  misc_feature 1..93: note = hyper
  source 1..93: mol_type = genomic DNA
cgcagagcccaaacgaaatgtccccagtgcggaaaagccggtgacgccctggtagcaagaccaagagcttccgaagaacgctgcgcccttaac

SEQ ID NO: 3500 - DNA, 15 bp, Homo sapiens
  misc_feature 1..15: note = chr10:8075930-8075945
  misc_feature 1..15: note = hyper
  source 1..15: mol_type = genomic DNA
gctggcagccaactt

SEQ ID NO: 3501 - DNA, 124 bp, Homo sapiens
  misc_feature 1..124: note = chr10:8076053-8076177
  misc_feature 1..124: note = hyper
  source 1..124: mol_type = genomic DNA
cgacggacagtcccgggcttagggagggaggctgatcccgggagctctcaggagtccttccacctgccacctaggagcccagttcgcatctctacagcgccacacatctaggccagcccagctc

SEQ ID NO: 3502 - DNA, 39 bp, Homo sapiens
  misc_feature 1..39: note = chr10:8076448-8076487
  misc_feature 1..39: note = hyper
  source 1..39: mol_type = genomic DNA
cataaaaaacaaagacgggggcggcggagggtgtggaag

SEQ ID NO: 3503 - DNA, 96 bp, Homo sapiens
  misc_feature 1..96: note = chr10:8077922-8078018
  misc_feature 1..96: note = hyper
  source 1..96: mol_type = genomic DNA
cccggcacccaactgcggggcacgcgcccgttgctcggccctaaaggggcctagagctgcgccccgggggcgcggaaggtgcggggagagggggtg

SEQ ID NO: 3504 - DNA, 376 bp, Homo sapiens; identical to SEQ ID NO: 871
  misc_feature 1..376: note = chr10:8085599-8085975
  misc_feature 1..376: note = hyper
  source 1..376: mol_type = genomic DNA

SEQ ID NO: 3505 - DNA, 89 bp, Homo sapiens
  misc_feature 1..89: note = chr10:8097108-8097197
  misc_feature 1..89: note = hyper
  source 1..89: mol_type = genomic DNA
gagccctgcgggctccgcggccgtgtccccgcgctcccgtgcgggtctcgggtgcgctgggcgggcgggcggcgcgaggggaggttgtg

SEQ ID NO: 3506 - DNA, 172 bp, Homo sapiens
  misc_feature 1..172: note = chr10:11059492-11059664
  misc_feature 1..172: note = hyper
  source 1..172: mol_type = genomic DNA
atcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggag

SEQ ID NO: 3507 - DNA, 120 bp, Homo sapiens
  misc_feature 1..120: note = chr10:11059932-11060052
  misc_feature 1..120: note = hyper
  source 1..120: mol_type = genomic DNA
ggctcggcggccgccgggggaggccgcgcgcacctgtccctgcccgtctcgcgccgcccgcggccgctcggacgcgcgcagagccgccccccgccgctgccgccgcgtgcgcccgcgaac

SEQ ID NO: 3508 - DNA, 33 bp, Homo sapiens
  misc_feature 1..33: note = chr10:13933506-13933539
  misc_feature 1..33: note = hyper
  source 1..33: mol_type = genomic DNA
ccagtaaagaagcagcggcgcgtcccttttccc

SEQ ID NO: 3509 - DNA, 339 bp, Homo sapiens
  misc_feature 1..339: note = chr10:13933596-13933935
  misc_feature 1..339: note = hyper
  source 1..339: mol_type = genomic DNA
cgcgaccgggaaacaaagacacattaccttttattttttgcgcttccaagggatccgaggaacttctggctgcaagcggctggtaccccggaacgggcgtcccattcgcccgggcgaaggcccttggcctactaggcggccttggcgcccgcagctggcgagcccccgccccgtccccgccgccgcccccgccgcgggccctcggcgtcagcccatagcccgctcgcgcctctcgcgccgagcctggcccggcgccagtgagccccgccgccggcccgcccctcgcccgcgcccggcccgccgcatggtgcgcccagcgcgccccgagccagtccccgg

SEQ ID NO: 3510 - DNA, 14 bp, Homo sapiens
  misc_feature 1..14: note = chr10:13933982-13933996
  misc_feature 1..14: note = hyper
  source 1..14: mol_type = genomic DNA
cgccaccgcccgcc

SEQ ID NO: 3511 - DNA, 129 bp, Homo sapiens
  misc_feature 1..129: note = chr10:13933997-13934126
  misc_feature 1..129: note = hyper
  source 1..129: mol_type = genomic DNA
cccgatcctggacaacaatgcgcgcccccgcccccccagaaagccagggacgcccccagtcgccgccagagctggctcggcttcccagcccctctccgtggcacccgcaggcgagacaaagttcgctcc

SEQ ID NO: 3512 - DNA, 75 bp, Homo sapiens
  misc_feature 1..75: note = chr10:13934168-13934243
  misc_feature 1..75: note = hyper
  source 1..75: mol_type = genomic DNA
cggaggtccccaagcgggggacccctggctcccccacaaaacccacccaaagccaccgctcgaggccctctccta

SEQ ID NO: 3513 - DNA, 858 bp, Homo sapiens; identical to SEQ ID NO: 872
  misc_feature 1..858: note = chr10:15760996-15761854
  misc_feature 1..858: note = hyper
  source 1..858: mol_type = genomic DNA

SEQ ID NO: 3514 - DNA, 111 bp, Homo sapiens; identical to SEQ ID NO: 873
  misc_feature 1..111: note = chr10:15761855-15761966
  misc_feature 1..111: note = hyper
  source 1..111: mol_type = genomic DNA

SEQ ID NO: 3515 - DNA, 81 bp, Homo sapiens
  misc_feature 1..81: note = chr10:16562545-16562626
  misc_feature 1..81: note = hyper
  source 1..81: mol_type = genomic DNA
gaagaagtagatgcccgggatggagcaggtgaacttgccggtggtggggtcgtagtggtttccgaggttggtgaccacgtc

SEQ ID NO: 3516 - DNA, 46 bp, Homo sapiens
  misc_feature 1..46: note = chr10:16562627-16562673
  misc_feature 1..46: note = hyper
  source 1..46: mol_type = genomic DNA
tcgaacttgagcacctcgtagccttcatgctgccgcttgaggccgg

SEQ ID NO: 3517 - DNA, 956 bp, Homo sapiens
  misc_feature 1..956: note = chr10:16562709-16563665
  misc_feature 1..956: note = hyper
  source 1..956: mol_type = genomic DNA
cggcgctgatggccccggccgcgttcaggccgggcgccccgggcgggcccggcaggccttggcggcccggctcgcccttctcgcccgggggccccatggggccgggtggcccgggctctccggggggcccgcgcggacccgccttcccgggcctgccggcctcgcctttggggccctggatgaaggtgggcagggactgcatgaggccgcggtcgggcgtggcagcggtgctgggcgccttggtgcccccgtaggggtcgcagaccatgcggcaggtgcccagcatctcgtagtgcgccgacgtgccggccgagctcaccagcaccgggatgaggatcaccagcagcagcaccatcaccacccccagcgccccggcggcgatcaggcgcctcctgctgcccaccagccggctcagcgcggggcgatcctcttgtctgcttttggacagaattttgaaggttgggcggggacctcttcagagccgaaaacaaccccctgcgaaccccaactcccctgggcgtgcgtgcgccggccgctgctgccgactcctgctccccccgcggaggctgcggctggggagggagcgcgggcgcccagtgacttgagccgaagtcccgagcccggggtgggggccgggggaggggtgcgcggggcgccctcgccccccgcgagctccttcgcacctgtggctgcagccggcgccggcgcggccaccgggagggcagagccagccgccgcctcctgagctcgcccgggcagctcacacttttatgccgccgccgcctgcgatcgacttttccgtttttgcagactgcgcctgttcgcaccaactttccgtctgaagttgcctttttctgcctcctcctcctcttctttcgctcgctcagttcgcccgtccgctgccttttttttttattgcctcctttctctcttcctcctttgccaccaccacaact

SEQ ID NO: 3518 - DNA, 261 bp, Homo sapiens
  misc_feature 1..261: note = chr10:16563690-16563951
  misc_feature 1..261: note = hyper
  source 1..261: mol_type = genomic DNA
cgcgtgggcccgggcgtcccccgggtgcgcccagcggcggcggcggcgggcacggtcggcacggcgaggctcagagctggggcggaggagcgagcgagcagcggcgagcgcctcacggccgggagcggagcgagagagagactgaaggcagaattctgcctgggtaccacctgccaggagaagaggaggctgacaaacgcgcgccggagcaatttataggcacccaaggcacagaggaaggggagccgctttggcatctca

SEQ ID NO: 3519 - DNA, 32 bp, Homo sapiens
  misc_feature 1..32: note = chr10:17271223-17271255
  misc_feature 1..32: note = hyper
  source 1..32: mol_type = genomic DNA
gaccctctttcctaacggggttataaaaacag

SEQ ID NO: 3520 - DNA, 76 bp, Homo sapiens
  misc_feature 1..76: note = chr10:17271443-17271519
  misc_feature 1..76: note = hyper
  source 1..76: mol_type = genomic DNA
cgtcctcctaccgcaggatgttcggcggcccgggcaccgcgagccggccgagctccagccggagctacgtgactac

SEQ ID NO: 3521 - DNA, 221 bp, Homo sapiens
  misc_feature 1..221: note = chr10:17271520-17271741
  misc_feature 1..221: note = hyper
  source 1..221: mol_type = genomic DNA
tccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagct

SEQ ID NO: 3522 - DNA, 615 bp, Homo sapiens; identical to SEQ ID NO: 874
  misc_feature 1..615: note = chr10:22541236-22541851
  misc_feature 1..615: note = hyper
  source 1..615: mol_type = genomic DNA

SEQ ID NO: 3523 - DNA, 226 bp, Homo sapiens; identical to SEQ ID NO: 875
  misc_feature 1..226: note = chr10:22542024-22542250
  misc_feature 1..226: note = hyper
  source 1..226: mol_type = genomic DNA

SEQ ID NO: 3524 - DNA, 560 bp, Homo sapiens; identical to SEQ ID NO: 876
  misc_feature 1..560: note = chr10:22624561-22625121
  misc_feature 1..560: note = hyper
  source 1..560: mol_type = genomic DNA

SEQ ID NO: 3525 - DNA, 401 bp, Homo sapiens; identical to SEQ ID NO: 877
  misc_feature 1..401: note = chr10:22625382-22625783
  misc_feature 1..401: note = hyper
  source 1..401: mol_type = genomic DNA

SEQ ID NO: 3526 - DNA, 292 bp, Homo sapiens; identical to SEQ ID NO: 878
  misc_feature 1..292: note = chr10:22625811-22626103
  misc_feature 1..292: note = hyper
  source 1..292: mol_type = genomic DNA

SEQ ID NO: 3527 - DNA, 190 bp, Homo sapiens; identical to SEQ ID NO: 879
  misc_feature 1..190: note = chr10:22633985-22634175
  misc_feature 1..190: note = hyper
  source 1..190: mol_type = genomic DNA

SEQ ID NO: 3528 - DNA, 108 bp, Homo sapiens; identical to SEQ ID NO: 880
  misc_feature 1..108: note = chr10:22634324-22634432
  misc_feature 1..108: note = hyper
  source 1..108: mol_type = genomic DNA

SEQ ID NO: 3529 - skipped

SEQ ID NO: 3530 - DNA, 215 bp, Homo sapiens; identical to SEQ ID NO: 882
  misc_feature 1..215: note = chr10:22634440-22634655
  misc_feature 1..215: note = hyper
  source 1..215: mol_type = genomic DNA

SEQ ID NO: 3531 - DNA, 897 bp, Homo sapiens; identical to SEQ ID NO: 883
  misc_feature 1..897: note = chr10:22764693-22765590
  misc_feature 1..897: note = hyper
  source 1..897: mol_type = genomic DNA

SEQ ID NO: 3532 - DNA, 274 bp, Homo sapiens
  misc_feature 1..274: note = chr10:23216856-23217130
  misc_feature 1..274: note = hyper
  source 1..274: mol_type = genomic DNA
tcctcccgcactggccgctgccctcggcgggacaatgggcgccctagcagccccgagcgttcccagggcgcaggcgcggcgcggcgtggcgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 3533 - DNA, 91 bp, Homo sapiens
  misc_feature 1..91: note = chr10:23462524-23462615
  misc_feature 1..91: note = hyper
  source 1..91: mol_type = genomic DNA
ccggtgcccacatgccgcccccacacgcccccacccccgtccggcgcaagacttcccttggccaaaagaggcgtttaattagttctggggc

SEQ ID NO: 3534 - DNA, 298 bp, Homo sapiens
  misc_feature 1..298: note = chr10:23462634-23462932
  misc_feature 1..298: note = hyper
  source 1..298: mol_type = genomic DNA
cgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtg

SEQ ID NO: 3535 - DNA, 588 bp, Homo sapiens
  misc_feature 1..588: note = chr10:23463266-23463854
  misc_feature 1..588: note = hyper
  source 1..588: mol_type = genomic DNA
cgagccgggcctttggctgcgccagggcccaggccgagtcatcccgccgctcgcgtcgccgcgaggcgggacaccgtgtgatacctttgccgtgggctgggcgtcggccgcggggcggagagcgggtgtcccacctcgcctcatcatttgatttccgccagcgtctgaggacggcgcacccaattcgttccactcgctgcgctctgtgaaccagcggcgggcagggcgggggaggccgggctgggggagggcagggtggtcccaatcccccgcccccgccccgccggcctcgcggagcacaagtgttgggattcccacgggcaggcgtgctctgcggctggaggcccgagcgcccagggcccaggagacgtggcggacacagaggggtttgtaggcacggtgacctccgtgctcctgctctgaaagggcctgaaaggagcggtttatggtgcattaccagtcaagggctcaggtaccagcgccttgtgtcgggaacccgggcggccgcccgtgctgcaggtgtctgctatacaaacgccccgggagggggagggcaggccgccggattgggggccggggaggggcctc

SEQ ID NO: 3536 - DNA, 190 bp, Homo sapiens
  misc_feature 1..190: note = chr10:23463887-23464077
  misc_feature 1..190: note = hyper
  source 1..190: mol_type = genomic DNA
cgctcttgctcctctgcagccatagcagccagccaggggtgcagacggagatcctagctgccgggacagaaaaagctgcaggggcctggctgcccagtcccgatttggtttcaagactaacggcagcaggaggtcacaggaggcttgaacctctccggggagacaaccgctgtgccggggaagaaacatt

SEQ ID NO: 3537 - DNA, 734 bp, Homo sapiens; identical to SEQ ID NO: 884
  misc_feature 1..734: note = chr10:23483777-23484511
  misc_feature 1..734: note = hyper
  source 1..734: mol_type = genomic DNA

SEQ ID NO: 3538 - DNA, 413 bp, Homo sapiens
  misc_feature 1..413: note = chr10:23487742-23488155
  misc_feature 1..413: note = hyper
  source 1..413: mol_type = genomic DNA
gcattactttcaagccgaacaaaggccagggccggggggaggcgggggaagggctcggctgtaatgaagcgcctctaaggcggaggtgctgccgtggaggctgaggcggcggcggagcgcgctgctgcgtttgtgcgcaagtgactctcctgtgccacacacaaaaggcctccctcttcccaccttctgccgcctttcagccctccggctcctgccgagcccgctcctgggactctgggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtg

SEQ ID NO: 3539 - DNA, 1097 bp, Homo sapiens; identical to SEQ ID NO: 885
  misc_feature 1..1097: note = chr10:23488393-23489490
  misc_feature 1..1097: note = hyper
  source 1..1097: mol_type = genomic DNA

SEQ ID NO: 3540 - DNA, 886 bp, Homo sapiens; identical to SEQ ID NO: 886
  misc_feature 1..886: note = chr10:23982394-23983280
  misc_feature 1..886: note = hyper
  source 1..886: mol_type = genomic DNA

SEQ ID NO: 3541 - DNA, 83 bp, Homo sapiens
  misc_feature 1..83: note = chr10:23984130-23984213
  misc_feature 1..83: note = hyper
  source 1..83: mol_type = genomic DNA
ggagaggcgagggggcggcagcctcggcccgaagtaagtgcagcagaagtttgcgtcggttgccccgccgctcccccagcgcg

SEQ ID NO: 3542 - DNA, 147 bp, Homo sapiens
  misc_feature 1..147: note = chr10:25465203-25465350
  misc_feature 1..147: note = hyper
  source 1..147: mol_type = genomic DNA
ttcctctgccatctacgggttgcagcctaacctggtcccggaattcaggtagggagggccggggggcaggggggaaggcaaaagcgaagctttccttccggtcttgtgggtgggtgcacgtgtgaggaaggaacccttggctgtgac

SEQ ID NO: 3543 - DNA, 204 bp, Homo sapiens
  misc_feature 1..204: note = chr10:25465351-25465555
  misc_feature 1..204: note = hyper
  source 1..204: mol_type = genomic DNA
cgaacgcttctcaccctcagagtagagacccgggctgagggacaccccacgcgggcgcgggtgcttgggggcaagaagcgccccacgcccgtcagcttccggcgctcggcgaaagccattcattctctcggaccagtttccccgcactgggcgagggacaggcagcccttggcaggacggagacacccccgctgctctgtgctt

SEQ ID NO: 3544 - DNA, 279 bp, Homo sapiens; identical to SEQ ID NO: 887
  misc_feature 1..279: note = chr10:26500592-26500871
  misc_feature 1..279: note = hyper
  source 1..279: mol_type = genomic DNA

SEQ ID NO: 3545 - DNA, 130 bp, Homo sapiens
  misc_feature 1..130: note = chr10:26504014-26504144
  misc_feature 1..130: note = hyper
  source 1..130: mol_type = genomic DNA
cccagacgggatccccgggtctctgctttgttagcagctttggtggctggttcaggaggtcagagaaataaaacgacttgtgaacacaatggaaatgacaggcgctctggccaggcgcggggaaggcagc

SEQ ID NO: 3546 - DNA, 694 bp, Homo sapiens
  misc_feature 1..694: note = chr10:26504190-26504884
  misc_feature 1..694: note = hyper
  source 1..694: mol_type = genomic DNA
cgtctcccccagagccccggagctccgaggtgcacttgaagttcatctccactgccaggagaacgcagcgcaaactgtcaaagggctcccaatccttagggcgtcctccctgtctgcaatagctttttgtagaaaggaaatcatcagaacgattctgactttctcctcctttctttattagaaaaagagaaaccgcctcctaatacgcctcagagagaaccaatctcgcgcttccgggtcacccgctaccgcgaagattctctgggggcgagggggggcattggtttgaagccccttaaaacgagggccctgcaggcgatgccttctttcctactcggatttgtaaagccgagattgcttagttggaaaccctgttctcccctcccaggcgcacacagatcccccttacacgcaagcagcgggcgcttccacgcctccgcgggccaaggtcaccaaatgccctgattccatcccccacccgccatcaatcctgccgactctggccgctctgcctcattctcttccaagaagtttccattcgttttatttttttttccccagcccgaggtcctcagtagactccagcgtggattttaattgcctcaatcagcagtcattctccccagccgtcactcagagcctggacggtgggtcccgcgatctagcccttggctacgcaggaacggtgcgcccc

SEQ ID NO: 3547 - DNA, 200 bp, Homo sapiens
  misc_feature 1..200: note = chr10:26505008-26505208
  misc_feature 1..200: note = hyper
  source 1..200: mol_type = genomic DNA
cgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgc

SEQ ID NO: 3548 - DNA, 90 bp, Homo sapiens
  misc_feature 1..90: note = chr10:26506073-26506163
  misc_feature 1..90: note = hyper
  source 1..90: mol_type = genomic DNA
ggggacatggaattccgtggtcctggggcgctgctaagatccgggtgtctggaccctggggtgggacggagtgaccgtgaagatagaaaa

SEQ ID NO: 3549 - DNA, 246 bp, Homo sapiens; identical to SEQ ID NO: 888
  misc_feature 1..246: note = chr10:26506373-26506619
  misc_feature 1..246: note = hyper
  source 1..246: mol_type = genomic DNA

SEQ ID NO: 3550 - DNA, 518 bp, Homo sapiens; identical to SEQ ID NO: 889
  misc_feature 1..518: note = chr10:26506902-26507420
  misc_feature 1..518: note = hyper
  source 1..518: mol_type = genomic DNA

SEQ ID NO: 3551 - DNA, 200 bp, Homo sapiens; identical to SEQ ID NO: 890
  misc_feature 1..200: note = chr10:26727617-26727817
  misc_feature 1..200: note = hyper
  source 1..200: mol_type = genomic DNA

SEQ ID NO: 3552 - DNA, 183 bp, Homo sapiens; identical to SEQ ID NO: 891
  misc_feature 1..183: note = chr10:26727867-26728050
  misc_feature 1..183: note = hyper
  source 1..183: mol_type = genomic DNA

SEQ ID NO: 3553 - DNA, 606 bp, Homo sapiens
  misc_feature 1..606: note = chr10:27547726-27548332
  misc_feature 1..606: note = hyper
  source 1..606: mol_type = genomic DNA
gcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctcctt

SEQ ID NO: 3554 - DNA, 15 bp, Homo sapiens
  misc_feature 1..15: note = chr10:27548400-27548415
  misc_feature 1..15: note = hyper
  source 1..15: mol_type = genomic DNA
cgaatccattcttgg

SEQ ID NO: 3555 - DNA, 391 bp, Homo sapiens
  misc_feature 1..391: note = chr10:28034909-28035300
  misc_feature 1..391: note = hyper
  source 1..391: mol_type = genomic DNA
ccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtg

SEQ ID NO: 3556 - DNA, 374 bp, Homo sapiens
  misc_feature 1..374: note = chr10:43250406-43250780
  misc_feature 1..374: note = hyper
  source 1..374: mol_type = genomic DNA
aggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacc

SEQ ID NO: 3557 - DNA, 39 bp, Homo sapiens
  misc_feature 1..39: note = chr10:43250854-43250893
  misc_feature 1..39: note = hyper
  source 1..39: mol_type = genomic DNA
cgcccaggccgccggctcggtgagcgcagagaggggccc

SEQ ID NO: 3558 - DNA, 92 bp, Homo sapiens; identical to SEQ ID NO: 892
  misc_feature 1..92: note = chr10:43429066-43429158
  misc_feature 1..92: note = hyper
  source 1..92: mol_type = genomic DNA

SEQ ID NO: 3559 - DNA, 77 bp, Homo sapiens
  misc_feature 1..77: note = chr10:43429361-43429438
  misc_feature 1..77: note = hyper
  source 1..77: mol_type = genomic DNA
tagcccagctgcagccggatcctccctgagcgcagcgcaggggtcacagcccccgacagctgcgcaagtctattcct

SEQ ID NO: 3560 - DNA, 28 bp, Homo sapiens
  misc_feature 1..28: note = chr10:49732060-49732088
  misc_feature 1..28: note = hyper
  source 1..28: mol_type = genomic DNA
ccgcagggagcggggcgcacgtgcgcgc

SEQ ID NO: 3561 - DNA, 160 bp, Homo sapiens
  misc_feature 1..160: note = chr10:49732155-49732315
  misc_feature 1..160: note = hyper
  source 1..160: mol_type = genomic DNA
cgcccgcggccccgccgctcggctcctctccccgcctgccgcctgcgccccggggcggcgcggccgaggtccggcccacgggcagtgcccagctgggcgcagggtgcgcgggaccgccggcccgcggctcccgggccctcacactccaccgcggccccgc

SEQ ID NO: 3562 - DNA, 227 bp, Homo sapiens
  misc_feature 1..227: note = chr10:49732316-49732543
  misc_feature 1..227: note = hyper
  source 1..227: mol_type = genomic DNA
cagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgc

SEQ ID NO: 3563 - DNA, 261 bp, Homo sapiens
  misc_feature 1..261: note = chr10:50603909-50604170
  misc_feature 1..261: note = hyper
  source 1..261: mol_type = genomic DNA
ggccaggaaggcagccgagccccaaggcccggcgctcggggcccggcgagtgggtcaggagccgagcatacctcggcgggcggcggtcgaggaggtcggagcgtgaccgcctccgatccgcaagccctgctcggctggcggcgggcggggctcggcgcggctggcgcccgcaggaccaaagaagtgactcgggaagtggccagatgtcttgctgtctgtctgcagcgcgcgccgccgctcagcactcgcctttataatctc

SEQ ID NO: 3564 - DNA, 1458 bp, Homo sapiens; identical to SEQ ID NO: 893
  misc_feature 1..1458: note = chr10:50605213-50606671
  misc_feature 1..1458: note = hyper
  source 1..1458: mol_type = genomic DNA

SEQ ID NO: 3565 - DNA, 189 bp, Homo sapiens
  misc_feature 1..189: note = chr10:50821472-50821661
  misc_feature 1..189: note = hyper
  source 1..189: mol_type = genomic DNA
agagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgt

SEQ ID NO: 3566 - DNA, 30 bp, Homo sapiens
  misc_feature 1..30: note = chr10:60937073-60937103
  misc_feature 1..30: note = hyper
  source 1..30: mol_type = genomic DNA
aaggggaaatgccctcgggatgtttctagc

SEQ ID NO: 3567 - DNA, 342 bp, Homo sapiens
  misc_feature 1..342: note = chr10:64578287-64578629
  misc_feature 1..342: note = hyper
  source 1..342: mol_type = genomic DNA
gctgcgttcttaccacgtgcgccagcccactccgcctgcgctctggcgggtcccgcggcccccgcgctgaccatgggcaagacgacgcctcggaagggagtccgactcgcatctcgggccctgagtccgaaagaacgggggaaagccgaattatgcaaatgcggatccctgcgatggggctcgggttacggcccccgccggccccttaggtgaggcacccaccggcagcaagcgcgggcgaggcgactgctcgcgcttcgctcctctctgcgcacgtgggcggaccggcaggcgggcgagttgcccgggccgccccgcgactggcgctgctgccaaacccgc

SEQ ID NO: 3568 - skipped

SEQ ID NO: 3569 - DNA, 462 bp, Homo sapiens; identical to SEQ ID NO: 894
  misc_feature 1..462: note = chr10:71331980-71332442
  misc_feature 1..462: note = hyper
  source 1..462: mol_type = genomic DNA

SEQ ID NO: 3570 - DNA, 89 bp, Homo sapiens
  misc_feature 1..89: note = chr10:72015293-72015382
  misc_feature 1..89: note = hyper
  source 1..89: mol_type = genomic DNA
gggcgtacatgaccacgatgagcgccagcggcgccaggtagatgtgcgagaagagcacagtggtgtagaccctgcgcatgcccttctcg

SEQ ID NO: 3571 - DNA, 15 bp, Homo sapiens
  misc_feature 1..15: note = chr10:72200050-72200065
  misc_feature 1..15: note = hyper
  source 1..15: mol_type = genomic DNA
gccccctcccatccc

SEQ ID NO: 3572 - DNA, 655 bp, Homo sapiens; identical to SEQ ID NO: 896
  misc_feature 1..655: note = chr10:72200117-72200772
  misc_feature 1..655: note = hyper
  source 1..655: mol_type = genomic DNA

SEQ ID NO: 3573 - DNA, 557 bp, Homo sapiens; identical to SEQ ID NO: 897
  misc_feature 1..557: note = chr10:72200824-72201381
  misc_feature 1..557: note = hyper
  source 1..557: mol_type = genomic DNA

SEQ ID NO: 3574 - DNA, 72 bp, Homo sapiens
  misc_feature 1..72: note = chr10:73847720-73847792
  misc_feature 1..72: note = hyper
  source 1..72: mol_type = genomic DNA
gggacaggggaggggcgctgggctgtgacccccagtactgtttactttccgtgtaattagccggccaggctg

SEQ ID NO: 3575 - DNA, 14 bp, Homo sapiens
  misc_feature 1..14: note = chr10:73848208-73848222
  misc_feature 1..14: note = hyper
  source 1..14: mol_type = genomic DNA
ggtgactggcggag

SEQ ID NO: 3576 - DNA, 777 bp, Homo sapiens
  misc_feature 1..777: note = chr10:79396686-79397463
  misc_feature 1..777: note = hyper
  source 1..777: mol_type = genomic DNA
tggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccacccc

SEQ ID NO: 3577 - DNA, 512 bp, Homo sapiens
  misc_feature 1..512: note = chr10:90967644-90968156
  misc_feature 1..512: note = hyper
  source 1..512: mol_type = genomic DNA
gtccccgaacgccggcggtgaccgtcagctcaggaaatcagacgggaagggtggccggatgggaacctccgccagctccagcttgtccccagagttttcctggccggcgggcagcaagctagagagaccacgcacgcaggctctccgggagaggccgcagcccggccgcgtagctaccctcggcggcgcgtcccggggcgccgggcccgcgatcggagccggaggcaccgcacagcggaaagagggctccgcggcggccaggctcagctttgccgggaaaatgctggatttaactcccagtctgcgccaatctggctaaaaagcccgttgtatctcaatttggggcgggaacacttaattcagcaaaccacctgcgttgttcgtcaagggaaagagatgtgagttcctgaagcctcccgggaggctattgaaggaccaggtgatgtcgtcactaccctacccttccccttgttggctttgcggggccaacttgcagtcgccctctgccaccg

SEQ ID NO: 3578 - DNA, 139 bp, Homo sapiens
  misc_feature 1..139: note = chr10:92617227-92617366
  misc_feature 1..139: note = hyper
  source 1..139: mol_type = genomic DNA
ggcattgtccgggggcgcgtcccaggtgggcgccgggctggctgtcacctcgctcagcaggtgcggcgcccaggagcccgcgaccgggtcggcgccaccgtcggggctcaagtcgggcagcccgcgccccacttctggc

SEQ ID NO: 3579 - DNA, 159 bp, Homo sapiens; identical to SEQ ID NO: 898
  misc_feature 1..159: note = chr10:94828735-94828894
  misc_feature 1..159: note = hyper
  source 1..159: mol_type = genomic DNA

SEQ ID NO: 3580 - DNA, 937 bp, Homo sapiens; identical to SEQ ID NO: 899
  misc_feature 1..937: note = chr10:94834033-94834970
  misc_feature 1..937: note = hyper
  source 1..937: mol_type = genomic DNA

SEQ ID NO: 3581 - DNA, 185 bp, Homo sapiens
  misc_feature 1..185: note = chr10:99080262-99080447
  misc_feature 1..185: note = hyper
  source 1..185: mol_type = genomic DNA
gcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgcca

SEQ ID NO: 3582 - DNA, 119 bp, Homo sapiens; identical to SEQ ID NO: 900
  misc_feature 1..119: note = chr10:99789175-99789294
  misc_feature 1..119: note = hyper
  source 1..119: mol_type = genomic DNA

SEQ ID NO: 3583 - DNA, 32 bp, Homo sapiens; identical to SEQ ID NO: 901
  misc_feature 1..32: note = chr10:99790308-99790340
  misc_feature 1..32: note = hyper
  source 1..32: mol_type = genomic DNA

SEQ ID NO: 3584 - DNA, 323 bp, Homo sapiens; identical to SEQ ID NO: 902
  misc_feature 1..323: note = chr10:99790437-99790760
  misc_feature 1..323: note = hyper
  source 1..323: mol_type = genomic DNA

SEQ ID NO: 3585 - DNA, 260 bp, Homo sapiens; identical to SEQ ID NO: 903
  misc_feature 1..260: note = chr10:99790917-99791177
  misc_feature 1..260: note = hyper
  source 1..260: mol_type = genomic DNA

SEQ ID NO: 3586 - DNA, 74 bp, Homo sapiens; identical to SEQ ID NO: 904
  misc_feature 1..74: note = chr10:100992117-100992191
  misc_feature 1..74: note = hyper
  source 1..74: mol_type = genomic DNA

SEQ ID NO: 3587 - skipped

SEQ ID NO: 3588 - DNA, 451 bp, Homo sapiens; identical to SEQ ID NO: 906
  misc_feature 1..451: note = chr10:100993487-100993938
  misc_feature 1..451: note = hyper
  source 1..451: mol_type = genomic DNA

SEQ ID NO: 3589 - DNA, 456 bp, Homo sapiens; identical to SEQ ID NO: 907
  misc_feature 1..456: note = chr10:100993939-100994395
  misc_feature 1..456: note = hyper
  source 1..456: mol_type = genomic DNA

SEQ ID NO: 3590 - DNA, 427 bp, Homo sapiens; identical to SEQ ID NO: 908
  misc_feature 1..427: note = chr10:100995797-100996224
  misc_feature 1..427: note = hyper
  source 1..427: mol_type = genomic DNA

SEQ ID NO: 3591 - DNA, 327 bp, Homo sapiens; identical to SEQ ID NO: 909
  misc_feature 1..327: note = chr10:101290372-101290699
  misc_feature 1..327: note = hyper
  source 1..327: mol_type = genomic DNA

SEQ ID NO: 3592 - DNA, 443 bp, Homo sapiens; identical to SEQ ID NO: 910
  misc_feature 1..443: note = chr10:101290700-101291143
  misc_feature 1..443: note = hyper
  source 1..443: mol_type = genomic DNA

SEQ ID NO: 3593 - DNA, 403 bp, Homo sapiens; identical to SEQ ID NO: 911
  misc_feature 1..403: note = chr10:101292461-101292864
  misc_feature 1..403: note = hyper
  source 1..403: mol_type = genomic DNA

SEQ ID NO: 3594 - DNA, 290 bp, Homo sapiens
  misc_feature 1..290: note = chr10:101293164-101293454
  misc_feature 1..290: note = hyper
  source 1..290: mol_type = genomic DNA
gtccacacggtcctgcgagactcgtgcagcgagcccaaggaacatgaagaggagcccgaggtcgtgagggaccggagccaaagtgagtagagggggaaagaaaacgcacccgcacacctggagcaatggcagagcgcacacaaacagcccacagaccttgccagcgcagctgcccatccctttaccctttggctggggccatgcctccgccctggtcaccgacagctccacaaagcgcaggtacctgcaagggagccggggtggagagacaaggacgaggtgaccctgac

SEQ ID NO: 3595 - DNA, 644 bp, Homo sapiens
  misc_feature 1..644: note = chr10:101294756-101295400
  misc_feature 1..644: note = hyper
  source 1..644: mol_type = genomic DNA
agaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagc

SEQ ID NO: 3596 - DNA, 152 bp, Homo sapiens
  misc_feature 1..152: note = chr10:101295401-101295553
  misc_feature 1..152: note = hyper
  source 1..152: mol_type = genomic DNA
cacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgac

SEQ ID NO: 3597 - DNA, 111 bp, Homo sapiens
  misc_feature 1..111: note = chr10:102484269-102484380
  misc_feature 1..111: note = hyper
  source 1..111: mol_type = genomic DNA
cgcggggccccggggcggctccaagcccggcgggctccgcggcggcggcgaccaggctcgcttcccacttgggctgcgggcggcatggtccctctgcgcccatccggctct

SEQ ID NO: 3598 - DNA, 15 bp, Homo sapiens
  misc_feature 1..15: note = chr10:102497161-102497176
  misc_feature 1..15: note = hyper
  source 1..15: mol_type = genomic DNA
gggcggccgcttacc

SEQ ID NO: 3599 - DNA, 46 bp, Homo sapiens
  misc_feature 1..46: note = chr10:102497252-102497298
  misc_feature 1..46: note = hyper
  source 1..46: mol_type = genomic DNA
cgggtgcgggtctcgtgttccaggcagcagcagctccgggaaaggc

SEQ ID NO: 3600 - DNA, 26 bp, Homo sapiens
  misc_feature 1..26: note = chr10:102497299-102497325
  misc_feature 1..26: note = hyper
  source 1..26: mol_type = genomic DNA
ggggggagctgcggagctgggcagga

SEQ ID NO: 3601 - DNA, 241 bp, Homo sapiens; identical to SEQ ID NO: 912
  misc_feature 1..241: note = chr10:102497525-102497766
  misc_feature 1..241: note = hyper
  source 1..241: mol_type = genomic DNA

SEQ ID NO: 3602 - DNA, 128 bp, Homo sapiens
  misc_feature 1..128: note = chr10:102501247-102501375
  misc_feature 1..128: note = hyper
  source 1..128: mol_type = genomic DNA
aggagggggaaaggccgggcaggagccggtcaggcctttctgcggaaggggctggggtgtaagtttcggctccctgggatctgacagccgagggtatgcgccctggggtgcgccgggacccagagggc

SEQ ID NO: 3603 - DNA, 69 bp, Homo sapiens; identical to SEQ ID NO: 913
  misc_feature 1..69: note = chr10:102507467-102507536
  misc_feature 1..69: note = hyper
  source 1..69: mol_type = genomic DNA

SEQ ID NO: 3604 - DNA, 1165 bp, Homo sapiens; identical to SEQ ID NO: 914
  misc_feature 1..1165: note = chr10:102589250-102590415
  misc_feature 1..1165: note = hyper
  source 1..1165: mol_type = genomic DNA

SEQ ID NO: 3605 - DNA, 51 bp, Homo sapiens
  misc_feature 1..51: note = chr10:102890968-102891019
  misc_feature 1..51: note = hyper
  source 1..51: mol_type = genomic DNA
caccccgctcctctccgcgcacagccaatggagagacccagtcgaaaccgc

SEQ ID NO: 3606 - DNA, 274 bp, Homo sapiens
  misc_feature 1..274: note = chr10:102891020-102891294
  misc_feature 1..274: note = hyper
  source 1..274: mol_type = genomic DNA
aagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggc

SEQ ID NO: 3607 - DNA, 380 bp, Homo sapiens
  misc_feature 1..380: note = chr10:102891576-102891956
  misc_feature 1..380: note = hyper
  source 1..380: mol_type = genomic DNA
catgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctg

SEQ ID NO: 3608 - DNA, 369 bp, Homo sapiens; identical to SEQ ID NO: 915
  misc_feature 1..369: note = chr10:102893583-102893952
  misc_feature 1..369: note = hyper
  source 1..369: mol_type = genomic DNA

SEQ ID NO: 3609 - DNA, 1155 bp, Homo sapiens; identical to SEQ ID NO: 916
  misc_feature 1..1155: note = chr10:102894090-102895245
  misc_feature 1..1155: note = hyper
  source 1..1155: mol_type = genomic DNA

SEQ ID NO: 3610 - DNA, 683 bp, Homo sapiens; identical to SEQ ID NO: 917
  misc_feature 1..683: note = chr10:102899173-102899856
  misc_feature 1..683: note = hyper
  source 1..683: mol_type = genomic DNA

SEQ ID NO: 3611 - DNA, 372 bp, Homo sapiens; identical to SEQ ID NO: 918
  misc_feature 1..372: note = chr10:102900262-102900634
  misc_feature 1..372: note = hyper
  source 1..372: mol_type = genomic DNA

SEQ ID NO: 3612 - DNA, 135 bp, Homo sapiens; identical to SEQ ID NO: 919
  misc_feature 1..135: note = chr10:102983245-102983380
  misc_feature 1..135: note = hyper
  source 1..135: mol_type = genomic DNA

SEQ ID NO: 3613 - DNA, 315 bp, Homo sapiens; identical to SEQ ID NO: 920
  misc_feature 1..315: note = chr10:102983434-102983749
  misc_feature 1..315: note = hyper
  source 1..315: mol_type = genomic DNA

SEQ ID NO: 3614 - DNA, 1497 bp, Homo sapiens
  misc_feature 1..1497: note = chr10:102985456-102986953
  misc_feature 1..1497: note = hyper
  source 1..1497: mol_type = genomic DNA
caaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctc

SEQ ID NO: 3615 - DNA, 136 bp, Homo sapiens
  misc_feature 1..136: note = chr10:102987206-102987342
  misc_feature 1..136: note = hyper
  source 1..136: mol_type = genomic DNA
gccaccgccggctgtggcctccgagttctgctcgagttcggccagcgccacgatgtccatctgcccgctggggcccagtttcttggcggactctacgtcggccttcatctcctccaggtcccgcttgagcttagcg

SEQ ID NO: 3616 - DNA, 455 bp, Homo sapiens; identical to SEQ ID NO: 921
  misc_feature 1..455: note = chr10:102996026-102996481
  misc_feature 1..455: note = hyper
  source 1..455: mol_type = genomic DNA

SEQ ID NO: 3617 - DNA, 123 bp, Homo sapiens; identical to SEQ ID NO: 922
  misc_feature 1..123: note = chr10:102996596-102996719
  misc_feature 1..123: note = hyper
  source 1..123: mol_type = genomic DNA

SEQ ID NO: 3618 - DNA, 142 bp, Homo sapiens
  misc_feature 1..142: note = chr10:102997086-102997228
  misc_feature 1..142: note = hyper
  source 1..142: mol_type = genomic DNA
cagtcctgcgggggccggcatgcaccagacctcaaaagggatcttcacgggaattccgcatagccagatcccaagcctccagggaggccaccagccctcccccatcttcttcttcctcctccgtctcctttcctcttccctc

SEQ ID NO: 3619 - DNA, 303 bp, Homo sapiens
  misc_feature 1..303: note = chr10:102997281-102997584
  misc_feature 1..303: note = hyper
  source 1..303: mol_type = genomic DNA
cgccacagccctgtcccctagggagaggcctggactaactttgccgtcctcgtggccttagcccggactgtgagtctcgagcggcttccgagaggcagctcgggtgtcttcgcagagacagatgaggtgggctggcgattccctagcctcagatggctctgccaccagccagctctgtgatcctgggtaagtctttcaacctctctgagtcttgacgttggtaaaaggcaggagatttagagaaggtgttgggagactaaatcttttcattcgtttgagaaagggagtcgcctgtgttgggac

SEQ ID NO: 3620 - DNA, 503 bp, Homo sapiens; identical to SEQ ID NO: 923
  misc_feature 1..503: note = chr10:102998356-102998859
  misc_feature 1..503: note = hyper
  source 1..503: mol_type = genomic DNA

SEQ ID NO: 3621 - DNA, 304 bp, Homo sapiens; identical to SEQ ID NO: 924
  misc_feature 1..304: note = chr10:103043924-103044228
  misc_feature 1..304: note = hyper
  source 1..304: mol_type = genomic DNA

SEQ ID NO: 3622 - DNA, 99 bp, Homo sapiens; identical to SEQ ID NO: 925
  misc_feature 1..99: note = chr10:103044300-103044399
  misc_feature 1..99: note = hyper
  source 1..99: mol_type = genomic DNA

SEQ ID NO: 3623 - DNA, 177 bp, Homo sapiens
  misc_feature 1..177: note = chr10:103536320-103536497
  misc_feature 1..177: note = hyper
  source 1..177: mol_type = genomic DNA
gggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccg

SEQ ID NO: 3624 - DNA, 62 bp, Homo sapiens
  misc_feature 1..62: note = chr10:104170201-104170263
  misc_feature 1..62: note = hyper
  source 1..62: mol_type = genomic DNA
ctttttggctgtccacgcggcgggggagcagtgtggagtgtacccccatccaatccctgtcc

SEQ ID NO: 3625 - DNA, 106 bp, Homo sapiens
  misc_feature 1..106: note = chr10:104170407-104170513
  misc_feature 1..106: note = hyper
  source 1..106: mol_type = genomic DNA
cgcatgtgcgcatgttccgggagagcctgcgcgtggggcctggggagggggcggtccccaggctgagtcacgagagcccgggcttccgtggcaggagccgggggtc

SEQ ID NO: 3626 - DNA, 287 bp, Homo sapiens
  misc_feature 1..287: note = chr10:104170514-104170801
  misc_feature 1..287: note = hyper
  source 1..287: mol_type = genomic DNA
gcaagccccagccctgccctccctccgactctggactccgtcgccgactgggtcctccatccttcccctccagcgacttctaccctgccccgccccccaccttgagcagctccctagggaagtcgccgccatcattgaggccctccaggttcccgatgaagtccccgcaggtcatgcgcttcccgatgttctaaggaagggaacggaggcctgtgagtttggagggcccttggcctcccaggtcctgcatgtctggccaggggtttgttttccggctcctgcccgcc

SEQ ID NO: 3627 - DNA, 209 bp, Homo sapiens
  misc_feature 1..209: note = chr10:105036450-105036659
  misc_feature 1..209: note = hyper
  source 1..209: mol_type = genomic DNA
gtaactggaaaaacacgacctcgccctcgggaaggctttctgtgcgcctcacctcaggatgagggtgggtgtaggggacacctcccagaaacccctaacctcccagtcggttaaagaagaggggatagggtcaagggatgcgacagagctgtgtggtttccggatgggaaacctcagtcgtttaggcacccctccgctcgagtcacttc

SEQ ID NO: 3628 - DNA, 163 bp, Homo sapiens
  misc_feature 1..163: note = chr10:105036700-105036863
  misc_feature 1..163: note = hyper
  source 1..163: mol_type = genomic DNA
cgactccgatgcagatggccctgtcccggcgccccaggtcgtcgcgcgcgcagctgcggtagtcactgcgcctccccgcccccactcctggatgccccccttccctctcccggccagactctgagcaggagctccgcccccagcgcgccgccccagccccggc

SEQ ID NO: 3629 - DNA, 19 bp, Homo sapiens
  misc_feature 1..19: note = chr10:105036864-105036883
  misc_feature 1..19: note = hyper
  source 1..19: mol_type = genomic DNA
ccttaaaagccgggcgcac

SEQ ID NO: 3630 - DNA, 717 bp, Homo sapiens
  misc_feature 1..717: note = chr10:105036893-105037610
  misc_feature 1..717: note = hyper
  source 1..717: mol_type = genomic DNA
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggag

SEQ ID NO: 3631 - DNA, 934 bp, Homo sapiens
  misc_feature 1..934: note = chr10:106399442-106400376
  misc_feature 1..934: note = hyper
  source 1..934: mol_type = genomic DNA
atcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggatctcagctgcaccaagcgcgcaggctacactcctgcagtagcggattggggaccagataagcccacgcggctcccgcctgagtaccctcttaactggcggccgacactttgaaacaattgagtccgttcagaaacggactggggagagtgagggcacgacctcaaaatcctaggcagcaaaatgaggtctggatcctccctggaagaacagacatctcgactactctctcgccccacctctggccgggaggtcggggcaaggagaatccctcaaccgagaagatctggcaagtccccgatcccaccggggccttccgcctcttttccctcatcccctaggaggctttatcaggttctaaccgcttgtagtgggggccgtgggtgctcggggcgccaagaggagggggctgccgagagcggcctgcctagttctcagcattgcctctttgaccactcgcaggctcctggaaatgcaaacacagcccgtgcgtgatccgcacgcgaccaaaagccgagcgcacacctcccgcccccgccccacttgccatcgctcacactaacgtgcacacatgctcgtgcaaacgcgcacgcacggaaccgcgcgccccctcacacccagccgcgctcccggcccggctcagccaggtgcccccacgcggcagcgcccggtctgcccgccggccccctgcgaacccctcgcctcacgcccgcctgcctgcgcgcacgcacgcgcacgcacgcattccccacgcccccgcgcgggggcgcaggccttgggtggcggggtttggccggg

SEQ ID NO: 3632 - DNA, 110 bp, Homo sapiens
  misc_feature 1..110: note = chr10:106400808-106400918
  misc_feature 1..110: note = hyper
  source 1..110: mol_type = genomic DNA
taagaaagaaagcaccgaaggggcaattattaattttcctcgggtttggaatcaccctctggacaagagaacgggcgagcgggagctaggagggaagagtggagaggacc

SEQ ID NO: 3633 - DNA, 111 bp, Homo sapiens
  misc_feature 1..111: note = chr10:106401322-106401433
  misc_feature 1..111: note = hyper
  source 1..111: mol_type = genomic DNA
gtgctggggcgccgggccggaccagagctgctgccccagcagggcggcggcagaggcggtgagatgcaggtggaagccggagggacatcaccggcaggcgagcggcggggc

SEQ ID NO: 3634 - DNA, 681 bp, Homo sapiens
  misc_feature 1..681: note = chr10:106401510-106402191
  misc_feature 1..681: note = hyper
  source 1..681: mol_type = genomic DNA
cggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtgagtacccacccggcggcgggtccgcctgtttcctgacaccgaaggggaatgggggggtgggtgggagcgagggacagatagttgctcgggggtcgaggcgggggacgcctcgacttttcgagataacaggtttgtccgattccccccacgcccccaacaggttaacggagtttgttgttagacgctgtgtgtgtttgtttactggagaccctaggcttcggccgccgggaggggagtggaggaaggggcttcttaaagatgagtgggggagggatctgtgctcactttctccaatacttggcttggagggtcagttttcctgtttgcggggtgcttgaattcttggatgagaaaaagggctgacttggggcgggagccgctgaacagaccgattcctgcggctgccgggctccccctacccccaccccacccccaccccccctcccgtcacgcgaaagggaacccggaaggccatt

SEQ ID NO: 3635 - DNA, 80 bp, Homo sapiens
  misc_feature 1..80: note = chr10:106402271-106402351
  misc_feature 1..80: note = hyper
  source 1..80: mol_type = genomic DNA
cggccaagtcggcccccagccttggccttcaggtaaccccggttcctccttcaaagtccagggagcggccctggaaagcc

SEQ ID NO: 3636 - DNA, 205 bp, Homo sapiens
  misc_feature 1..205: note = chr10:106402620-106402825
  misc_feature 1..205: note = hyper
  source 1..205: mol_type = genomic DNA
cggtctggcctactccggcattccgaactgggcgcccgactgagcatcgcgcctgcctggcagctgcagcggcccgcagcgcgtgcccggaggggctccccctacctcgccggcacccagcgctgtgcagccaagcaaagaaaaggcgggggacaggttcccaccatctccccgacttccctccctcccgcggtccctactagag

SEQ ID NO: 3637 - DNA, 180 bp, Homo sapiens
  misc_feature 1..180: note = chr10:110672065-110672245
  misc_feature 1..180: note = hyper
  source 1..180: mol_type = genomic DNA
cagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggacccc

SEQ ID NO: 3638 - DNA, 51 bp, Homo sapiens
  misc_feature 1..51: note = chr10:111216345-111216396
  misc_feature 1..51: note = hyper
  source 1..51: mol_type = genomic DNA
agatgtgcagagagtcgcctgtcggagcaaatgtgacgctgattggcttca

SEQ ID NO: 3639 - DNA, 79 bp, Homo sapiens; identical to SEQ ID NO: 926
  misc_feature 1..79: note = chr10:115804976-115805055
  misc_feature 1..79: note = hyper
  source 1..79: mol_type = genomic DNA

SEQ ID NO: 3640 - DNA, 397 bp, Homo sapiens
  misc_feature 1..397: note = chr10:118032412-118032809
  misc_feature 1..397: note = hyper
  source 1..397: mol_type = genomic DNA
cgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaa

SEQ ID NO: 3641 - DNA, 95 bp, Homo sapiens; identical to SEQ ID NO: 927
  misc_feature 1..95: note = chr10:118033068-118033163
  misc_feature 1..95: note = hyper
  source 1..95: mol_type = genomic DNA

SEQ ID NO: 3642 - DNA, 454 bp, Homo sapiens; identical to SEQ ID NO: 928
  misc_feature 1..454: note = chr10:118033223-118033677
  misc_feature 1..454: note = hyper
  source 1..454: mol_type = genomic DNA

SEQ ID NO: 3643 - DNA, 157 bp, Homo sapiens
  misc_feature 1..157: note = chr10:118890938-118891095
  misc_feature 1..157: note = hyper
  source 1..157: mol_type = genomic DNA
gatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtc

SEQ ID NO: 3644 - DNA, 145 bp, Homo sapiens; identical to SEQ ID NO: 929
  misc_feature 1..145: note = chr10:118891517-118891662
  misc_feature 1..145: note = hyper
  source 1..145: mol_type = genomic DNA

SEQ ID NO: 3645 - DNA, 59 bp, Homo sapiens; identical to SEQ ID NO: 930
  misc_feature 1..59: note = chr10:118891715-118891774
  misc_feature 1..59: note = hyper
  source 1..59: mol_type = genomic DNA

SEQ ID NO: 3646 - DNA, 444 bp, Homo sapiens; identical to SEQ ID NO: 931
  misc_feature 1..444: note = chr10:118892013-118892457
  misc_feature 1..444: note = hyper
  source 1..444: mol_type = genomic DNA

SEQ ID NO: 3647 - DNA, 44 bp, Homo sapiens; identical to SEQ ID NO: 932
  misc_feature 1..44: note = chr10:118892517-118892561
  misc_feature 1..44: note = hyper
  source 1..44: mol_type = genomic DNA

SEQ ID NO: 3648 - DNA, 283 bp, Homo sapiens; identical to SEQ ID NO: 933
  misc_feature 1..283: note = chr10:118892955-118893238
  misc_feature 1..283: note = hyper
  source 1..283: mol_type = genomic DNA

SEQ ID NO: 3649 - DNA, 72 bp, Homo sapiens; identical to SEQ ID NO: 934
  misc_feature 1..72: note = chr10:118893679-118893751
  misc_feature 1..72: note = hyper
  source 1..72: mol_type = genomic DNA

SEQ ID NO: 3650 - DNA, 14 bp, Homo sapiens
  misc_feature 1..14: note = chr10:118894477-118894491
  misc_feature 1..14: note = hyper
  source 1..14: mol_type = genomic DNA
ggaatttccggtgg

SEQ ID NO: 3651 - DNA, 353 bp, Homo sapiens; identical to SEQ ID NO: 935
  misc_feature 1..353: note = chr10:118899892-118900245
  misc_feature 1..353: note = hyper
  source 1..353: mol_type = genomic DNA

SEQ ID NO: 3652 - DNA, 113 bp, Homo sapiens; identical to SEQ ID NO: 936
  misc_feature 1..113: note = chr10:118900323-118900436
  misc_feature 1..113: note = hyper
  source 1..113: mol_type = genomic DNA

SEQ ID NO: 3653 - DNA, 292 bp, Homo sapiens
  misc_feature 1..292: note = chr10:118924431-118924723
  misc_feature 1..292: note = hyper
  source 1..292: mol_type = genomic DNA
tttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatcccagcaaaaggaggccgagtccaaagagaatatgtccggtttctatttcaccaagctcctggactcacatttggccccggagccgagtgctcggtctctttccccgggacgggacaggg

SEQ ID NO: 3654 - DNA, 537 bp, Homo sapiens; identical to SEQ ID NO: 937
  misc_feature 1..537: note = chr10:118927026-118927563
  misc_feature 1..537: note = hyper
  source 1..537: mol_type = genomic DNA

SEQ ID NO: 3655 - DNA, 244 bp, Homo sapiens
  misc_feature 1..244: note = chr10:119000911-119001155
  misc_feature 1..244: note = hyper
  source 1..244: mol_type = genomic DNA
tggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggc

SEQ ID NO: 3656 - DNA, 200 bp, Homo sapiens
  misc_feature 1..200: note = chr10:119001328-119001528
  misc_feature 1..200: note = hyper
  source 1..200: mol_type = genomic DNA
cgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgct

SEQ ID NO: 3657 - DNA, 183 bp, Homo sapiens
  misc_feature 1..183: note = chr10:119297461-119297644
  misc_feature 1..183: note = hyper
  source 1..183: mol_type = genomic DNA
tggaggaattcttaacgcccccgaggcctttccaactcgggacaccattctcgcgcctcgggccgggaaagggctcgcccttcacgggcgtcggtgcggtccgcggcgagccgcgggagcacagggcgggctcagcattctggttcaacgtgaggaccagaacctcggcgatcagggaccagg

SEQ ID NO: 3658 - DNA, 105 bp, Homo sapiens
  misc_feature 1..105: note = chr10:119301323-119301428
  misc_feature 1..105: note = hyper
  source 1..105: mol_type = genomic DNA
ctagagaccgtggggcgagagagggagagagttggaagcccactgctccggcggggtcggcagctcccggtctcaactcgcaaacgaacgagccgggtcaagaat

SEQ ID NO: 3659 - DNA, 176 bp, Homo sapiens; identical to SEQ ID NO: 938
  misc_feature 1..176: note = chr10:122708495-122708671
  misc_feature 1..176: note = hyper
  source 1..176: mol_type = genomic DNA

SEQ ID NO: 3660 - DNA, 38 bp, Homo sapiens; identical to SEQ ID NO: 939
  misc_feature 1..38: note = chr10:123922645-123922683
  misc_feature 1..38: note = hyper
  source 1..38: mol_type = genomic DNA

SEQ ID NO: 3661 - DNA, 1013 bp, Homo sapiens
  misc_feature 1..1013: note = chr10:124893594-124894607
  misc_feature 1..1013: note = hyper
  source 1..1013: mol_type = genomic DNA
agcaaaaatggggttcgctgctgtagatgaatgcagaaagaaacattacatatgcccgtcgagatttggtgggggagggtctgacgccccaggaccgaaaaacaaaatctacctctcaagtggggaccccacacgatcacgtctgccaatgcagggcggccttgaattaggcgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtctgcctcatgggcttctcgtgcgaaccggggagctgtttttaaagccagtggagtggaatgtcctttcactaagccgttctgcaaaggtccagtgtggttctctaaggacttcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgc

SEQ ID NO: 3662 - DNA, 52 bp, Homo sapiens
  misc_feature 1..52: note = chr10:124894870-124894922
  misc_feature 1..52: note = hyper
  source 1..52: mol_type = genomic DNA
gggctcgcggccgttagtgcgcttcggccaagggcgccgcctgctccgcgtc

SEQ ID NO: 3663 - DNA, 535 bp, Homo sapiens; identical to SEQ ID NO: 940
  misc_feature 1..535: note = chr10:124895161-124895696
  misc_feature 1..535: note = hyper
  source 1..535: mol_type = genomic DNA

SEQ ID NO: 3664 - DNA, 624 bp, Homo sapiens; identical to SEQ ID NO: 941
  misc_feature 1..624: note = chr10:124895832-124896456
  misc_feature 1..624: note = hyper
  source 1..624: mol_type = genomic DNA

SEQ ID NO: 3665 - DNA, 437 bp, Homo sapiens
  misc_feature 1..437: note = chr10:124897220-124897657
  misc_feature 1..437: note = hyper
  source 1..437: mol_type = genomic DNA
tccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattctt

SEQ ID NO: 3666 - DNA, 16 bp, Homo sapiens
  misc_feature 1..16: note = chr10:124897957-124897973
  misc_feature 1..16: note = hyper
  source 1..16: mol_type = genomic DNA
ccggcctagtttattc

SEQ ID NO: 3667 - DNA, 114 bp, Homo sapiens
  misc_feature 1..114: note = chr10:124899035-124899149
  misc_feature 1..114: note = hyper
  source 1..114: mol_type = genomic DNA
taagtacaacctggacgcacaaccctgtattccgggaggcggtggagacagaggcggctttgttcgcgaccagaggcactctctcccctgtactttccgcggcctgaaacgccc

SEQ ID NO: 3668 - DNA, 113 bp, Homo sapiens; identical to SEQ ID NO: 942
  misc_feature 1..113: note = chr10:124901934-124902047
  misc_feature 1..113: note = hyper
  source 1..113: mol_type = genomic DNA

SEQ ID NO: 3669 - DNA, 431 bp, Homo sapiens; identical to SEQ ID NO: 943
  misc_feature 1..431: note = chr10:124902138-124902569
  misc_feature 1..431: note = hyper
  source 1..431: mol_type = genomic DNA

SEQ ID NO: 3670 - DNA, 214 bp, Homo sapiens; identical to SEQ ID NO: 944
  misc_feature 1..214: note = chr10:124902607-124902821
  misc_feature 1..214: note = hyper
  source 1..214: mol_type = genomic DNA

SEQ ID NO: 3671 - DNA, 267 bp, Homo sapiens; identical to SEQ ID NO: 945
  misc_feature 1..267: note = chr10:124903040-124903307
  misc_feature 1..267: note = hyper
  source 1..267: mol_type = genomic DNA

SEQ ID NO: 3672 - DNA, 244 bp, Homo sapiens
  misc_feature 1..244: note = chr10:124904921-124905165
  misc_feature 1..244: note = hyper
  source 1..244: mol_type = genomic DNA
gcagaggaagtgcctcggtgaagatcagaccctcgaagcgattagagggacgggacagaggaaatacaaggcaagatggatctttttgacttcccaaactatccctaggggaaggagagatagggacgcaaggcttcataacttccttgtttagagtccgcaagccaggcttcttgcaagggtcgactccccagtctctcactgtttcagggcctgggagttgcttttccgaggcccacttcga

SEQ ID NO: 3673 - DNA, 296 bp, Homo sapiens
  misc_feature 1..296: note = chr10:124907293-124907589
  misc_feature 1..296: note = hyper
  source 1..296: mol_type = genomic DNA
cgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatg

SEQ ID NO: 3674 - DNA, 316 bp, Homo sapiens
  misc_feature 1..316: note = chr10:124907979-124908295
  misc_feature 1..316: note = hyper
  source 1..316: mol_type = genomic DNA
gcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggag

SEQ ID NO: 3675 - DNA, 112 bp, Homo sapiens
  misc_feature 1..112: note = chr10:125651051-125651163
  misc_feature 1..112: note = hyper
  source 1..112: mol_type = genomic DNA
tccagatctcctgcccgtaataatcagggtcctcgagggctgcgccctgggctccgaccccggccagggtcactgccaggagcaccagggccagcgctggggtagcggtccc

SEQ ID NO: 3676 - DNA, 88 bp, Homo sapiens
  misc_feature 1..88: note = chr10:125651372-125651460
  misc_feature 1..88: note = hyper
  source 1..88: mol_type = genomic DNA
gcagaggcgcggggcgggcgcaggggggccggccccgcccttccttcttccctccctttcccggcgacccctccgaggccggtccttg

SEQ ID NO: 3677 - DNA, 109 bp, Homo sapiens
  misc_feature 1..109: note = chr10:126137296-126137405
  misc_feature 1..109: note = hyper
  source 1..109: mol_type = genomic DNA
aagggggtttgaagtcggtacctgcaagctgcgggcaggagatatgcaggcgccagtaatagaatatcgatcacgagggtgggggaagggagggcggcccctcggagag

SEQ ID NO: 3678 - DNA, 219 bp, Homo sapiens
  misc_feature 1..219: note = chr10:128993945-128994164
  misc_feature 1..219: note = hyper
  source 1..219: mol_type = genomic DNA
gtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgccc

SEQ ID NO: 3679 - DNA, 146 bp, Homo sapiens; identical to SEQ ID NO: 946
  misc_feature 1..146: note = chr10:130085053-130085199
  misc_feature 1..146: note = hyper
  source 1..146: mol_type = genomic DNA

SEQ ID NO: 3680 - DNA, 76 bp, Homo sapiens; identical to SEQ ID NO: 947
  misc_feature 1..76: note = chr10:130085200-130085276
  misc_feature 1..76: note = hyper
  source 1..76: mol_type = genomic DNA

SEQ ID NO: 3681 - DNA, 54 bp, Homo sapiens; identical to SEQ ID NO: 948
  misc_feature 1..54: note = chr10:130085355-130085409
  misc_feature 1..54: note = hyper
  source 1..54: mol_type = genomic DNA

SEQ ID NO: 3682 - DNA, 698 bp, Homo sapiens
  misc_feature 1..698: note = chr10:131762639-131763337
  misc_feature 1..698: note = hyper
  source 1..698: mol_type = genomic DNA
cctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 3683 - DNA, 780 bp, Homo sapiens
  misc_feature 1..780: note = chr10:131769496-131770276
  misc_feature 1..780: note = hyper
  source 1..780: mol_type = genomic DNA
aagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcac

SEQ ID NO: 3684 - DNA, 121 bp, Homo sapiens
  misc_feature 1..121: note = chr10:133110064-133110185
  misc_feature 1..121: note = hyper
  source 1..121: mol_type = genomic DNA
gcccccggacccggcccccgccccggtccccgcccgcccgcgcccctccccgccggaccccgccccgccctcgcgctccccggccctggccggggtctcctccccgctgcgcccctggacc

SEQ ID NO: 3685 - DNA, 290 bp, Homo sapiens
  misc_feature 1..290: note = chr10:133110553-133110843
  misc_feature 1..290: note = hyper
  source 1..290: mol_type = genomic DNA
cgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggacc

SEQ ID NO: 3686 - DNA, 120 bp, Homo sapiens
  misc_feature 1..120: note = chr10:135044554-135044674
  misc_feature 1..120: note = hyper
  source 1..120: mol_type = genomic DNA
cggacgcctcccccgcccccggctccccgccagctcccgccccgaccgccctcgccacctgcatccccgaggaccgcgcgcccgtccgcggccccgggtccccgccgccacccccggccc

SEQ ID NO: 3687 - skipped

SEQ ID NO: 3688 - DNA, 118 bp, Homo sapiens
  misc_feature 1..118: note = chr11:637349-637467
  misc_feature 1..118: note = hyper
  source 1..118: mol_type = genomic DNA
cgcgggccggccgcgggggcatctgcgggggcatctgcggggctggctgggcagggcgcggcggcgctggtggggggcgtgctgctcatcggcgcggtgctcgcggggaactcgctcg

SEQ ID NO: 3689 - DNA, 794 bp, Homo sapiens
  misc_feature 1..794: note = chr11:8189946-8190740
  misc_feature 1..794: note = hyper
  source 1..794: mol_type = genomic DNA
gttgaaaaaacataacgacttaaggtttgctgtaccaattccatttgccttgatttcgtaccaagcggcgcgtcagaaagtacacggaaaacctaaagagggaaacccaactgggaacccttgactcaaagcacgtgaacaaatggtgacgagatgagttaagccagcggggtaagagagaagggactgcgcctaaacgggagtacgcaaggccacctagaggatgcacagacctgcatgcatacgttcctgacccttccagcagcagaaccatctgggccgccacccgctgataacaacggaaccgtgggcattggcccttcaacgccgtctcgcccgccctctccagtcagtttggtggatatttcggtgaaggctgcagactctcagagtcacccctccctcaagcagcgttctccgtactcttcggcgccgggaagctcagagggagctggcctgctcttaccttcaggtgtcggcggcggctcctgccgcttcccgcgggacaggaaggccttgggcagcagcagcgacagagccaggacaagcccagaagccagagcgactctctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacgcatcttcacctccactgtcgggagttgacctgctcctcccgcgtggttacccgtcgctgtaaatggtac

SEQ ID NO: 3690 - DNA, 140 bp, Homo sapiens
  misc_feature 1..140: note = chr11:9112446-9112586
  misc_feature 1..140: note = hyper
  source 1..140: mol_type = genomic DNA
gggtaattcccagatcggaacaggcgctgttccgctgacagaaaagtctctggagcccaccccgaagccatcagcagaacttgccggcccccaaagaaagaaacggcaaagctgccaccgcctcgcggatgtgcccggcc

SEQ ID NO: 3691 - DNA, 307 bp, Homo sapiens
  misc_feature 1..307: note = chr11:9112639-9112946
  misc_feature 1..307: note = hyper
  source 1..307: mol_type = genomic DNA
cgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctc

SEQ ID NO: 3692 - DNA, 326 bp, Homo sapiens
  misc_feature 1..326: note = chr11:15136101-15136427
  misc_feature 1..326: note = hyper
  source 1..326: mol_type = genomic DNA
ggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgg

SEQ ID NO: 3693 - DNA, 70 bp, Homo sapiens
  misc_feature 1..70: note = chr11:16632513-16632583
  misc_feature 1..70: note = hyper
  source 1..70: mol_type = genomic DNA
cgcaagaaccccgggcgctgagctccggggaacctgggagggaaggaggggcgagcgggtggggctgact

SEQ ID NO: 3694 - DNA, 29 bp, Homo sapiens
  misc_feature 1..29: note = chr11:17497492-17497521
  misc_feature 1..29: note = hyper
  source 1..29: mol_type = genomic DNA
ctttgcaagcaagggcgccggggtcgctg

SEQ ID NO: 3695 - DNA, 116 bp, Homo sapiens
  misc_feature 1..116: note = chr11:17497545-17497661
  misc_feature 1..116: note = hyper
  source 1..116: mol_type = genomic DNA
cgcagagcctgagaagttgcgctctggagacacatgcccgggtggggtggcgggggaagggaatccaagtccctagctctcgcctctcctcgcccagggcgcgggcctgggactgt

SEQ ID NO: 3696 - DNA, 84 bp, Homo sapiens; identical to SEQ ID NO: 949
  misc_feature 1..84: note = chr11:17741806-17741890
  misc_feature 1..84: note = hyper
  source 1..84: mol_type = genomic DNA

SEQ ID NO: 3697 - DNA, 135 bp, Homo sapiens; identical to SEQ ID NO: 950
  misc_feature 1..135: note = chr11:17741952-17742087
  misc_feature 1..135: note = hyper
  source 1..135: mol_type = genomic DNA

SEQ ID NO: 3698 - DNA, 224 bp, Homo sapiens
  misc_feature 1..224: note = chr11:18813811-18814035
  misc_feature 1..224: note = hyper
  source 1..224: mol_type = genomic DNA
tcattgggggcatgccgtggcgctccccgcatgttgccaacacctgcgcaagtggagcggccccatactagggcgcatgcaataccaggtgccgaggactcgttctaggacgctgaggaggcgtcctttttcccagttctccctgttcagcctctggggagctagagcgagtggacagcccctccctccactgagtcttgccctcctgacgtgcggcgcggggc

SEQ ID NO: 3699 - DNA, 385 bp, Homo sapiens
  misc_feature 1..385: note = chr11:20178093-20178478
  misc_feature 1..385: note = hyper
  source 1..385: mol_type = genomic DNA
cgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctg

SEQ ID NO: 3700 - DNA, 101 bp, Homo sapiens
  misc_feature 1..101: note = chr11:20181185-20181286
  misc_feature 1..101: note = hyper
  source 1..101: mol_type = genomic DNA
tgtctcctagaagctcgaaggcagaaacgcagacgtccaggagcgtgcgctcagcgttactgcaccagatgactgcgcacagtctccgactgcgtgtgctc

SEQ ID NO: 3701 - DNA, 80 bp, Homo sapiens
  misc_feature 1..80: note = chr11:20183674-20183754
  misc_feature 1..80: note = hyper
  source 1..80: mol_type = genomic DNA
gcccagctccagaggcgaattaatgctagaagatgacgtaagtgcggagtttctgagcccaagaccgctcatgctcatgg

SEQ ID NO: 3702 - DNA, 190 bp, Homo sapiens
  misc_feature 1..190: note = chr11:20184500-20184690
  misc_feature 1..190: note = hyper
  source 1..190: mol_type = genomic DNA
cctgcttcctggggtcggtctccacagcctcctaaagaattcctaaagcgccaaagaggaaaagtgagggcgggggcgagggggcgagggctggccgcccgtgaaaggaaaaataaatcctaaggaagcaagaaatcggacgaaaggatcttactttaagtgatctccttgaacgcgtcttttcaaactc

SEQ ID NO: 3703 - DNA, 531 bp, Homo sapiens
  misc_feature 1..531: note = chr11:20184899-20185430
  misc_feature 1..531: note = hyper
  source 1..531: mol_type = genomic DNA
gggaaaagagagaatcggagtccctggtttggggtttaaggtccttgcctacgctgcgggggaggccgcagcagatccggctggggctccccgggcctaggtggccaaagctgccgaaacctgccttggatagtagaaagagcgtgtcggaacgcactctgggggtttcgttccccccgcgcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggctgcaacgctaaggtcaccctttgcaggcttcggacccccagtcctccatgctccctgccggagcagccaacagagtgagagcgcattttggaaagattggccggatgccgggcggcgacagggaaaagcgcccgacgcctggctttgggg

SEQ ID NO: 3704 - DNA, 344 bp, Homo sapiens; identical to SEQ ID NO: 951
  misc_feature 1..344: note = chr11:20229223-20229567
  misc_feature 1..344: note = hyper
  source 1..344: mol_type = genomic DNA

SEQ ID NO: 3705 - DNA, 30 bp, Homo sapiens; identical to SEQ ID NO: 952
  misc_feature 1..30: note = chr11:20618363-20618393
  misc_feature 1..30: note = hyper
  source 1..30: mol_type = genomic DNA

SEQ ID NO: 3706 - DNA, 503 bp, Homo sapiens; identical to SEQ ID NO: 953
  misc_feature 1..503: note = chr11:20618422-20618925
  misc_feature 1..503: note = hyper
  source 1..503: mol_type = genomic DNA

SEQ ID NO: 3707 - DNA, 50 bp, Homo sapiens
  misc_feature 1..50: note = chr11:20621603-20621653
  misc_feature 1..50: note = hyper
  source 1..50: mol_type = genomic DNA
tgaaagggggttagacgagaggagtgcggtggaggcgaagataataggat

SEQ ID NO: 3708 - DNA, 101 bp, Homo sapiens; identical to SEQ ID NO: 954
  misc_feature 1..101: note = chr11:20623258-20623359
  misc_feature 1..101: note = hyper
  source 1..101: mol_type = genomic DNA

SEQ ID NO: 3709 - DNA, 26 bp, Homo sapiens
  misc_feature 1..26: note = chr11:20691060-20691086
  misc_feature 1..26: note = hyper
  source 1..26: mol_type = genomic DNA
gccagcggtggggggcgggctggggg

SEQ ID NO: 3710 - DNA, 40 bp, Homo sapiens; identical to SEQ ID NO: 956
  misc_feature 1..40: note = chr11:20691121-20691161
  misc_feature 1..40: note = hyper
  source 1..40: mol_type = genomic DNA

SEQ ID NO: 3711 - DNA, 218 bp, Homo sapiens; identical to SEQ ID NO: 957
  misc_feature 1..218: note = chr11:20691162-20691380
  misc_feature 1..218: note = hyper
  source 1..218: mol_type = genomic DNA

SEQ ID NO: 3712 - DNA, 185 bp, Homo sapiens; identical to SEQ ID NO: 958
  misc_feature 1..185: note = chr11:20691431-20691616
  misc_feature 1..185: note = hyper
  source 1..185: mol_type = genomic DNA

SEQ ID NO: 3713 - DNA, 90 bp, Homo sapiens; identical to SEQ ID NO: 959
  misc_feature 1..90: note = chr11:20691747-20691837
  misc_feature 1..90: note = hyper
  source 1..90: mol_type = genomic DNA

SEQ ID NO: 3714 - DNA, 105 bp, Homo sapiens
  misc_feature 1..105: note = chr11:22215182-22215287
  misc_feature 1..105: note = hyper
  source 1..105: mol_type = genomic DNA
agtcctagggaggttcgctgcgtggcgtgctcagcgcgaaaccgggactgcggggcagagtcccccgcctggggtgagtggggttggtttcggcgccccacagat

SEQ ID NO: 3715 - DNA, 140 bp, Homo sapiens
  misc_feature 1..140: note = chr11:22365407-22365547
  misc_feature 1..140: note = hyper
  source 1..140: mol_type = genomic DNA
gggggcaggcaccagcgatgcgatttcacctgttaatgagctgcgtaggggcgggcgttgggggagccctcagctgctttcagtggcctcctgccttgctgcggtgtccacaaccaaggtcctagcgccagttcccagaa

SEQ ID NO: 3716 - DNA, 197 bp, Homo sapiens; identical to SEQ ID NO: 960
  misc_feature 1..197: note = chr11:27743436-27743633
  misc_feature 1..197: note = hyper
  source 1..197: mol_type = genomic DNA

SEQ ID NO: 3717 - DNA, 15 bp, Homo sapiens
  misc_feature 1..15: note = chr11:30606740-30606755
  misc_feature 1..15: note = hyper
  source 1..15: mol_type = genomic DNA
tgtagagaagaaatc

SEQ ID NO: 3718 - DNA, 292 bp, Homo sapiens
  misc_feature 1..292: note = chr11:30606795-30607087
  misc_feature 1..292: note = hyper
  source 1..292: mol_type = genomic DNA
cgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatc

SEQ ID NO: 3719 - DNA, 1042 bp, Homo sapiens; identical to SEQ ID NO: 961
  misc_feature 1..1042: note = chr11:31819319-31820361
  misc_feature 1..1042: note = hyper
  source 1..1042: mol_type = genomic DNA

SEQ ID NO: 3720 - DNA, 565 bp, Homo sapiens; identical to SEQ ID NO: 962
  misc_feature 1..565: note = chr11:31820460-31821025
  misc_feature 1..565: note = hyper
  source 1..565: mol_type = genomic DNA

SEQ ID NO: 3721 - DNA, 718 bp, Homo sapiens
  misc_feature 1..718: note = chr11:31824246-31824964
  misc_feature 1..718: note = hyper
  source 1..718: mol_type = genomic DNA
atcacctgcagaattcgggaaatgtcgcacggccgggccccgctgtgagctagctctacaatcttctgccgggtggagtccggcagtggccgcccgttgacaaagacaccaccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgccaacctgtgccaacctcggcggtcagttccctgctatcgatcaaataaaggacaacaggaccaccagccatgccagacatcgggcagcccagtccaagcaaccgtgcccctgcccactgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgct

SEQ ID NO: 3722 - DNA, 29 bp, Homo sapiens
  misc_feature 1..29: note = chr11:31826042-31826071
  misc_feature 1..29: note = hyper
  source 1..29: mol_type = genomic DNA
acaggcgtttgggggatctgggctccggc

SEQ ID NO: 3723 - DNA, 198 bp, Homo sapiens; identical to SEQ ID NO: 964
  misc_feature 1..198: note = chr11:31826106-31826304
  misc_feature 1..198: note = hyper
  source 1..198: mol_type = genomic DNA

SEQ ID NO: 3724 - DNA, 325 bp, Homo sapiens; identical to SEQ ID NO: 965
  misc_feature 1..325: note = chr11:31826408-31826733
  misc_feature 1..325: note = hyper
  source 1..325: mol_type = genomic DNA

SEQ ID NO: 3725 - DNA, 117 bp, Homo sapiens; identical to SEQ ID NO: 966
  misc_feature 1..117: note = chr11:31827113-31827230
  misc_feature 1..117: note = hyper
  source 1..117: mol_type = genomic DNA

SEQ ID NO: 3726 - DNA, 457 bp, Homo sapiens; identical to SEQ ID NO: 967
  misc_feature 1..457: note = chr11:31827597-31828054
  misc_feature 1..457: note = hyper
  source 1..457: mol_type = genomic DNA

SEQ ID NO: 3727 - DNA, 220 bp, Homo sapiens
  misc_feature 1..220: note = chr11:31835591-31835811
  misc_feature 1..220: note = hyper
  source 1..220: mol_type = genomic DNA
tgctgccctccaagacgcgggggggcggcggggattgcgctttaggttctgtctcctttccccgcctccccacaggcccctgttcccccctaccctccgccccctgtggccagagggaggacctctcaggccggcgggtgcgttcccgcgggggccgccggggtcgtcccacccggtagcggggctgtctgcgtggagggagtcccgctgggggaccgtg

SEQ ID NO: 3728 - DNA, 438 bp, Homo sapiens; identical to SEQ ID NO: 968
  misc_feature 1..438: note = chr11:31836032-31836470
  misc_feature 1..438: note = hyper
  source 1..438: mol_type = genomic DNA

SEQ ID NO: 3729 - DNA, 159 bp, Homo sapiens; identical to SEQ ID NO: 969
  misc_feature 1..159: note = chr11:31837354-31837513
  misc_feature 1..159: note = hyper
  source 1..159: mol_type = genomic DNA

SEQ ID NO: 3730 - DNA, 735 bp, Homo sapiens; identical to SEQ ID NO: 970
  misc_feature 1..735: note = chr11:31837541-31838276
  misc_feature 1..735: note = hyper
  source 1..735: mol_type = genomic DNA

SEQ ID NO: 3731 - DNA, 1227 bp, Homo sapiens
  misc_feature 1..1227: note = chr11:31838719-31839946
  misc_feature 1..1227: note = hyper
  source 1..1227: mol_type = genomic DNA
aattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagagg

SEQ ID NO: 3732 - DNA, 132 bp, Homo sapiens
  misc_feature 1..132: note = chr11:31840041-31840173
  misc_feature 1..132: note = hyper
  source 1..132: mol_type = genomic DNA
cgggggctccgggaagaggacatgcgacccctttttcagggcctaggccaaaggtctctccaggcctgctgggttctcaagagggaagccctaaagggggcctacccgggcttccctcgccctctggctgaa

SEQ ID NO: 3733 - DNA, 315 bp, Homo sapiens; identical to SEQ ID NO: 971
  misc_feature 1..315: note = chr11:31841774-31842089
  misc_feature 1..315: note = hyper
  source 1..315: mol_type = genomic DNA

SEQ ID NO: 3734 - DNA, 229 bp, Homo sapiens
  misc_feature 1..229: note = chr11:31847484-31847713
  misc_feature 1..229: note = hyper
  source 1..229: mol_type = genomic DNA
aaggctgtcatctggcggggcaaacgctcttctctcattccttcgtctcccttccagccctcgcatcctttccttctttctgcttcagagctctcaggctcgcgtgcagggcgggatgggcccggatcgggggccccttcgcagatttgaaagttgcctcggccttgatcttctcccagcctccctgctggggactcacccccacatcccgctaccccccggggaaaag

SEQ ID NO: 3735 - DNA, 104 bp, Homo sapiens
  misc_feature 1..104: note = chr11:31847769-31847873
  misc_feature 1..104: note = hyper
  source 1..104: mol_type = genomic DNA
cggcctcggtggagcctcagggccagggcggggtgtggcggggtgtggcccggtggggtgagggagggacccggggtgcaagccaggccaaggcctcctcagtg

SEQ ID NO: 3736 - DNA, 76 bp, Homo sapiens
  misc_feature 1..76: note = chr11:31847895-31847971
  misc_feature 1..76: note = hyper
  source 1..76: mol_type = genomic DNA
cgccccctcccaaggcgtggggtcccggggacagaccccgagcccctctctgcgcaactaccgcctctaaaaaaaa

SEQ ID NO: 3737 - DNA, 248 bp, Homo sapiens
  misc_feature 1..248: note = chr11:31848355-31848603
  misc_feature 1..248: note = hyper
  source 1..248: mol_type = genomic DNA
cctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtccca

SEQ ID NO: 3738 - DNA, 353 bp, Homo sapiens
  misc_feature 1..353: note = chr11:31848722-31849075
  misc_feature 1..353: note = hyper
  source 1..353: mol_type = genomic DNA
cggacccggagcttgggaggcgaccgccaggctggtgcccggcctgacccggcgttcgcggccgcccgctcgcccgccgcgggccgggagcgtacaggagtgtgacgcagattgtgaaaacagaagggagggagttgggtcatttccttcgctaatcatcgccccctcctgctcctcctccccacccccatcccatcctcgccgccacccagcctcgaactctcttccttgccagagtctgcctcactttgagccagtggctgcactttatggagaaaatatatgtgcccatcactcacccatctatttgcagcgtccatggagcgcctcggggaacacgcatggacaattaa

SEQ ID NO: 3739 - DNA, 110 bp, Homo sapiens; identical to SEQ ID NO: 972
  misc_feature 1..110: note = chr11:32455906-32456016
  misc_feature 1..110: note = hyper
  source 1..110: mol_type = genomic DNA

SEQ ID NO: 3740 - DNA, 154 bp, Homo sapiens
  misc_feature 1..154: note = chr11:32456758-32456912
  misc_feature 1..154: note = hyper
  source 1..154: mol_type = genomic DNA
cgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgc

SEQ ID NO: 3741 - DNA, 156 bp, Homo sapiens
  misc_feature 1..156: note = chr11:32456913-32457069
  misc_feature 1..156: note = hyper
  source 1..156: mol_type = genomic DNA
gcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactc

SEQ ID NO: 3742 - DNA, 916 bp, Homo sapiens
  misc_feature 1..916: note = chr11:32457851-32458767
  misc_feature 1..916: note = hyper
  source 1..916: mol_type = genomic DNA
cttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccct

SEQ ID NO: 3743 - DNA, 155 bp, Homo sapiens
  misc_feature 1..155: note = chr11:33890297-33890452
  misc_feature 1..155: note = hyper
  source 1..155: mol_type = genomic DNA
tactcagatttactccggatttcgctgctctagaaatccctggaggcccagagccagctccgaggtggacggtcggacccctcacccgcccgttatccgcaaggctggcagcggctccacctgcggaccgggaaggcggccgttggggaccccgg

SEQ ID NO: 3744 - DNA, 454 bp, Homo sapiens; identical to SEQ ID NO: 973
  misc_feature 1..454: note = chr11:43602393-43602847
  misc_feature 1..454: note = hyper
  source 1..454: mol_type = genomic DNA

SEQ ID NO: 3745 - DNA, 189 bp, Homo sapiens; identical to SEQ ID NO: 974
  misc_feature 1..189: note = chr11:43602848-43603037
  misc_feature 1..189: note = hyper
  source 1..189: mol_type = genomic DNA

SEQ ID NO: 3746 - DNA, 112 bp, Homo sapiens; identical to SEQ ID NO: 975
  misc_feature 1..112: note = chr11:43603076-43603188
  misc_feature 1..112: note = hyper
  source 1..112: mol_type = genomic DNA

SEQ ID NO: 3747 - DNA, 40 bp, Homo sapiens
  misc_feature 1..40: note = chr11:43603446-43603486
  misc_feature 1..40: note = hyper
  source 1..40: mol_type = genomic DNA
gtggtcatttttgaccgtaatgatccgattctgcaatatg

SEQ ID NO: 3748 - DNA, 81 bp, Homo sapiens; identical to SEQ ID NO: 976
  misc_feature 1..81: note = chr11:44330877-44330958
  misc_feature 1..81: note = hyper
  source 1..81: mol_type = genomic DNA

SEQ ID NO: 3749 - DNA, 481 bp, Homo sapiens; identical to SEQ ID NO: 977
  misc_feature 1..481: note = chr11:44330959-44331440
  misc_feature 1..481: note = hyper
  source 1..481: mol_type = genomic DNA

SEQ ID NO: 3750 - DNA, 229 bp, Homo sapiens; identical to SEQ ID NO: 978
  misc_feature 1..229: note = chr11:44331482-44331711
  misc_feature 1..229: note = hyper
  source 1..229: mol_type = genomic DNA

SEQ ID NO: 3751 - DNA, 68 bp, Homo sapiens
  misc_feature 1..68: note = chr11:44341966-44342034
  misc_feature 1..68: note = hyper
  source 1..68: mol_type = genomic DNA
ttcgtttacaggtcccggtcgagtttttcaaagggtggtggaaaacgcgcgcgcgagctctagtaaag

SEQ ID NO: 3752 - DNA, 194 bp, Homo sapiens
  misc_feature 1..194: note = chr11:45376858-45377052
  misc_feature 1..194: note = hyper
  source 1..194: mol_type = genomic DNA
agaaaggagaggaggcggagacggttagtctagcctctctgtggggcctctctgctggtacccagatgctgagcgctgaaattctcatccgccacacacaacatggcggcttcctggacccgcgcccaattttcgcttccgggatggaagctacgtcatttccccctctgttgccctagcgccccttggaagcc

SEQ ID NO: 3753 - DNA, 15 bp, Homo sapiens
  misc_feature 1..15: note = chr11:46316818-46316833
  misc_feature 1..15: note = hyper
  source 1..15: mol_type = genomic DNA
gtaccattactgccc

SEQ ID NO: 3754 - DNA, 461 bp, Homo sapiens; identical to SEQ ID NO: 980
  misc_feature 1..461: note = chr11:46316895-46317356
  misc_feature 1..461: note = hyper
  source 1..461: mol_type = genomic DNA

SEQ ID NO: 3755 - DNA, 290 bp, Homo sapiens; identical to SEQ ID NO: 981
  misc_feature 1..290: note = chr11:46317407-46317697
  misc_feature 1..290: note = hyper
  source 1..290: mol_type = genomic DNA

SEQ ID NO: 3756 - DNA, 577 bp, Homo sapiens
  misc_feature 1..577: note = chr11:47208680-47209257
  misc_feature 1..577: note = hyper
  source 1..577: mol_type = genomic DNA
ttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagaggagtgcgcccccagggacgcggctctgagccctgggaagctgaggcgcctggctgcgccctctgaagctcgtacttttcctcccaccctcagctccctgaagagtgtgagtgcgtgcgcgcggagttttaaacggcagctttaaaaatagcaaaattatgttgtttctaaatccaggaggaatcactgacgcgttctttacgcagatgaatccgc

SEQ ID NO: 3757 - DNA, 300 bp, Homo sapiens
  misc_feature 1..300: note = chr11:57194178-57194478
  misc_feature 1..300: note = hyper
  source 1..300: mol_type = genomic DNA
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgcaaacctggtccccgccgcccttcctcgcatcaacttctaccaggaaagcctccgggggccgctccccgccagcctccgcaccccgctccagcctgcggcctgccctccccgcagaggagcccga

SEQ ID NO: 3758 - DNA, 450 bp, Homo sapiens
  misc_feature 1..450: note = chr11:58672717-58673167
  misc_feature 1..450: note = hyper
  source 1..450: mol_type = genomic DNA
aagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttc

SEQ ID NO: 3759 - DNA, 80 bp, Homo sapiens
  misc_feature 1..80: note = chr11:58673168-58673248
  misc_feature 1..80: note = hyper
  source 1..80: mol_type = genomic DNA
ggggaggggatcgctgggaccgggatgggtcatctggacaaatagggagggtgggcgggtgggcgcgcagtcccctcggc

SEQ ID NO: 3760 - DNA, 153 bp, Homo sapiens; identical to SEQ ID NO: 982
  misc_feature 1..153: note = chr11:60718701-60718854
  misc_feature 1..153: note = hyper
  source 1..153: mol_type = genomic DNA

SEQ ID NO: 3761 - DNA, 145 bp, Homo sapiens; identical to SEQ ID NO: 983
  misc_feature 1..145: note = chr11:60718976-60719121
  misc_feature 1..145: note = hyper
  source 1..145: mol_type = genomic DNA

SEQ ID NO: 3762 - DNA, 348 bp, Homo sapiens
  misc_feature 1..348: note = chr11:61276772-61277120
  misc_feature 1..348: note = hyper
  source 1..348: mol_type = genomic DNA
gctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcac

SEQ ID NO: 3763 - DNA, 15 bp, Homo sapiens
  misc_feature 1..15: note = chr11:61277327-61277342
  misc_feature 1..15: note = hyper
  source 1..15: mol_type = genomic DNA
cgctccaggactggg

SEQ ID NO: 3764 - DNA, 274 bp, Homo sapiens
  misc_feature 1..274: note = chr11:61595049-61595323
  misc_feature 1..274: note = hyper
  source 1..274: mol_type = genomic DNA
cgcgccaaggaagggcgtcacctagccaagccggccctggagttgagtgccccgcagcccgccggtccacccgcccggccgcttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctg

SEQ ID NO: 3765 - DNA, 762 bp, Homo sapiens; identical to SEQ ID NO: 984
  misc_feature 1..762: note = chr11:65600895-65601657
  misc_feature 1..762: note = hyper
  source 1..762: mol_type = genomic DNA

SEQ ID NO: 3766 - DNA, 73 bp, Homo sapiens; identical to SEQ ID NO: 985
  misc_feature 1..73: note = chr11:65816447-65816520
  misc_feature 1..73: note = hyper
  source 1..73: mol_type = genomic DNA

SEQ ID NO: 3767 - skipped

SEQ ID NO: 3768 - DNA, 75 bp, Homo sapiens; identical to SEQ ID NO: 987
  misc_feature 1..75: note = chr11:66188095-66188170
  misc_feature 1..75: note = hyper
  source 1..75: mol_type = genomic DNA

SEQ ID NO: 3769 - DNA, 15 bp, Homo sapiens
  misc_feature 1..15: note = chr11:66188769-66188784
  misc_feature 1..15: note = hyper
  source 1..15: mol_type = genomic DNA
gcacatcatgagcct

SEQ ID NO: 3770 - DNA, 257 bp, Homo sapiens
  misc_feature 1..257: note = chr11:66188852-66189109
  misc_feature 1..257: note = hyper
  source 1..257: mol_type = genomic DNA
cgagctgccaggcgccggagaccctggagctgagggaacccgctggggctgtcgcatgtctagggcagcgtgctggcgagctggggagattcgggactcgggagattcgggactttctacttttcctcctgagctccctccagacctcaccttagttctgaatgagagttagagagcctggacggtgtccctaacaccagattatgagaggataagagccaggacagagcggcctcggtgcccgccagtgcagaagc

SEQ ID NO: 3771 - DNA, 165 bp, Homo sapiens
  misc_feature 1..165: note = chr11:71955215-71955380
  misc_feature 1..165: note = hyper
  source 1..165: mol_type = genomic DNA
caagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcag

SEQ ID NO: 3772 - DNA, 176 bp, Homo sapiens
  misc_feature 1..176: note = chr11:78672891-78673067
  misc_feature 1..176: note = hyper
  source 1..176: mol_type = genomic DNA
ctgatgtttccttctcgtgatgtctgtctgtgcatctttgtcggtacatctgcctgtccgatgtctctcatgggggttggggacagaagcagccctccaactcttgcacactccagcggcgccgcggggcaagagcggggctgcctgagcccgcggagccacgtcaggcccccagc

SEQ ID NO: 3773 - DNA, 549 bp, Homo sapiens
  misc_feature 1..549: note = chr11:82444635-82445184
  misc_feature 1..549: note = hyper
  source 1..549: mol_type = genomic DNA
gagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttga

SEQ ID NO: 3774 - DNA, 76 bp, Homo sapiens
  misc_feature 1..76: note = chr11:86085786-86085862
  misc_feature 1..76: note = hyper
  source 1..76: mol_type = genomic DNA
agcgagcctttctcgcgtcccagcaacgcgcccttccctctgccgggcctattctccctggtgcccctcccttcct

SEQ ID NO: 3775 - DNA, 60 bp, Homo sapiens
  misc_feature 1..60: note = chr11:86085931-86085991
  misc_feature 1..60: note = hyper
  source 1..60: mol_type = genomic DNA
cggtgccggacatcagttcctgcggctcttgctgtgggagctgcccgagagccagagcag

SEQ ID NO: 3776 - DNA, 38 bp, Homo sapiens; identical to SEQ ID NO: 988
  misc_feature 1..38: note = chr11:88241938-88241976
  misc_feature 1..38: note = hyper
  source 1..38: mol_type = genomic DNA

SEQ ID NO: 3777 - DNA, 145 bp, Homo sapiens; identical to SEQ ID NO: 989
  misc_feature 1..145: note = chr11:88242130-88242275
  misc_feature 1..145: note = hyper
  source 1..145: mol_type = genomic DNA

SEQ ID NO: 3778 - DNA, 42 bp, Homo sapiens; identical to SEQ ID NO: 990
  misc_feature 1..42: note = chr11:88242358-88242400
  misc_feature 1..42: note = hyper
  source 1..42: mol_type = genomic DNA

SEQ ID NO: 3779 - DNA, 111 bp, Homo sapiens
  misc_feature 1..111: note = chr11:88798820-88798931
  misc_feature 1..111: note = hyper
  source 1..111: mol_type = genomic DNA
tttagccccagctcccgccccttgcttgattgctctccatccctgcactgggggaggggctccagcggtatcctatatccgtggtaactatagccaagagaaagaaaaagg

SEQ ID NO: 3780 - DNA, 170 bp, Homo sapiens
  misc_feature 1..170: note = chr11:88798965-88799135
  misc_feature 1..170: note = hyper
  source 1..170: mol_type = genomic DNA
cgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccg

SEQ ID NO: 3781 - DNA, 120 bp, Homo sapiens
  misc_feature 1..120: note = chr11:91958730-91958850
  misc_feature 1..120: note = hyper
  source 1..120: mol_type = genomic DNA
gcagccggtgcctctcgggcgcagtgggggatgttcagatgccgatggatgatgcacttaggggaccccgaggtgcaagttgggtcatcgctaggcgaggcgcggcgcagagagggagcc

SEQ ID NO: 3782 - DNA, 75 bp, Homo sapiens
  misc_feature 1..75: note = chr11:94473596-94473671
  misc_feature 1..75: note = hyper
  source 1..75: mol_type = genomic DNA
ggagcgtgacggccacggtcgcctagcaacgagcggggatgcgcggggcgcctgggtgggcgaggggtgctcgcc

SEQ ID NO: 3783 - DNA, 97 bp, Homo sapiens
  misc_feature 1..97: note = chr11:94473672-94473769
  misc_feature 1..97: note = hyper
  source 1..97: mol_type = genomic DNA
ccgccgccgcgcgccctcgggcccccgggaccgcgggaaaacttcgcggctcctcggcgctggggcgtcggcgccaggcccggcagacagagcaatg

SEQ ID NO: 3784 - DNA, 96 bp, Homo sapiens
  misc_feature 1..96: note = chr11:94473802-94473898
  misc_feature 1..96: note = hyper
  source 1..96: mol_type = genomic DNA
cggcccagcgcccggccgggggagccgcggggtggcacgcggggaaagttggcgcgcgcctgaccgcgcctggaagccgcgcggtgccagggccga

SEQ ID NO: 3785 - DNA, 708 bp, Homo sapiens
  misc_feature 1..708: note = chr11:100997686-100998394
  misc_feature 1..708: note = hyper
  source 1..708: mol_type = genomic DNA
aagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctgggg

SEQ ID NO: 3786 - DNA, 375 bp, Homo sapiens
  misc_feature 1..375: note = chr11:101453090-101453465
  misc_feature 1..375: note = hyper
  source 1..375: mol_type = genomic DNA
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtccta

SEQ ID NO: 3787 - DNA, 345 bp, Homo sapiens
  misc_feature 1..345: note = chr11:104034409-104034754
  misc_feature 1..345: note = hyper
  source 1..345: mol_type = genomic DNA
acaatgcattcagcccgagttcacattcaagattcaaaaagaaaggggaaaaacatagaaagaacaataacaatagcaaacatgatttttttttcagttaaaaaataaaatgagtctcttaccatctcgcctgaggttggcgttgcgcaaagctttgatggatgcgctctgcggggttgcagaagtgtcccgacagctgcaaaagtttgcgcagattagagtgtagacaaagatgagccggtgcatttgggatcagcgactagagacagcgtcgctccaagaaaaagccgggttctgctcccgggaccgacgccgcgccgccctgcgctctcgccgcctgcgctc

SEQ ID NO: 3788 - DNA, 463 bp, Homo sapiens
  misc_feature 1..463: note = chr11:104034755-104035218
  misc_feature 1..463: note = hyper
  source 1..463: mol_type = genomic DNA
ccctgcgctggcccgggtcgctgtgctaatcgccgagctctccccaaacttcctgcatgctgaactttccgagcgcgtgtgggtgccgcacttccttgtggtgctgagctgataaatggtgacgggacaaacaacaggttgacgtttgtttgttcgccccctccggtggccggcagctgcagcacaggctgcagggggcgggcagcgccgaatctagcggggcaggcgagcggagcagcagcgttctccagccccggccgcggcccctgagaggcgcgcactcgggctcagagcggcggcgcgagcacctcagctccccagtttcccaggccgggcctaaacctgctctgccactgagcatgcccagtttaatcgccggccgggactcttcccaccgccctgggctttaccctcctggttggacctgtaagggctcaggaaacaaactcgccaggaggaagtg

SEQ ID NO: 3789 - DNA, 140 bp, Homo sapiens
  misc_feature 1..140: note = chr11:110582889-110583029
  misc_feature 1..140: note = hyper
  source 1..140: mol_type = genomic DNA
gtcagggaagaggagcgccccggctgtccccctagagtctcctgctggggggacatcgcttccatgaagaaaatcttcaaacaaatcccagcccaggaggaggctacacgatcatgtccgcgggctgccggccggagggg

SEQ ID NO: 3790 - DNA, 853 bp, Homo sapiens
  misc_feature 1..853: note = chr11:110583043-110583896
  misc_feature 1..853: note = hyper
  source 1..853: mol_type = genomic DNA
cggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaag

SEQ ID NO: 3791 - DNA, 383 bp, Homo sapiens
  misc_feature 1..383: note = chr11:111383132-111383515
  misc_feature 1..383: note = hyper
  source 1..383: mol_type = genomic DNA
acccgccccgtctcgcgcccgccccgcccctcggcccgcggggttccaaggacggttggtcgcccccgccacagtcactcggccgctcagagcggcggggcgcacggggtcgagagagccagctctagggtttggggctgggaactgaagcctggcgtgaaggaagtgggagcccgggccgaggaggcgaaggggaaaggaaaagcgaggggaacctgagcgggagggccctgagaggagcgggaggctgcgggaaggggaggcctggcactcctgggggtcatgggggtcggggcgcggctcccggcctgggagggcgcgggtcctccccggcagcgccgcccgctggcccagctacgcgtgttgtgcgctgcgaggccggc

SEQ ID NO: 3792 - DNA, 16 bp, Homo sapiens
  misc_feature 1..16: note = chr11:111383516-111383532
  misc_feature 1..16: note = hyper
  source 1..16: mol_type = genomic DNA
ggggtcccgctgggcc

SEQ ID NO: 3793 - DNA, 348 bp, Homo sapiens
  misc_feature 1..348: note = chr11:111383557-111383905
  misc_feature 1..348: note = hyper
  source 1..348: mol_type = genomic DNA
cgcccagccatggtagggcgtcccccggtgaaatggggtccgaggcgggccccgaccccgcgtcggcgctgcggaccgtccgggagctgcagccgcgggtgcccggtgctcggtttgtaggcagtgtcattagctgattgtactgtggtggttacaatcactaactccactgccatcaaaacaaggcacagcatcaccgccgcccggccgggaagaagacgccggctcgggcagcccgcagccttcgagagaagatgcctgagaagcgcggcgtcggcgtgggtcctgcgcagcctgccccgcgagcgcccgctgcaagtgcgaggaaacccgcggtttctccagata

SEQ ID NO: 3794 - DNA, 286 bp, Homo sapiens; identical to SEQ ID NO: 991
  misc_feature 1..286: note = chr11:111411296-111411582
  misc_feature 1..286: note = hyper
  source 1..286: mol_type = genomic DNA

SEQ ID NO: 3795 - DNA, 391 bp, Homo sapiens; identical to SEQ ID NO: 992
  misc_feature 1..391: note = chr11:111411821-111412212
  misc_feature 1..391: note = hyper
  source 1..391: mol_type = genomic DNA

SEQ ID NO: 3796 - DNA, 38 bp, Homo sapiens; identical to SEQ ID NO: 993
  misc_feature 1..38: note = chr11:115530058-115530096
  misc_feature 1..38: note = hyper
  source 1..38: mol_type = genomic DNA

SEQ ID NO: 3797 - DNA, 201 bp, Homo sapiens; identical to SEQ ID NO: 994
  misc_feature 1..201: note = chr11:115530221-115530422
  misc_feature 1..201: note = hyper
  source 1..201: mol_type = genomic DNA

SEQ ID NO: 3798 - DNA, 50 bp, Homo sapiens
  misc_feature 1..50: note = chr11:115630424-115630474
  misc_feature 1..50: note = hyper
  source 1..50: mol_type = genomic DNA
ctcgcctccccaatgcgcttcccgcctctgcatcgccgccggccccttca

SEQ ID NO: 3799 - DNA, 99 bp, Homo sapiens
  misc_feature 1..99: note = chr11:115630530-115630629
  misc_feature 1..99: note = hyper
  source 1..99: mol_type = genomic DNA
cgaggtcgccggagctcctcctctcgcggctgagtgagggtctgggaggccagatgaagggagctgctcggctgagctgcggaccagcgcgagagcagc

SEQ ID NO: 3800 - DNA, 259 bp, Homo sapiens
  misc_feature 1..259: note = chr11:115630630-115630889
  misc_feature 1..259: note = hyper
  source 1..259: mol_type = genomic DNA
ggcagtggcggaccagcgccagggcagggcaggggtggacagagggctctccccacccttccctcctccagtgaaagtaccagaagagatggcggccgctccgccgagtgtcattaccgcggaagcagcagaagccggcggcaggagcgggcccgagagcccgcggccagtggcctgcgcaccccgcgcccagcgcccccgccgcgggtcatcagtgtcagcgttgaggggtcccggggagcggttgcagggcggcggc

SEQ ID NO: 3801 - DNA, 94 bp, Homo sapiens
  misc_feature 1..94: note = chr11:115630890-115630984
  misc_feature 1..94: note = hyper
  source 1..94: mol_type = genomic DNA
gcggccgggtcatcagaagcacagtggagccgccccctgctttgggaggagcaaaagagcctctcgcttgcctcccgctcgagctccttctcct

SEQ ID NO: 3802 - DNA, 57 bp, Homo sapiens
  misc_feature 1..57: note = chr11:115631307-115631364
  misc_feature 1..57: note = hyper
  source 1..57: mol_type = genomic DNA
ctgctcttcagcaaacggtgtatttcagcccgagtttccttccgggggtttggctgt

SEQ ID NO: 3803 - DNA, 588 bp, Homo sapiens
  misc_feature 1..588: note = chr11:122847170-122847758
  misc_feature 1..588: note = hyper
  source 1..588: mol_type = genomic DNA
gaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttga

SEQ ID NO: 3804 - DNA, 323 bp, Homo sapiens; identical to SEQ ID NO: 995
  misc_feature 1..323: note = chr11:122849801-122850124
  misc_feature 1..323: note = hyper
  source 1..323: mol_type = genomic DNA

SEQ ID NO: 3805 - DNA, 232 bp, Homo sapiens; identical to SEQ ID NO: 996
  misc_feature 1..232: note = chr11:122850148-122850380
  misc_feature 1..232: note = hyper
  source 1..232: mol_type = genomic DNA

SEQ ID NO: 3806 - DNA, 308 bp, Homo sapiens; identical to SEQ ID NO: 997
  misc_feature 1..308: note = chr11:122850901-122851209
  misc_feature 1..308: note = hyper
  source 1..308: mol_type = genomic DNA

SEQ ID NO: 3807 - DNA, 15 bp, Homo sapiens
  misc_feature 1..15: note = chr11:123228701-123228716
  misc_feature 1..15: note = hyper
  source 1..15: mol_type = genomic DNA
ctttccataccttcc

SEQ ID NO: 3808 - DNA, 392 bp, Homo sapiens; identical to SEQ ID NO: 999
  misc_feature 1..392: note = chr11:123228788-123229180
  misc_feature 1..392: note = hyper
  source 1..392: mol_type = genomic DNA

SEQ ID NO: 3809 - DNA, 226 bp, Homo sapiens; identical to SEQ ID NO: 1000
  misc_feature 1..226: note = chr11:123229181-123229407
  misc_feature 1..226: note = hyper
  source 1..226: mol_type = genomic DNA

SEQ ID NO: 3810 - DNA, 15 bp, Homo sapiens
  misc_feature 1..15: note = chr11:123301014-123301029
  misc_feature 1..15: note = hyper
  source 1..15: mol_type = genomic DNA
actgcctcttcctcc

SEQ ID NO: 3811 - DNA, 944 bp, Homo sapiens; identical to SEQ ID NO: 1002
  misc_feature 1..944: note = chr11:123301082-123302026
  misc_feature 1..944: note = hyper
  source 1..944: mol_type = genomic DNA

SEQ ID NO: 3812 - DNA, 181 bp, Homo sapiens; identical to SEQ ID NO: 1003
  misc_feature 1..181: note = chr11:125773880-125774061
  misc_feature 1..181: note = hyper
  source 1..181: mol_type = genomic DNA

SEQ ID NO: 3813 - DNA, 312 bp, Homo sapiens; identical to SEQ ID NO: 1004
  misc_feature 1..312: note = chr11:125774122-125774434
  misc_feature 1..312: note = hyper
  source 1..312: mol_type = genomic DNA

SEQ ID NO: 3814 - DNA, 330 bp, Homo sapiens
  misc_feature 1..330: note = chr11:128562856-128563186
  misc_feature 1..330: note = hyper
  source 1..330: mol_type = genomic DNA
cagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtc

SEQ ID NO: 3815 - DNA, 37 bp, Homo sapiens
  misc_feature 1..37: note = chr11:128563336-128563373
  misc_feature 1..37: note = hyper
  source 1..37: mol_type = genomic DNA
cggttttcgtccgagtcttccccggcagtaggcgctg

SEQ ID NO: 3816 - DNA, 167 bp, Homo sapiens
  misc_feature 1..167: note = chr11:128563669-128563836
  misc_feature 1..167: note = hyper
  source 1..167: mol_type = genomic DNA
caagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagagagaggagagctcgaggc

SEQ ID NO: 3817 - DNA, 500 bp, Homo sapiens
  misc_feature 1..500: note = chr11:128563896-128564396
  misc_feature 1..500: note = hyper
  source 1..500: mol_type = genomic DNA
cctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccc

SEQ ID NO: 3818 - DNA, 189 bp, Homo sapiens; identical to SEQ ID NO: 1005
  misc_feature 1..189: note = chr11:128564685-128564874
  misc_feature 1..189: note = hyper
  source 1..189: mol_type = genomic DNA

SEQ ID NO: 3819 - skipped

SEQ ID NO: 3820 - DNA, 308 bp, Homo sapiens; identical to SEQ ID NO: 1007
  misc_feature 1..308: note = chr11:128564991-128565299
  misc_feature 1..308: note = hyper
  source 1..308: mol_type = genomic DNA

SEQ ID NO: 3821 - DNA, 459 bp, Homo sapiens; identical to SEQ ID NO: 1008
  misc_feature 1..459: note = chr11:129242783-129243242
  misc_feature 1..459: note = hyper
  source 1..459: mol_type = genomic DNA

SEQ ID NO: 3822 - DNA, 350 bp, Homo sapiens; identical to SEQ ID NO: 1009
  misc_feature 1..350: note = chr11:129243304-129243654
  misc_feature 1..350: note = hyper
  source 1..350: mol_type = genomic DNA

SEQ ID NO: 3823 - DNA, 347 bp, Homo sapiens; identical to SEQ ID NO: 1010
  misc_feature 1..347: note = chr11:129243954-129244301
  misc_feature 1..347: note = hyper
  source 1..347: mol_type = genomic DNA

SEQ ID NO: 3824 - DNA, 204 bp, Homo sapiens; identical to SEQ ID NO: 1011
  misc_feature 1..204: note = chr11:129244440-129244644
  misc_feature 1..204: note = hyper
  source 1..204: mol_type = genomic DNA

SEQ ID NO: 3825 - DNA, 203 bp, Homo sapiens; identical to SEQ ID NO: 1012
  misc_feature 1..203: note = chr11:131780876-131781079
  misc_feature 1..203: note = hyper
  source 1..203: mol_type = genomic DNA

SEQ ID NO: 3826 - DNA, 449 bp, Homo sapiens; identical to SEQ ID NO: 1013
  misc_feature 1..449: note = chr11:132952552-132953001
  misc_feature 1..449: note = hyper
  source 1..449: mol_type = genomic DNA

SEQ ID NO: 3827 - DNA, 263 bp, Homo sapiens
  misc_feature 1..263: note = chr11:133825226-133825489
  misc_feature 1..263: note = hyper
  source 1..263: mol_type = genomic DNA
aacaaaatcacccttcgcttcgccctctgctcgttctgttttcagacaccaccacccccctcagaagcagaggcgacatattcattccattccggaaagtttcctgaagcacgcccccctgcacagacgagtgacgaggggaccccgtgagaggcgcctccagcccacccggcgccccatgccgctgggagagggttctctgtcggcgagtcctgcctgctgactcccacccacagcgggttctctcccgccgccatctcctc

SEQ ID NO: 3828 - DNA, 151 bp, Homo sapiens
  misc_feature 1..151: note = chr11:133906799-133906950
  misc_feature 1..151: note = hyper
  source 1..151: mol_type = genomic DNA
gtggatgccacagctcggccggaaggcttcagcgtgggagggggtgggggtgacaccagggctgccccttgagagcgacaccggcctgaaccccgtcctccccgcgccccccagccccgcctcgctgcagacggttcgccttgtccactct

SEQ ID NO: 3829 - DNA, 16 bp, Homo sapiens
  misc_feature 1..16: note = chr11:133938772-133938788
  misc_feature 1..16: note = hyper
  source 1..16: mol_type = genomic DNA
agagaacccatgtgcc

SEQ ID NO: 3830 - DNA, 275 bp, Homo sapiens
  misc_feature 1..275: note = chr11:133938789-133939064
  misc_feature 1..275: note = hyper
  source 1..275: mol_type = genomic DNA
gtccagagcatcgctgcatccgtaagcagctagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggtgagtttgc

SEQ ID NO: 3831 - DNA, 316 bp, Homo sapiens
  misc_feature 1..316: note = chr11:133939065-133939381
  misc_feature 1..316: note = hyper
  source 1..316: mol_type = genomic DNA
cgtttccgctgttgggagactagggtctgggggcgacggaagcagagcgggccgaagctgctggagccggtccgggcgaggatagcggtcctggctccgagggctcccggggtcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgt

SEQ ID NO: 3832 - DNA, 774 bp, Homo sapiens; identical to SEQ ID NO: 1014
  misc_feature 1..774: note = chr11:134145653-134146427
  misc_feature 1..774: note = hyper
  source 1..774: mol_type = genomic DNA

SEQ ID NO: 3833 - DNA, 232 bp, Homo sapiens; identical to SEQ ID NO: 1015
  misc_feature 1..232: note = chr11:134146444-134146676
  misc_feature 1..232: note = hyper
  source 1..232: mol_type = genomic DNA

SEQ ID NO: 3834 - DNA, 217 bp, Homo sapiens; identical to SEQ ID NO: 1016
  misc_feature 1..217: note = chr11:134146677-134146894
  misc_feature 1..217: note = hyper
  source 1..217: mol_type = genomic DNA

SEQ ID NO: 3835 - DNA, 244 bp, Homo sapiens
  misc_feature 1..244: note = chr12:1639107-1639351
  misc_feature 1..244: note = hyper
  source 1..244: mol_type = genomic DNA
cgctcgtgccaggatcgcggggcgcgggtacgggctccttgggcgccccgagggggctgctggccggggtaagagccgcggtttcttcggaggatcgggtcgagttccaggagaagggggcagcaggcgtgcggcgccgggagaagggggccgggcggcggagactccccgtccgcacccccgcggcgaggcccccgggccgctctgcttaggggccgagggagccgggcgggaggcaggtgcg

SEQ ID NO: 3836 - DNA, 285 bp, Homo sapiens
  misc_feature 1..285: note = chr12:2162554-2162839
  misc_feature 1..285: note = hyper
  source 1..285: mol_type = genomic DNA
tgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggtaaggctggaccccgccgcctcgccggggctccctgccttttccaccgggttcctgcccta

SEQ ID NO: 3837 - DNA, 400 bp, Homo sapiens
  misc_feature 1..400: note = chr12:2163110-2163510
  misc_feature 1..400: note = hyper
  source 1..400: mol_type = genomic DNA
ggctgcctggccagccgcgcggggggcagagggcgccggcgccgcggagcccagaggcccggggtccctcgcccggctcggggcgcggctgggagcgcgcgcgcgcgcaccctgcgccggcagagcccggcgcccacggccgcccctggggcgccctcgcgctgcccggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 3838 - DNA, 61 bp, Homo sapiens
  misc_feature 1..61: note = chr12:3600168-3600229
  misc_feature 1..61: note = hyper
  source 1..61: mol_type = genomic DNA
cgggcctggcctccacgtaagttgtgtgcagcgccagggagtggaggcggccgagaccctc

SEQ ID NO: 3839 - DNA, 115 bp, Homo sapiens
  misc_feature 1..115: note = chr12:3600230-3600345
  misc_feature 1..115: note = hyper
  source 1..115: mol_type = genomic DNA
gagactaggggagggggcgggcccgggggcgctgggggccctcggtctgcgcccagccgccgccggctccagcgaacctcctaccccgcccccactcacccggctcagcccctag

SEQ ID NO: 3840 - DNA, 555 bp, Homo sapiens
  misc_feature 1..555: note = chr12:3602162-3602717
  misc_feature 1..555: note = hyper
  source 1..555: mol_type = genomic DNA
gagttcttaactctgcgctaaaacccctaccccacggcgtaggcagcaaagctttataaatcccccttctctgagagactagaagcagcatgcatctgacaattgtcaatttcaaaacaaacacgctccgggacttgaacgcagcggggcattcagtagcgaatgctgtctccttgagttagggcaaagcctgcgtgcccgccgtcccctcaccacttcctcttccccagcccccacctgagagcagacattcggaatgatgtgtagtgcgaggcggctagcctcccagcagaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcg

SEQ ID NO: 3841 - DNA, 15 bp, Homo sapiens
  misc_feature 1..15: note = chr12:3602864-3602879
  misc_feature 1..15: note = hyper
  source 1..15: mol_type = genomic DNA
cgctcccccttctca

SEQ ID NO: 3842 - DNA, 335 bp, Homo sapiens; identical to SEQ ID NO: 1017
  misc_feature 1..335: note = chr12:4274054-4274389
  misc_feature 1..335: note = hyper
  source 1..335: mol_type = genomic DNA

SEQ ID NO: 3843 - DNA, 808 bp, Homo sapiens; identical to SEQ ID NO: 1018
  misc_feature 1..808: note = chr12:5017990-5018798
  misc_feature 1..808: note = hyper
  source 1..808: mol_type = genomic DNA

SEQ ID NO: 3844 - skipped

SEQ ID NO: 3845 - DNA, 229 bp, Homo sapiens; identical to SEQ ID NO: 1020
  misc_feature 1..229: note = chr12:5018806-5019035
  misc_feature 1..229: note = hyper
  source 1..229: mol_type = genomic DNA

SEQ ID NO: 3846 - DNA, 659 bp, Homo sapiens; identical to SEQ ID NO: 1021
  misc_feature 1..659: note = chr12:5019084-5019743
  misc_feature 1..659: note = hyper
  source 1..659: mol_type = genomic DNA

SEQ ID NO: 3847 - DNA, 397 bp, Homo sapiens; identical to SEQ ID NO: 1022
  misc_feature 1..397: note = chr12:5019793-5020190
  misc_feature 1..397: note = hyper
  source 1..397: mol_type = genomic DNA

SEQ ID NO: 3848 - DNA, 712 bp, Homo sapiens
  misc_feature 1..712: note = chr12:5542090-5542802
  misc_feature 1..712: note = hyper
  source 1..712: mol_type = genomic DNA
gcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggacta

SEQ ID NO: 3849 - DNA, 153 bp, Homo sapiens
  misc_feature 1..153: note = chr12:6664370-6664523
  misc_feature 1..153: note = hyper
  source 1..153: mol_type = genomic DNA
cgttgtgagtggtatgacacagagagacctgtccccctttcccaatccctacctccgcttgtactcgtcccgctcccgcttcactttggccagcacgttgtagagagcgcggatctcgggcgtgatggtgtcgatctggacgcccaccccatc

SEQ ID NO: 3850 - DNA, 424 bp, Homo sapiens
  misc_feature 1..424: note = chr12:8171321-8171745
  misc_feature 1..424: note = hyper
  source 1..424: mol_type = genomic DNA
gcccggcagtgacagcgaccgcgccgctgcgctcccgccggccccgcccgcagccgctgggacccactaactgcctcgaaaagcctaggattcgactttgaatggtccgttaatgtggtcgcaaaacgtgactcggttcatcgggcgctccctgtaagcaagacaagcacccacctgcggtcagagcaggggtccggctcgcggtcggggttgtccaggccctcccggcttctcacctgcgcaccacacggtccagccctggcggctgcaggggatccctccgagcgccccctcaggcgtcttcctgcgaccggggagagggaaccctttacggggaaacagttttggggcccaccacccttggcgccgccgttaggagggtgtgaacatttctgctttaagagatacccgagcccctcaccgc

SEQ ID NO: 3851 - DNA, 68 bp, Homo sapiens; identical to SEQ ID NO: 1023
  misc_feature 1..68: note = chr12:14133813-14133881
  misc_feature 1..68: note = hyper
  source 1..68: mol_type = genomic DNA

SEQ ID NO: 3852 - DNA, 777 bp, Homo sapiens
  misc_feature 1..777: note = chr12:14134478-14135255
  misc_feature 1..777: note = hyper
  source 1..777: mol_type = genomic DNA
gcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtggcgcctcctcccggccgcagcggggaacagcaccgacggagagcggctgaggggcgaggggagctagacagtgccccccgtgggcggcccgcgggctgcggaaagcatctccaaggcggagctgtagttcgaaattgaagaccc

SEQ ID NO: 3853 - DNA, 71 bp, Homo sapiens; identical to SEQ ID NO: 1024
  misc_feature 1..71: note = chr12:22093889-22093960
  misc_feature 1..71: note = hyper
  source 1..71: mol_type = genomic DNA

SEQ ID NO: 3854 - DNA, 308 bp, Homo sapiens; identical to SEQ ID NO: 1025
  misc_feature 1..308: note = chr12:22093961-22094269
  misc_feature 1..308: note = hyper
  source 1..308: mol_type = genomic DNA

SEQ ID NO: 3855 - DNA, 471 bp, Homo sapiens; identical to SEQ ID NO: 1026
  misc_feature 1..471: note = chr12:22094577-22095048
  misc_feature 1..471: note = hyper
  source 1..471: mol_type = genomic DNA

SEQ ID NO: 3856 - DNA, 83 bp, Homo sapiens; identical to SEQ ID NO: 1027
  misc_feature 1..83: note = chr12:22486799-22486882
  misc_feature 1..83: note = hyper
  source 1..83: mol_type = genomic DNA

SEQ ID NO: 3857 - DNA, 300 bp, Homo sapiens; identical to SEQ ID NO: 1028
  misc_feature 1..300: note = chr12:22487133-22487433
  misc_feature 1..300: note = hyper
  source 1..300: mol_type = genomic DNA

SEQ ID NO: 3858 - DNA, 194 bp, Homo sapiens
  misc_feature 1..194: note = chr12:25056242-25056436
  misc_feature 1..194: note = hyper
  source 1..194: mol_type = genomic DNA
cgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtct

SEQ ID NO: 3859 - DNA, 601 bp, Homo sapiens
  misc_feature 1..601: note = chr12:25101397-25101998
  misc_feature 1..601: note = hyper
  source 1..601: mol_type = genomic DNA
cctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgtagcagactttcacctccgttcccaaaagcgaatgtgaaaaagtccgagaaggcacgtcctgcgagtggaggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagggtcgtagcccctggccgtgtggaccgggtctgcggctgcagagcgcggtcccggctgcagcaagacctggggcagtgcc

SEQ ID NO: 3860 - DNA, 77 bp, Homo sapiens
  misc_feature 1..77: note = chr12:25102009-25102086
  misc_feature 1..77: note = hyper
  source 1..77: mol_type = genomic DNA
cgagtacacgtggcgggctggattgcagaccggccctctcgcggcggagactcgcgacctagcggattgcatcagca

SEQ ID NO: 3861 - DNA, 372 bp, Homo sapiens
  misc_feature 1..372: note = chr12:28128699-28129071
  misc_feature 1..372: note = hyper
  source 1..372: mol_type = genomic DNA
agtggttacagttggcgatcgcagggtgggggttgggggtgtagaccgtgggccatggaacacgtggcatctctccagggcataaaaatcaatctagctggtggctcctatggagtttgtaaattgcgcagagctggctgggggaagccagtgagctgtccatggtggttaaggctcgttgatgtgcgtcctcgggctgtcctggtgaggcacagacccccctaccccaggggccgcaacgccccagagccccagcctgccagcgatccagccggtgtgcgcccgacacgaggctggacgtgtgtttgcacaactccaggacgcgctcttgcacagaggccgaattccagagatagacggaaaaatctcccg

SEQ ID NO: 3862 - DNA, 23 bp, Homo sapiens
  misc_feature 1..23: note = chr12:30322902-30322925
  misc_feature 1..23: note = hyper
  source 1..23: mol_type = genomic DNA
cccagcagagcgaggcgctgggc

SEQ ID NO: 3863 - DNA, 426 bp, Homo sapiens
  misc_feature 1..426: note = chr12:30323014-30323440
  misc_feature 1..426: note = hyper
  source 1..426: mol_type = genomic DNA
cggccccggctatcaacacctcctcctccccactgcgaatgccccgatcgtgctccccaaaacccaatacatccacgcccccaaaaaactgggaacccacgcgggtgccttctgtttaccgcagcgctctcactgcaggcgcttgagtaccagatggcgagagttcgcgcgcaggtggagtggggatcctggcgctaggctacccaggagaggaggggaagggcaacccgcggtcccgcctgtggtgcccggctgtgctcatccccacgccccagaccccaaaaggggctggggaggggcacatctggcggacccctcgcgggggaccaagcgggtttagcaggtgcgccgcctggaacccctacgcccaccttccagggagaaaagtgcctctgcttctcgggaagttcccggcttttcagcacc

SEQ ID NO: 3864 - DNA, 24 bp, Homo sapiens
  misc_feature 1..24: note = chr12:30323502-30323526
  misc_feature 1..24: note = hyper
  source 1..24: mol_type = genomic DNA
cgccagcttcgtgatcttctgccc

SEQ ID NO: 3865 - DNA, 533 bp, Homo sapiens
  misc_feature 1..533: note = chr12:30975388-30975921
  misc_feature 1..533: note = hyper
  source 1..533: mol_type = genomic DNA
cgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccgcggctccggctgcttcgccctccctctgtgggctgggctggggtcctcgcgagaagtcctgccccgctcccttctccaaatccacaggccctgtttctctggagacagggaggctcatacaggatatgtgcaaatgcttttattacaagctgagttgaaagacacccgtttgctctcgggtccttttggtgagcgccgcaggaagccgggctcctctctccccagaggcggccgcaggttcgcggcgcagggcctgcagtgccaggagcaggcaggggcctctgccctccccttcgtccctgatctcccgcctcctcctcacccgccgtctctgcgaactcaccctggg

SEQ ID NO: 3866 - DNA, 100 bp, Homo sapiens
  misc_feature 1..100: note = chr12:31079268-31079368
  misc_feature 1..100: note = hyper
  source 1..100: mol_type = genomic DNA
ctaagcggggagctgcggagcgcggggagtttgaaagccgctccaccgccctactagtccgtccttttgccccgccccccttagggatccccccggcaac

SEQ ID NO: 3867 - DNA, 247 bp, Homo sapiens
  misc_feature 1..247: note = chr12:31079417-31079664
  misc_feature 1..247: note = hyper
  source 1..247: mol_type = genomic DNA
cgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccc

SEQ ID NO: 3868 - DNA, 117 bp, Homo sapiens
  misc_feature 1..117: note = chr12:31079693-31079810
  misc_feature 1..117: note = hyper
  source 1..117: mol_type = genomic DNA
cgcagctcccttcgccgcttccggagcccctggcagggtaagtgcagaagcgcgcccgaggagtgggggcgccgcgggagggggctgggggtccaggagaggcgcctccacctccgc

SEQ ID NO: 3869 - DNA, 96 bp, Homo sapiens
  misc_feature 1..96: note = chr12:47225381-47225477
  misc_feature 1..96: note = hyper
  source 1..96: mol_type = genomic DNA
atccagctctgctctcgccttctcccttgaaagagactccttgggggctccccaggtcagagtaccccgcccggggaatcatgctggtctctgggg

SEQ ID NO: 3870 - DNA, 65 bp, Homo sapiens
  misc_feature 1..65: note = chr12:47225550-47225615
  misc_feature 1..65: note = hyper
  source 1..65: mol_type = genomic DNA
cgggtccagggactcgggtaacaccttgccagcaggatcccgggcggtcgcggagccagctcccg

SEQ ID NO: 3871 - DNA, 1227 bp, Homo sapiens; identical to SEQ ID NO: 1029
  misc_feature 1..1227: note = chr12:48397123-48398350
  misc_feature 1..1227: note = hyper
  source 1..1227: mol_type = genomic DNA

SEQ ID NO: 3872 - DNA, 113 bp, Homo sapiens
  misc_feature 1..113: note = chr12:49297802-49297915
  misc_feature 1..113: note = hyper
  source 1..113: mol_type = genomic DNA
gaccctctcaaaaaccgaccgcggtcctccactgggtagggggcgctccaagacagggactcttctagcctgttgcctctccatgttagcgatatcctcgttgctaggagact

SEQ ID NO: 3873 - DNA, 90 bp, Homo sapiens; identical to SEQ ID NO: 1030
  misc_feature 1..90: note = chr12:49374937-49375027
  misc_feature 1..90: note = hyper
  source 1..90: mol_type = genomic DNA

SEQ ID NO: 3874 - DNA, 57 bp, Homo sapiens; identical to SEQ ID NO: 1031
  misc_feature 1..57: note = chr12:49375115-49375172
  misc_feature 1..57: note = hyper
  source 1..57: mol_type = genomic DNA

SEQ ID NO: 3875 - DNA, 255 bp, Homo sapiens; identical to SEQ ID NO: 1032
  misc_feature 1..255: note = chr12:49390850-49391105
  misc_feature 1..255: note = hyper
  source 1..255: mol_type = genomic DNA

SEQ ID NO: 3876 - DNA, 788 bp, Homo sapiens; identical to SEQ ID NO: 1033
  misc_feature 1..788: note = chr12:49391146-49391934
  misc_feature 1..788: note = hyper
  source 1..788: mol_type = genomic DNA

SEQ ID NO: 3877 - DNA, 634 bp, Homo sapiens; identical to SEQ ID NO: 1034
  misc_feature 1..634: note = chr12:49729728-49730362
  misc_feature 1..634: note = hyper
  source 1..634: mol_type = genomic DNA

SEQ ID NO: 3878 - DNA, 94 bp, Homo sapiens; identical to SEQ ID NO: 1035
  misc_feature 1..94: note = chr12:50297461-50297555
  misc_feature 1..94: note = hyper
  source 1..94: mol_type = genomic DNA

SEQ ID NO: 3879 - DNA, 115 bp, Homo sapiens; identical to SEQ ID NO: 1036
  misc_feature 1..115: note = chr12:50297973-50298088
  misc_feature 1..115: note = hyper
  source 1..115: mol_type = genomic DNA

SEQ ID NO: 3880 - DNA, 198 bp, Homo sapiens
  misc_feature 1..198: note = chr12:52400709-52400907
  misc_feature 1..198: note = hyper
  source 1..198: mol_type = genomic DNA
gacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctcc

SEQ ID NO: 3881 - DNA, 508 bp, Homo sapiens
  misc_feature 1..508: note = chr12:52400908-52401416
  misc_feature 1..508: note = hyper
  source 1..508: mol_type = genomic DNA
gtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagaca

SEQ ID NO: 3882 - DNA, 79 bp, Homo sapiens; identical to SEQ ID NO: 1037
  misc_feature 1..79: note = chr12:52652141-52652220
  misc_feature 1..79: note = hyper
  source 1..79: mol_type = genomic DNA

SEQ ID NO: 3883 - DNA, 14 bp, Homo sapiens
  misc_feature 1..14: note = chr12:52652599-52652613
  misc_feature 1..14: note = hyper
  source 1..14: mol_type = genomic DNA
gagtggaacccctc

SEQ ID NO: 3884 - DNA, 15 bp, Homo sapiens
  misc_feature 1..15: note = chr12:53359301-53359316
  misc_feature 1..15: note = hyper
  source 1..15: mol_type = genomic DNA
tagggagctgctccc

SEQ ID NO: 3885 - DNA, 178 bp, Homo sapiens
  misc_feature 1..178: note = chr12:53359385-53359563
  misc_feature 1..178: note = hyper
  source 1..178: mol_type = genomic DNA
cgcgctcccattgggtggtgcctgggtgtccccggctcggcagctgcggctgcttcccagccccggggtctcagggccgtcccgccggtcccagggcaccgctcctgtgccccacgccgccgcttccccagttgccccctgactgcaagagtctcctggttttcggcttgtcctggga

SEQ ID NO: 3886 - DNA, 378 bp, Homo sapiens; identical to SEQ ID NO: 1039
  misc_feature 1..378: note = chr12:54321250-54321628
  misc_feature 1..378: note = hyper
  source 1..378: mol_type = genomic DNA

SEQ ID NO: 3887 - DNA, 114 bp, Homo sapiens
  misc_feature 1..114: note = chr12:54338704-54338818
  misc_feature 1..114: note = hyper
  source 1..114: mol_type = genomic DNA
gtgcctaggcagcctcgggtcctctatctcagtccagccgcttgcctcacttcttcccgcttgccttatctccccgcagacgtggttcccctgcagcccgaggtgagcagctac

SEQ ID NO: 3888 - DNA, 17 bp, Homo sapiens
  misc_feature 1..17: note = chr12:54338978-54338995
  misc_feature 1..17: note = hyper
  source 1..17: mol_type = genomic DNA
ggcgggtcaaagagaag

SEQ ID NO: 3889 - DNA, 48 bp, Homo sapiens; identical to SEQ ID NO: 1040
  misc_feature 1..48: note = chr12:54345611-54345659
  misc_feature 1..48: note = hyper
  source 1..48: mol_type = genomic DNA

SEQ ID NO: 3890 - DNA, 14 bp, Homo sapiens
  misc_feature 1..14: note = chr12:54345965-54345979
  misc_feature 1..14: note = hyper
  source 1..14: mol_type = genomic DNA
ggtgggtctcaggg

SEQ ID NO: 3891 - DNA, 180 bp, Homo sapiens; identical to SEQ ID NO: 1042
  misc_feature 1..180: note = chr12:54354514-54354694
  misc_feature 1..180: note = hyper
  source 1..180: mol_type = genomic DNA

SEQ ID NO: 3892 - DNA, 38 bp, Homo sapiens; identical to SEQ ID NO: 1043
  misc_feature 1..38: note = chr12:54354814-54354852
  misc_feature 1..38: note = hyper
  source 1..38: mol_type = genomic DNA

SEQ ID NO: 3893 - DNA, 43 bp, Homo sapiens; identical to SEQ ID NO: 1044
  misc_feature 1..43: note = chr12:54379888-54379931
  misc_feature 1..43: note = hyper
  source 1..43: mol_type = genomic DNA

SEQ ID NO: 3894 - DNA, 406 bp, Homo sapiens; identical to SEQ ID NO: 1045
  misc_feature 1..406: note = chr12:54379958-54380364
  misc_feature 1..406: note = hyper
  source 1..406: mol_type = genomic DNA

SEQ ID NO: 3895 - DNA, 120 bp, Homo sapiens
  misc_feature 1..120: note = chr12:54402676-54402796
  misc_feature 1..120: note = hyper
  source 1..120: mol_type = genomic DNA
tcatgtcgtggattgatgaacgcgaatcgcgtgtaagcgccgccaccgccgggagtctgaggaattcgcctgggctgttagaggaaagagctaagtgagagagcgcgagctctacctacc

SEQ ID NO: 3896 - DNA, 504 bp, Homo sapiens
  misc_feature 1..504: note = chr12:54402856-54403360
  misc_feature 1..504: note = hyper
  source 1..504: mol_type = genomic DNA
ccgcgccccagccccgggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagt

SEQ ID NO: 3897 - DNA, 553 bp, Homo sapiens
  misc_feature 1..553: note = chr12:54812069-54812622
  misc_feature 1..553: note = hyper
  source 1..553: mol_type = genomic DNA
cagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggcccccatttaaccttccgaccccctcagtctttgactttcctcctactacacgtagctcattcggcttctacccgttctctcgccgcacaatggcccctacggatcccgaggtctcctggagcccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 3898 - DNA, 14 bp, Homo sapiens
  misc_feature 1..14: note = chr12:57619110-57619124
  misc_feature 1..14: note = hyper
  source 1..14: mol_type = genomic DNA
gggcctgtccccca

SEQ ID NO: 3899 - DNA, 340 bp, Homo sapiens
  misc_feature 1..340: note = chr12:57943845-57944185
  misc_feature 1..340: note = hyper
  source 1..340: mol_type = genomic DNA
gacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggt

SEQ ID NO: 3900 - DNA, 166 bp, Homo sapiens
  misc_feature 1..166: note = chr12:58021293-58021459
  misc_feature 1..166: note = hyper
  source 1..166: mol_type = genomic DNA
ccgctggcggctgggcgcgggtgcagcctaggaggagaggcgcgtgaccgtgcgccagctccccgtggggctcctgccagggtcgaccgggagggggtgccactcacccagatgagccacgcggctgaggcgggggtcgaaaccgacctcgcgcaccttgtcagtc

SEQ ID NO: 3901 - DNA, 88 bp, Homo sapiens; identical to SEQ ID NO: 1046
  misc_feature 1..88: note = chr12:58025646-58025734
  misc_feature 1..88: note = hyper
  source 1..88: mol_type = genomic DNA

SEQ ID NO: 3902 - DNA, 190 bp, Homo sapiens; identical to SEQ ID NO: 1047
  misc_feature 1..190: note = chr12:62584823-62585013
  misc_feature 1..190: note = hyper
  source 1..190: mol_type = genomic DNA

SEQ ID NO: 3903 - DNA, 963 bp, Homo sapiens; identical to SEQ ID NO: 1048
  misc_feature 1..963: note = chr12:62585030-62585993
  misc_feature 1..963: note = hyper
  source 1..963: mol_type = genomic DNA

SEQ ID NO: 3904 - DNA, 462 bp, Homo sapiens
  misc_feature 1..462: note = chr12:63543848-63544310
  misc_feature 1..462: note = hyper
  source 1..462: mol_type = genomic DNA
gctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaa

SEQ ID NO: 3905 - DNA, 88 bp, Homo sapiens; identical to SEQ ID NO: 1049
  misc_feature 1..88: note = chr12:63544512-63544600
  misc_feature 1..88: note = hyper
  source 1..88: mol_type = genomic DNA

SEQ ID NO: 3906 - DNA, 146 bp, Homo sapiens; identical to SEQ ID NO: 1050
  misc_feature 1..146: note = chr12:63544728-63544874
  misc_feature 1..146: note = hyper
  source 1..146: mol_type = genomic DNA

SEQ ID NO: 3907 - DNA, 165 bp, Homo sapiens
  misc_feature 1..165: note = chr12:64061785-64061950
  misc_feature 1..165: note = hyper
  source 1..165: mol_type = genomic DNA
aagaaaagcgccatgcggctccctcctagggctctcctgccctctcctcaccgatgccgagagtggttctgctggagaaccgccgcgcctgcagttcctgcaccttttcccggagctgcgccagggaattacggacgaactggaaggggccgagaagaaaggtct

SEQ ID NO: 3908 - DNA, 232 bp, Homo sapiens; identical to SEQ ID NO: 1051
  misc_feature 1..232: note = chr12:65218319-65218551
  misc_feature 1..232: note = hyper
  source 1..232: mol_type = genomic DNA

SEQ ID NO: 3909 - DNA, 281 bp, Homo sapiens; identical to SEQ ID NO: 1052
  misc_feature 1..281: note = chr12:65218900-65219181
  misc_feature 1..281: note = hyper
  source 1..281: mol_type = genomic DNA

SEQ ID NO: 3910 - DNA, 179 bp, Homo sapiens; identical to SEQ ID NO: 1053
  misc_feature 1..179: note = chr12:65219605-65219784
  misc_feature 1..179: note = hyper
  source 1..179: mol_type = genomic DNA

SEQ ID NO: 3911 - DNA, 327 bp, Homo sapiens
  misc_feature 1..327: note = chr12:65220112-65220439
  misc_feature 1..327: note = hyper
  source 1..327: mol_type = genomic DNA
ctatgagaaggcaatcggcatgatgcccagcaggtgccccggaaaagtcagaagagcatattggtcagacatacagggaatccttgtagtgtggcaagaataagtcagcgcgggaccgaatttcctggtctttgttatcaagcaaacgtcatgattatacgctcctccattcagcacctcgcgtccggacagcaacctcacttgttttcagcgtgccttaaagcgtgcgctgggctggaaacactcccgtggccgttgttatcaccgttctatgtttgggcaggacttcgtttaaaccacctcagagagaggcggatccatgtggta

SEQ ID NO: 3912 - DNA, 200 bp, Homo sapiens
  misc_feature 1..200: note = chr12:65514835-65515035
  misc_feature 1..200: note = hyper
  source 1..200: mol_type = genomic DNA
ttgcctggtgagcatcgatccataggtacaggctctcctcctgcggcggcccggcctccgcccgcagtgccagcaggcacaggaggatgctccagagccagagcgcggcggcagggaaggcgctcctccgggccatgctgctcaggacctcctcgctgccgggaaaactcctcgtgccgcacctacgcaacctggcgccg

SEQ ID NO: 3913 - DNA, 139 bp, Homo sapiens
  misc_feature 1..139: note = chr12:66123380-66123519
  misc_feature 1..139: note = hyper
  source 1..139: mol_type = genomic DNA
gggaggtggagcacgaaacacaaaagctgtttgaaccacaaacgccaggctggacacccaacgaatattaatgacctgcagcctccacccacccgcaaacataatattatgtgtacgtgcttaccggttagcttaacag

SEQ ID NO: 3914 - DNA, 122 bp, Homo sapiens
  misc_feature 1..122: note = chr12:72666686-72666808
  misc_feature 1..122: note = hyper
  source 1..122: mol_type = genomic DNA
cttcgctgtgtccctcgtggcattgctcgcggtcacaatgctcgctgtgctgctcagcctgcgcttcgacgagtgcggggcgagtgccacgccaggcgccgacggtggcccctcaggctttc

SEQ ID NO: 3915 - DNA, 389 bp, Homo sapiens
  misc_feature 1..389: note = chr12:72666997-72667386
  misc_feature 1..389: note = hyper
  source 1..389: mol_type = genomic DNA
cgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaaggtatggagggaggcggtgccccgcgctgccccaccccggcgcgcggctc

SEQ ID NO: 3916 - DNA, 38 bp, Homo sapiens
  misc_feature 1..38: note = chr12:72667387-72667425
  misc_feature 1..38: note = hyper
  source 1..38: mol_type = genomic DNA
aacctctgggcggcctgcgaccccggggacccagctgg

SEQ ID NO: 3917 - DNA, 20 bp, Homo sapiens
  misc_feature 1..20: note = chr12:75601480-75601500
  misc_feature 1..20: note = hyper
  source 1..20: mol_type = genomic DNA
ggtcgctggccctgccgccg

SEQ ID NO: 3918 - DNA, 247 bp, Homo sapiens; identical to SEQ ID NO: 1055
  misc_feature 1..247: note = chr12:75601695-75601942
  misc_feature 1..247: note = hyper
  source 1..247: mol_type = genomic DNA

SEQ ID NO: 3919 - DNA, 194 bp, Homo sapiens
  misc_feature 1..194: note = chr12:81102236-81102430
  misc_feature 1..194: note = hyper
  source 1..194: mol_type = genomic DNA
accccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaat

SEQ ID NO: 3920 - DNA, 375 bp, Homo sapiens
  misc_feature 1..375: note = chr12:85673460-85673835
  misc_feature 1..375: note = hyper
  source 1..375: mol_type = genomic DNA
ttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctg

SEQ ID NO: 3921 - DNA, 224 bp, Homo sapiens
  misc_feature 1..224: note = chr12:93966429-93966653
  misc_feature 1..224: note = hyper
  source 1..224: mol_type = genomic DNA
actgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtcttt

SEQ ID NO: 3922 - DNA, 149 bp, Homo sapiens
  misc_feature 1..149: note = chr12:93967067-93967216
  misc_feature 1..149: note = hyper
  source 1..149: mol_type = genomic DNA
agatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccggg

SEQ ID NO: 3923 - DNA, 14 bp, Homo sapiens
  misc_feature 1..14: note = chr12:95942964-95942978
  misc_feature 1..14: note = hyper
  source 1..14: mol_type = genomic DNA
gcgtggcaaactcc

SEQ ID NO: 3924 - DNA, 107 bp, Homo sapiens
  misc_feature 1..107: note = chr12:99288301-99288408
  misc_feature 1..107: note = hyper
  source 1..107: mol_type = genomic DNA
cgactcggcttcctccgcctctgccccggctgcggcaccacttcttggagccacgtctcggcgagcgggggccgcggagcgagggggccgctgtgccgctactcacc

SEQ ID NO: 3925 - DNA, 155 bp, Homo sapiens
  misc_feature 1..155: note = chr12:99288782-99288937
  misc_feature 1..155: note = hyper
  source 1..155: mol_type = genomic DNA
cggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagag

SEQ ID NO: 3926 - skipped

SEQ ID NO: 3927 - DNA, 93 bp, Homo sapiens
  misc_feature 1..93: note = chr12:99289161-99289254
  misc_feature 1..93: note = hyper
  source 1..93: mol_type = genomic DNA
ggctcggcagcggcagagcagtggcagcagccgccactgccgctgttactgcggtcgccgccgctggagagaggaggacgaggagggcaaggg

SEQ ID NO: 3928 - DNA, 485 bp, Homo sapiens; identical to SEQ ID NO: 1057
  misc_feature 1..485: note = chr12:103351501-103351986
  misc_feature 1..485: note = hyper
  source 1..485: mol_type = genomic DNA

SEQ ID NO: 3929 - DNA, 104 bp, Homo sapiens; identical to SEQ ID NO: 1058
  misc_feature 1..104: note = chr12:103352051-103352155
  misc_feature 1..104: note = hyper
  source 1..104: mol_type = genomic DNA

SEQ ID NO: 3930 - DNA, 97 bp, Homo sapiens; identical to SEQ ID NO: 1059
  misc_feature 1..97: note = chr12:103352170-103352267
  misc_feature 1..97: note = hyper
  source 1..97: mol_type = genomic DNA

SEQ ID NO: 3931 - DNA, 15 bp, Homo sapiens
  misc_feature 1..15: note = chr12:103352268-103352283
  misc_feature 1..15: note = hyper
  source 1..15: mol_type = genomic DNA
cccaagcaagtcaag

SEQ ID NO: 3932 - DNA, 259 bp, Homo sapiens; identical to SEQ ID NO: 1061
  misc_feature 1..259: note = chr12:103352313-103352572
  misc_feature 1..259: note = hyper
  source 1..259: mol_type = genomic DNA

SEQ ID NO: 3933 - DNA, 263 bp, Homo sapiens; identical to SEQ ID NO: 1062
  misc_feature 1..263: note = chr12:103889253-103889516
  misc_feature 1..263: note = hyper
  source 1..263: mol_type = genomic DNA

SEQ ID NO: 3934 - DNA, 197 bp, Homo sapiens; identical to SEQ ID NO: 1063
  misc_feature 1..197: note = chr12:103889517-103889714
  misc_feature 1..197: note = hyper
  source 1..197: mol_type = genomic DNA

SEQ ID NO: 3935 - DNA, 24 bp, Homo sapiens
  misc_feature 1..24: note = chr12:103889788-103889812
  misc_feature 1..24: note = hyper
  source 1..24: mol_type = genomic DNA
cgcagtcgccgggcaaccacaatg

SEQ ID NO: 3936 - DNA, 78 bp, Homo sapiens; identical to SEQ ID NO: 1065
  misc_feature 1..78: note = chr12:104609448-104609526
  misc_feature 1..78: note = hyper
  source 1..78: mol_type = genomic DNA

SEQ ID NO: 3937 - DNA, 270 bp, Homo sapiens; identical to SEQ ID NO: 1066
  misc_feature 1..270: note = chr12:104609527-104609797
  misc_feature 1..270: note = hyper
  source 1..270: mol_type = genomic DNA

SEQ ID NO: 3938 - DNA, 628 bp, Homo sapiens; identical to SEQ ID NO: 1067
  misc_feature 1..628: note = chr12:106980911-106981539
  misc_feature 1..628: note = hyper
  source 1..628: mol_type = genomic DNA

SEQ ID NO: 3939 - DNA, 492 bp, Homo sapiens; identical to SEQ ID NO: 1068
  misc_feature 1..492: note = chr12:108168922-108169414
  misc_feature 1..492: note = hyper
  source 1..492: mol_type = genomic DNA

SEQ ID NO: 3940 - DNA, 34 bp, Homo sapiens; identical to SEQ ID NO: 1069
  misc_feature 1..34: note = chr12:108169549-108169583
  misc_feature 1..34: note = hyper
  source 1..34: mol_type = genomic DNA

SEQ ID NO: 3941 - DNA, 255 bp, Homo sapiens
  misc_feature 1..255: note = chr12:108238259-108238514
  misc_feature 1..255: note = hyper
  source 1..255: mol_type = genomic DNA
gagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacc

SEQ ID NO: 3942 - DNA, 553 bp, Homo sapiens
  misc_feature 1..553: note = chr12:111471407-111471960
  misc_feature 1..553: note = hyper
  source 1..553: mol_type = genomic DNA
gcaagcgggggtaggcgccccgcgcgcccgcctcccgcagcgccccctcccaaacttccctttgcattgatcagcacgttacgtcagtattgataagtttgcaaaaagccaaagtcaagtgcaatcgcgcggcacaccgaccccggacttgggggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaactcttgtgtgtg

SEQ ID NO: 3943 - DNA, 138 bp, Homo sapiens
  misc_feature 1..138: note = chr12:111472058-111472196
  misc_feature 1..138: note = hyper
  source 1..138: mol_type = genomic DNA
cgccggccgcgcggccgtgaggagcccccgggcgcgccctgggcgcattggggaggtccccgggcgggcaggcggacgccctggggcggcgggcggcggctgccggggctcgccggggctcggccgcccgctgcccat

SEQ ID NO: 3944 - DNA, 161 bp, Homo sapiens
  misc_feature 1..161: note = chr12:111472356-111472517
  misc_feature 1..161: note = hyper
  source 1..161: mol_type = genomic DNA
cgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcgggcagg

SEQ ID NO: 3945 - DNA, 95 bp, Homo sapiens
  misc_feature 1..95: note = chr12:111472577-111472672
  misc_feature 1..95: note = hyper
  source 1..95: mol_type = genomic DNA
gaggcggctccgcgccccgccgctcgccggcacctcagccttcgccgcccgcctggctgcgcagcccggacgcgccgccacccgggggccgccgc

SEQ ID NO: 3946 - DNA, 166 bp, Homo sapiens
  misc_feature 1..166: note = chr12:111472851-111473017
  misc_feature 1..166: note = hyper
  source 1..166: mol_type = genomic DNA
cgctcctgcctccagggcggtggagagccgggagcggcgcagagcaggtgactcccagccctcgggcccaagggaacttttaaatgagagatttccttgcttgttctgcctcctgcgtttctccccgctgctcccctcgtctcctctctcccgtctctgcttttct

SEQ ID NO: 3947 - DNA, 325 bp, Homo sapiens; identical to SEQ ID NO: 1070
  misc_feature 1..325: note = chr12:113012954-113013279
  misc_feature 1..325: note = hyper
  source 1..325: mol_type = genomic DNA

SEQ ID NO: 3948 - DNA, 79 bp, Homo sapiens; identical to SEQ ID NO: 1071
  misc_feature 1..79: note = chr12:113541522-113541601
  misc_feature 1..79: note = hyper
  source 1..79: mol_type = genomic DNA

SEQ ID NO: 3949 - DNA, 438 bp, Homo sapiens; identical to SEQ ID NO: 1072
  misc_feature 1..438: note = chr12:113541661-113542099
  misc_feature 1..438: note = hyper
  source 1..438: mol_type = genomic DNA

SEQ ID NO: 3950 - DNA, 401 bp, Homo sapiens; identical to SEQ ID NO: 1073
  misc_feature 1..401: note = chr12:113900758-113901159
  misc_feature 1..401: note = hyper
  source 1..401: mol_type = genomic DNA

SEQ ID NO: 3951 - DNA, 24 bp, Homo sapiens
  misc_feature 1..24: note = chr12:113901407-113901431
  misc_feature 1..24: note = hyper
  source 1..24: mol_type = genomic DNA
cgaagtaggcgggggacccgggac

SEQ ID NO: 3952 - DNA, 332 bp, Homo sapiens
  misc_feature 1..332: note = chr12:113913350-113913682
  misc_feature 1..332: note = hyper
  source 1..332: mol_type = genomic DNA
gggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggac

SEQ ID NO: 3953 - DNA, 358 bp, Homo sapiens
  misc_feature 1..358: note = chr12:114838380-114838738
  misc_feature 1..358: note = hyper
  source 1..358: mol_type = genomic DNA
tctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctccc

SEQ ID NO: 3954 - DNA, 116 bp, Homo sapiens
  misc_feature 1..116: note = chr12:114844184-114844300
  misc_feature 1..116: note = hyper
  source 1..116: mol_type = genomic DNA
acaaatcatttcaaacgcggtcggcttctaatcgggaagtaatctcagtgacgctggcggtgcagagaaccgagtctggacgcacacacacaaacacaccgcgggcctccgcagcc

SEQ ID NO: 3955 - DNA, 476 bp, Homo sapiens
  misc_feature 1..476: note = chr12:114846471-114846947
  misc_feature 1..476: note = hyper
  source 1..476: mol_type = genomic DNA
cgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 3956 - DNA, 122 bp, Homo sapiens
  misc_feature 1..122: note = chr12:114847042-114847164
  misc_feature 1..122: note = hyper
  source 1..122: mol_type = genomic DNA
cgggcagcttccagcgccggccacaagctcccaggccagctgggccgcagacccctttgcttccagagagcacaacccgcgtcctttctctcagccaggctgcagtggctgccccgagcttc

SEQ ID NO: 3957 - DNA, 272 bp, Homo sapiens
  misc_feature 1..272: note = chr12:114847165-114847437
  misc_feature 1..272: note = hyper
  source 1..272: mol_type = genomic DNA
ctttcgtttcccaagctgttaataacgatatgtccccaaatccgaggctcgtgtttgctcccagatgccaagaacgcaacccgaaatccttctcccaaaccctaggtcgacgagatgagttcctacttgacctctgagccgaggtgggccggaaaccgaggcctaggccccgccggggctgcaaggaaaaggggaaactccgagcgtagcgtcttttccttgtggttcctttctccggcatcccggactgcgggccctgcagccacctggac

SEQ ID NO: 3958 - DNA, 78 bp, Homo sapiens
  misc_feature 1..78: note = chr12:114847577-114847655
  misc_feature 1..78: note = hyper
  source 1..78: mol_type = genomic DNA
cgggcagtaaactccggagccggctacagcgcgcatcctcccttcctcctttcggagaactgtcgctttcccgaagct

SEQ ID NO: 3959 - DNA, 131 bp, Homo sapiens
  misc_feature 1..131: note = chr12:117799330-117799461
  misc_feature 1..131: note = hyper
  source 1..131: mol_type = genomic DNA
cgctgctcgctgcccggccgcccctcggaggagccgcggcgctaagtagctcctcacccagcggctggaaacgcggcataaatatgtagggactgagccgtgagctcagcgagggtcgtgagggggaattt

SEQ ID NO: 3960 - DNA, 58 bp, Homo sapiens
  misc_feature 1..58: note = chr12:119212142-119212200
  misc_feature 1..58: note = hyper
  source 1..58: mol_type = genomic DNA
ttgtttgtccttgaacgcggcagggagtggaggaaggcgccgggaggaggcacaaaat

SEQ ID NO: 3961 - DNA, 63 bp, Homo sapiens
  misc_feature 1..63: note = chr12:119212318-119212381
  misc_feature 1..63: note = hyper
  source 1..63: mol_type = genomic DNA
cgctgctgaaatgcaatggacaaaagggagaggaatggccgcatcttccggctgcccgttgct

SEQ ID NO: 3962 - DNA, 364 bp, Homo sapiens
  misc_feature 1..364: note = chr12:120032837-120033201
  misc_feature 1..364: note = hyper
  source 1..364: mol_type = genomic DNA
ctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcacca

SEQ ID NO: 3963 - DNA, 153 bp, Homo sapiens
  misc_feature 1..153: note = chr12:128752114-128752267
  misc_feature 1..153: note = hyper
  source 1..153: mol_type = genomic DNA
cgaggggtgcggcgggggcctcggcgggggctcggatcccatcaacagcgcctctgcgggtgccgagccgcccctaatccagaagggcgctcccagctgggcgccgggatccgggcaagttaggctggtcccgagtcccgaatctcccacccc

SEQ ID NO: 3964 - DNA, 53 bp, Homo sapiens; identical to SEQ ID NO: 1075
  misc_feature 1..53: note = chr12:129337857-129337910
  misc_feature 1..53: note = hyper
  source 1..53: mol_type = genomic DNA

SEQ ID NO: 3965 - DNA, 239 bp, Homo sapiens; identical to SEQ ID NO: 1076
  misc_feature 1..239: note = chr12:129338587-129338826
  misc_feature 1..239: note = hyper
  source 1..239: mol_type = genomic DNA

SEQ ID NO: 3966 - DNA, 55 bp, Homo sapiens; identical to SEQ ID NO: 1077
  misc_feature 1..55: note = chr12:129338851-129338906
  misc_feature 1..55: note = hyper
  source 1..55: mol_type = genomic DNA

SEQ ID NO: 3967 - DNA, 156 bp, Homo sapiens
  misc_feature 1..156: note = chr12:130388279-130388435
  misc_feature 1..156: note = hyper
  source 1..156: mol_type = genomic DNA
gctagcgggcgctggcgcaggcggcgccggggtggcggggctgcggagcccgggacgcgggcagaggcggctcggagccccccgggcgggtggccgggctcgctgggcggcccggggctccctggcccgcagcccccatcccaggccggccgctgc

SEQ ID NO: 3968 - DNA, 140 bp, Homo sapiens
  misc_feature 1..140: note = chr12:130389012-130389152
  misc_feature 1..140: note = hyper
  source 1..140: mol_type = genomic DNA
cgtcatcaaaacctcaggcccaggggaggtcctccagcccgggggcacctgaggctcttcgccagggagagcgcaaggatggctggagaagggccctcgccccgccctgcgcatctcccagggatcgcagtgaggaagtc

SEQ ID NO: 3969 - DNA, 120 bp, Homo sapiens; identical to SEQ ID NO: 1078
  misc_feature 1..120: note = chr12:130647950-130648070
  misc_feature 1..120: note = hyper
  source 1..120: mol_type = genomic DNA

SEQ ID NO: 3970 - DNA, 15 bp, Homo sapiens
  misc_feature 1..15: note = chr12:133481368-133481383
  misc_feature 1..15: note = hyper
  source 1..15: mol_type = genomic DNA
gaagcttttcctcac

SEQ ID NO: 3971 - DNA, 31 bp, Homo sapiens; identical to SEQ ID NO: 1080
  misc_feature 1..31: note = chr12:133481489-133481520
  misc_feature 1..31: note = hyper
  source 1..31: mol_type = genomic DNA

SEQ ID NO: 3972 - DNA, 134 bp, Homo sapiens; identical to SEQ ID NO: 1081
  misc_feature 1..134: note = chr12:133481521-133481655
  misc_feature 1..134: note = hyper
  source 1..134: mol_type = genomic DNA

SEQ ID NO: 3973 - DNA, 187 bp, Homo sapiens; identical to SEQ ID NO: 1082
  misc_feature 1..187: note = chr12:133485161-133485348
  misc_feature 1..187: note = hyper
  source 1..187: mol_type = genomic DNA

SEQ ID NO: 3974 - DNA, 251 bp, Homo sapiens; identical to SEQ ID NO: 1083
  misc_feature 1..251: note = chr12:133485439-133485690
  misc_feature 1..251: note = hyper
  source 1..251: mol_type = genomic DNA

SEQ ID NO: 3975 - DNA, 481 bp, Homo sapiens; identical to SEQ ID NO: 1084
  misc_feature 1..481: note = chr13:23733629-23734110
  misc_feature 1..481: note = hyper
  source 1..481: mol_type = genomic DNA

SEQ ID NO: 3976 - DNA, 75 bp, Homo sapiens; identical to SEQ ID NO: 1085
  misc_feature 1..75: note = chr13:25319830-25319905
  misc_feature 1..75: note = hyper
  source 1..75: mol_type = genomic DNA

SEQ ID NO: 3977 - DNA, 70 bp, Homo sapiens
  misc_feature 1..70: note = chr13:25320387-25320457
  misc_feature 1..70: note = hyper
  source 1..70: mol_type = genomic DNA
cgcagctcctgatgccaagttcacttggaccccggctgagattagagaggcctggcgaggtgtgggggtg

SEQ ID NO: 3978 - DNA, 295 bp, Homo sapiens; identical to SEQ ID NO: 1086
  misc_feature 1..295: note = chr13:25320734-25321029
  misc_feature 1..295: note = hyper
  source 1..295: mol_type = genomic DNA

SEQ ID NO: 3979 - DNA, 1072 bp, Homo sapiens; identical to SEQ ID NO: 1087
  misc_feature 1..1072: note = chr13:25321112-25322184
  misc_feature 1..1072: note = hyper
  source 1..1072: mol_type = genomic DNA

SEQ ID NO: 3980 - DNA, 26 bp, Homo sapiens
  misc_feature 1..26: note = chr13:25744709-25744735
  misc_feature 1..26: note = hyper
  source 1..26: mol_type = genomic DNA
aggcagggtctggggcggcgggcgcc

SEQ ID NO: 3981 - DNA, 295 bp, Homo sapiens; identical to SEQ ID NO: 1089
  misc_feature 1..295: note = chr13:25745300-25745595
  misc_feature 1..295: note = hyper
  source 1..295: mol_type = genomic DNA

SEQ ID NO: 3982 - DNA, 221 bp, Homo sapiens; identical to SEQ ID NO: 1090
  misc_feature 1..221: note = chr13:25745726-25745947
  misc_feature 1..221: note = hyper
  source 1..221: mol_type = genomic DNA

SEQ ID NO: 3983 - DNA, 54 bp, Homo sapiens; identical to SEQ ID NO: 1091
  misc_feature 1..54: note = chr13:25946620-25946674
  misc_feature 1..54: note = hyper
  source 1..54: mol_type = genomic DNA

SEQ ID NO: 3984 - DNA, 18 bp, Homo sapiens
  misc_feature 1..18: note = chr13:25946801-25946819
  misc_feature 1..18: note = hyper
  source 1..18: mol_type = genomic DNA
cggcgcagagaagatgca

SEQ ID NO: 3985 - DNA, 403 bp, Homo sapiens
  misc_feature 1..403: note = chr13:26042768-26043171
  misc_feature 1..403: note = hyper
  source 1..403: mol_type = genomic DNA
cgcccaccccggcccgacaagcagcttgggcgtccagcccggcccggtccctgcagggagggagcgcaggagctgggggcggctctcccggggcggggctcgctccacaagcgccaggggccgcgcggggcgtgggcgtgggcggggccgggggcggggccggccttggctgccgcggcacaggcggcggcgtctccagggggagccaaggtacgtaggcggcgtccgcctcacccgagcatccttccccgccggtggccgcccgcccgcggcccgcgctcgcagcctcccgcctggcggttgacttctttgtgtcgtattctctgcctgcgccctgtctctgcaggacctgttcgttcttctttgggctataagaaggcagaggatgagatgtcccgggcca

SEQ ID NO: 3986 - DNA, 159 bp, Homo sapiens
  misc_feature 1..159: note = chr13:26043340-26043499
  misc_feature 1..159: note = hyper
  source 1..159: mol_type = genomic DNA
cgcgcacctggccggcccccgtccatctcccccagagccttcccctgccccctccccaccccactagcccgcggtgcagccccgcgcttccagtagggtcatgcgaatgcagccctcaccgttctctcctgcgcatccgttctgcgcccagcctgcctc

SEQ ID NO: 3987 - DNA, 419 bp, Homo sapiens
  misc_feature 1..419: note = chr13:27334304-27334723
  misc_feature 1..419: note = hyper
  source 1..419: mol_type = genomic DNA
cttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctc

SEQ ID NO: 3988 - DNA, 238 bp, Homo sapiens
  misc_feature 1..238: note = chr13:27334724-27334962
  misc_feature 1..238: note = hyper
  source 1..238: mol_type = genomic DNA
cccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcg

SEQ ID NO: 3989 - DNA, 91 bp, Homo sapiens
  misc_feature 1..91: note = chr13:28365659-28365750
  misc_feature 1..91: note = hyper
  source 1..91: mol_type = genomic DNA
gcagcggtttcccagcgcactgctggaagtgtgctccagtagacagggtgtgggcaagatgcgcgggcagacagtccgcactcgccacatg

SEQ ID NO: 3990 - DNA, 95 bp, Homo sapiens; identical to SEQ ID NO: 1093
  misc_feature 1..95: note = chr13:28366482-28366577
  misc_feature 1..95: note = hyper
  source 1..95: mol_type = genomic DNA

SEQ ID NO: 3991 - DNA, 152 bp, Homo sapiens; identical to SEQ ID NO: 1094
  misc_feature 1..152: note = chr13:28367794-28367946
  misc_feature 1..152: note = hyper
  source 1..152: mol_type = genomic DNA

SEQ ID NO: 3992 - DNA, 84 bp, Homo sapiens; identical to SEQ ID NO: 1095
  misc_feature 1..84: note = chr13:28368153-28368237
  misc_feature 1..84: note = hyper
  source 1..84: mol_type = genomic DNA

SEQ ID NO: 3993 - DNA, 77 bp, Homo sapiens; identical to SEQ ID NO: 1096
  misc_feature 1..77: note = chr13:28368994-28369071
  misc_feature 1..77: note = hyper
  source 1..77: mol_type = genomic DNA

SEQ ID NO: 3994 - DNA, 850 bp, Homo sapiens; identical to SEQ ID NO: 1097
  misc_feature 1..850: note = chr13:28369161-28370011
  misc_feature 1..850: note = hyper
  source 1..850: mol_type = genomic DNA

SEQ ID NO: 3995 - DNA, 382 bp, Homo sapiens
  misc_feature 1..382: note = chr13:28370980-28371362
  misc_feature 1..382: note = hyper
  source 1..382: mol_type = genomic DNA
gctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagtttt

SEQ ID NO: 3996 - DNA, 402 bp, Homo sapiens
  misc_feature 1..402: note = chr13:28395255-28395657
  misc_feature 1..402: note = hyper
  source 1..402: mol_type = genomic DNA
gttttcagtcaaatgcgcaaagccaggtggctcctttaacacccccagagattgtccccatgatctcctctgcgccatggggcgctgggtgctgggggcgccgtctgtatcctctgcctggtaactgcccccatcgcgccccactgcgccccagcccaggctggaaaactgggccaacagggaggcttggatggggggaaacccagcctgaggctggaaacggctagaagtgaacgggacgagtggctttgcaaaagcagccgctgcgattctctagcgccagcgcccctgcttccaggaactttacgcaagataggcgagaggggtggccgcactaaaagaaaaagaaaaattaaaaaaaaagacattccaactactttatccttgcgcagggaccccttc

SEQ ID NO: 3997 - DNA, 196 bp, Homo sapiens
  misc_feature 1..196: note = chr13:28491793-28491989
  misc_feature 1..196: note = hyper
  source 1..196: mol_type = genomic DNA
gtcccttctataggtcgcaggcagcagaaaatgctaattgtgaaagtgagaacgcgcctccatggaatacccccggcgatcccctcctcctcccccacagccgcgggtacccgggtttttgccggcgaccgcaaccggcggatttgctttctgctgagagcctcttttctttctgcagggccgagcaaaaatatta

SEQ ID NO: 3998 - DNA, 181 bp, Homo sapiens
  misc_feature 1..181: note = chr13:28492244-28492425
  misc_feature 1..181: note = hyper
  source 1..181: mol_type = genomic DNA
caagtcaaccctcggcgactcggcagattatctccaagggtcaacacgccgcggccaggcaaccccctccagcctgccctcctgatcgatgtggtcactcgcggccagggtgatagggtagagttctccgcggccgcagacaatggactcattgacgcgggcgcacagagattaggtgccc

SEQ ID NO: 3999 - DNA, 127 bp, Homo sapiens
  misc_feature 1..127: note = chr13:28492426-28492553
  misc_feature 1..127: note = hyper
  source 1..127: mol_type = genomic DNA
ggccccacggcctttcactctctgcccccaccaaaactgcaggtggcacttttccctgaagaaatcaccgaaactctccccgcccgccgccgtgcttcccttggcctgtcttcggtgacagcaaggg

SEQ ID NO: 4000 - DNA, 195 bp, Homo sapiens
  misc_feature 1..195: note = chr13:28544390-28544585
  misc_feature 1..195: note = hyper
  source 1..195: mol_type = genomic DNA
ctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcc

SEQ ID NO: 4001 - DNA, 217 bp, Homo sapiens
  misc_feature 1..217: note = chr13:28544665-28544882
  misc_feature 1..217: note = hyper
  source 1..217: mol_type = genomic DNA
cgcgtggagtgggcctgcggccgccgttcacctcctaatacaagcctttgacagcgctgccagattcgggaatgaggatcactgcggcgaggcccggcgggctgggcagcctgactcggcggctttgagcgctctcagaacccgcgggcgctcgcggcactcctggagacctgcacttgtctgttctcattgtcaagcgtttcgctcggatatttgt

SEQ ID NO: 4002 - DNA, 395 bp, Homo sapiens
  misc_feature 1..395: note = chr13:28549497-28549892
  misc_feature 1..395: note = hyper
  source 1..395: mol_type = genomic DNA
gaggaggccccattccgtatcccagttaagttacacaggtgagtgacaagcccgggtcggctcctgagttctcatccggagctgcgctctcccgtctctttactgggagcgttctcctgccggggcttggacatttccaagggaagtgaaaatccacaaagctgcccccacttcgtaagggcctgtgcctggagggtcgtcgggttacagaaattgaaatcagctctttgccttccaactcttcttggccttgccaccgcgattggttttgttttctttgtttttaacgaattggtaagtaaaatattagttgttcaccctgaaatctgccctaaccacttccgtaccccctgaagctcgctgggcgcgccctgggctgtccttccctgagcagc

SEQ ID NO: 4003 - DNA, 264 bp, Homo sapiens
  misc_feature 1..264: note = chr13:28551285-28551549
  misc_feature 1..264: note = hyper
  source 1..264: mol_type = genomic DNA
tgtggtgggctcctccgcaggatgctaatgtactttcccccagtggacagtctggctgctggtacaggaagctgcccagcctaataggggtctgaaactccagggctgacaagcaaagatttctatgggcacttccctccatttaatcgacactgcaatctcgcttcattctggggtccaaatacccagcgctgctcaatgttactattttaataactgatgggtttcccggggcagtcgagccacccccccaaagccgacctc

SEQ ID NO: 4004 - DNA, 37 bp, Homo sapiens
  misc_feature 1..37: note = chr13:28551658-28551695
  misc_feature 1..37: note = hyper
  source 1..37: mol_type = genomic DNA
cgcagggctcttcccggcccaccgcctccttcctgcg

SEQ ID NO: 4005 - DNA, 171 bp, Homo sapiens; identical to SEQ ID NO: 1098
  misc_feature 1..171: note = chr13:28674056-28674227
  misc_feature 1..171: note = hyper
  source 1..171: mol_type = genomic DNA

SEQ ID NO: 4006 - DNA, 436 bp, Homo sapiens; identical to SEQ ID NO: 1099
  misc_feature 1..436: note = chr13:28674720-28675156
  misc_feature 1..436: note = hyper
  source 1..436: mol_type = genomic DNA

SEQ ID NO: 4007 - DNA, 1213 bp, Homo sapiens; identical to SEQ ID NO: 1100
  misc_feature 1..1213: note = chr13:29067773-29068986
  misc_feature 1..1213: note = hyper
  source 1..1213: mol_type = genomic DNA

SEQ ID NO: 4008 - DNA, 182 bp, Homo sapiens; identical to SEQ ID NO: 1101
  misc_feature 1..182: note = chr13:29068993-29069175
  misc_feature 1..182: note = hyper
  source 1..182: mol_type = genomic DNA

SEQ ID NO: 4009 - DNA, 114 bp, Homo sapiens; identical to SEQ ID NO: 1102
  misc_feature 1..114: note = chr13:29106308-29106422
  misc_feature 1..114: note = hyper
  source 1..114: mol_type = genomic DNA

SEQ ID NO: 4010 - DNA, 392 bp, Homo sapiens; identical to SEQ ID NO: 1103
  misc_feature 1..392: note = chr13:29106423-29106815
  misc_feature 1..392: note = hyper
  source 1..392: mol_type = genomic DNA

SEQ ID NO: 4011 - DNA, 60 bp, Homo sapiens; identical to SEQ ID NO: 1104
  misc_feature 1..60: note = chr13:29106898-29106958
  misc_feature 1..60: note = hyper
  source 1..60: mol_type = genomic DNA

SEQ ID NO: 4012 - DNA, 212 bp, Homo sapiens
  misc_feature 1..212: note = chr13:33591219-33591431
  misc_feature 1..212: note = hyper
  source 1..212: mol_type = genomic DNA
ccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcag

SEQ ID NO: 4013 - DNA, 108 bp, Homo sapiens
  misc_feature 1..108: note = chr13:37005473-37005581
  misc_feature 1..108: note = hyper
  source 1..108: mol_type = genomic DNA
agtcacctatgcaggcgtctgagcccccgggtttccaggagccccccgtataaggaccccagggactcctctccccacgcggccgggccgcccgcccggcccccagcc

SEQ ID NO: 4014 - DNA, 164 bp, Homo sapiens
  misc_feature 1..164: note = chr13:37005899-37006063
  misc_feature 1..164: note = hyper
  source 1..164: mol_type = genomic DNA
ggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagc

SEQ ID NO: 4015 - DNA, 192 bp, Homo sapiens
  misc_feature 1..192: note = chr13:37006433-37006625
  misc_feature 1..192: note = hyper
  source 1..192: mol_type = genomic DNA
cgcatcgctaagcccggccgcctcccaggctggaatccctcgacacttggtccttcccgccccgcccttccgtgccctgcccttccctgcccttccccgccctgccccgcccggcccggcccggccctgcccaaccctgccccgccctgccccgcccagccggccacctcttaaccgcgatcctccagtgca

SEQ ID NO: 4016 - DNA, 517 bp, Homo sapiens
  misc_feature 1..517: note = chr13:43566059-43566576
  misc_feature 1..517: note = hyper
  source 1..517: mol_type = genomic DNA
agtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcgggaggcaggggaggcgccgagcccggagttcaccactctattgcgggtgttcatggttcacagcccgcgggtcccgggccgccgtcgctgcgggagggatgcggctgggacgcttagcgagtctcaagatgggattccaaagtgcagaggcagcggttttaacagctgagtttcggtttctcagaatcagcagcagactgcgcccgccccagagaacttccccacgtattctccactgaggccccgtccgaccttatcgcgggttaacagcccaggatgttgacttgagctggcttggtcggctacaggtgagacggtttaaagtctca

SEQ ID NO: 4017 - DNA, 739 bp, Homo sapiens; identical to SEQ ID NO: 1105
  misc_feature 1..739: note = chr13:44947737-44948476
  misc_feature 1..739: note = hyper
  source 1..739: mol_type = genomic DNA

SEQ ID NO: 4018 - DNA, 780 bp, Homo sapiens; identical to SEQ ID NO: 1106
  misc_feature 1..780: note = chr13:49794146-49794926
  misc_feature 1..780: note = hyper
  source 1..780: mol_type = genomic DNA

SEQ ID NO: 4019 - DNA, 336 bp, Homo sapiens; identical to SEQ ID NO: 1107
  misc_feature 1..336: note = chr13:53312978-53313314
  misc_feature 1..336: note = hyper
  source 1..336: mol_type = genomic DNA

SEQ ID NO: 4020 - DNA, 17 bp, Homo sapiens
  misc_feature 1..17: note = chr13:53313512-53313529
  misc_feature 1..17: note = hyper
  source 1..17: mol_type = genomic DNA
cgcagcacagggccttc

SEQ ID NO: 4021 - DNA, 83 bp, Homo sapiens; identical to SEQ ID NO: 1109
  misc_feature 1..83: note = chr13:53313530-53313613
  misc_feature 1..83: note = hyper
  source 1..83: mol_type = genomic DNA

SEQ ID NO: 4022 - DNA, 37 bp, Homo sapiens; identical to SEQ ID NO: 1110
  misc_feature 1..37: note = chr13:53313677-53313714
  misc_feature 1..37: note = hyper
  source 1..37: mol_type = genomic DNA

SEQ ID NO: 4023 - DNA, 592 bp, Homo sapiens; identical to SEQ ID NO: 1111
  misc_feature 1..592: note = chr13:58208334-58208926
  misc_feature 1..592: note = hyper
  source 1..592: mol_type = genomic DNA

SEQ ID NO: 4024 - DNA, 152 bp, Homo sapiens
  misc_feature 1..152: note = chr13:70681626-70681778
  misc_feature 1..152: note = hyper
  source 1..152: mol_type = genomic DNA
agaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccag

SEQ ID NO: 4025 - DNA, 205 bp, Homo sapiens
  misc_feature 1..205: note = chr13:70681866-70682071
  misc_feature 1..205: note = hyper
  source 1..205: mol_type = genomic DNA
cgcaggagtaggctggtcagcaggtgggggaggacagcggggcccgggggcggaggaagaggcgggatgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccacc

SEQ ID NO: 4026 - DNA, 86 bp, Homo sapiens
  misc_feature 1..86: note = chr13:78493110-78493196
  misc_feature 1..86: note = hyper
  source 1..86: mol_type = genomic DNA
agcgtgcgtgggaaccgcggaattaaggcacctagaggccaagggcttgtgtcaagctctgcattttgccccgcaggggaacctct

SEQ ID NO: 4027 - DNA, 37 bp, Homo sapiens; identical to SEQ ID NO: 1112
  misc_feature 1..37: note = chr13:79170347-79170384
  misc_feature 1..37: note = hyper
  source 1..37: mol_type = genomic DNA

SEQ ID NO: 4028 - DNA, 372 bp, Homo sapiens; identical to SEQ ID NO: 1113
  misc_feature 1..372: note = chr13:79170467-79170839
  misc_feature 1..372: note = hyper
  source 1..372: mol_type = genomic DNA

SEQ ID NO: 4029 - DNA, 242 bp, Homo sapiens; identical to SEQ ID NO: 1114
  misc_feature 1..242: note = chr13:79175702-79175944
  misc_feature 1..242: note = hyper
  source 1..242: mol_type = genomic DNA

SEQ ID NO: 4030 - DNA, 49 bp, Homo sapiens; identical to SEQ ID NO: 1115
  misc_feature 1..49: note = chr13:79176077-79176126
  misc_feature 1..49: note = hyper
  source 1..49: mol_type = genomic DNA

SEQ ID NO: 4031 - DNA, 145 bp, Homo sapiens; identical to SEQ ID NO: 1116
  misc_feature 1..145: note = chr13:79176276-79176421
  misc_feature 1..145: note = hyper
  source 1..145: mol_type = genomic DNA

SEQ ID NO: 4032 - DNA, 224 bp, Homo sapiens; identical to SEQ ID NO: 1117
  misc_feature 1..224: note = chr13:79176608-79176832
  misc_feature 1..224: note = hyper
  source 1..224: mol_type = genomic DNA

SEQ ID NO: 4033 - DNA, 104 bp, Homo sapiens; identical to SEQ ID NO: 1118
  misc_feature 1..104: note = chr13:79177081-79177185
  misc_feature 1..104: note = hyper
  source 1..104: mol_type = genomic DNA

SEQ ID NO: 4034 - DNA, 318 bp, Homo sapiens; identical to SEQ ID NO: 1119
  misc_feature 1..318: note = chr13:79177305-79177623
  misc_feature 1..318: note = hyper
  source 1..318: mol_type = genomic DNA

SEQ ID NO: 4035 - DNA, 175 bp, Homo sapiens; identical to SEQ ID NO: 1120
  misc_feature 1..175: note = chr13:79177885-79178060
  misc_feature 1..175: note = hyper
  source 1..175: mol_type = genomic DNA

SEQ ID NO: 4036 - DNA, 346 bp, Homo sapiens
  misc_feature 1..346: note = chr13:88323468-88323814
  misc_feature 1..346: note = hyper
  source 1..346: mol_type = genomic DNA
ctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcgga

SEQ ID NO: 4037 - DNA, 173 bp, Homo sapiens
  misc_feature 1..173: note = chr13:96296383-96296556
  misc_feature 1..173: note = hyper
  source 1..173: mol_type = genomic DNA
ccaggcgcatggcaccgccgggcagccgaaccagcagacaaaagccgagagacgcgggttccaggggaacctcggcgcccttccttggaaggcaaacaggcagtgggggcagcggcggctactccagctggatctgcagaggctcggctcgcagcctggagaggcaggagggc

SEQ ID NO: 4038 - DNA, 110 bp, Homo sapiens
  misc_feature 1..110: note = chr13:96296840-96296950
  misc_feature 1..110: note = hyper
  source 1..110: mol_type = genomic DNA
cgccgctctagggccttccagactccggaccacggacgactcaggataccccacccccctcccgccccctcccctccgcgatctccctccggcctcttccctcggtgtcc

SEQ ID NO: 4039 - DNA, 229 bp, Homo sapiens
  misc_feature 1..229: note = chr13:96296991-96297220
  misc_feature 1..229: note = hyper
  source 1..229: mol_type = genomic DNA
cgcagcgctaaaatgcgctcagccaatccggcagctggcgcagacacgtggttcgggggcgcgctccgttgctggccctggatgctaaccctaggaaggcttttcaaagagaaaccagattcgctcctacccggttgttggtctggccctcagcaagctaatttcccagaggagcttcaggtgaattatcttccaaaaagagatgcgttttaatcgcagaagtctgcag

SEQ ID NO: 4040 - DNA, 344 bp, Homo sapiens
  misc_feature 1..344: note = chr13:100608461-100608805
  misc_feature 1..344: note = hyper
  source 1..344: mol_type = genomic DNA
ggcacctcctgctcccactcccctctccgcccagccgtgggcagctgaaatggatgtgatttcacgcacttcctgcgcgcgcacacacacatgcacacatggacatacacttgcacacacgcacaacgcgcattccccctccaatgccgcccgcacacgtgcgcgagcctggacgttccccttttgtgctcgttttgcaggcccagagctcctgctgctggttttctcctttctctccttcatcgcctcttccttcgccactttccttctggaccctccgggctggctcctgcccctctgccccggtggcgctctcgcctattcctcccgggaggagccggggc

SEQ ID NO: 4041 - DNA, 103 bp, Homo sapiens
  misc_feature 1..103: note = chr13:100608838-100608941
  misc_feature 1..103: note = hyper
  source 1..103: mol_type = genomic DNA
cgagttctgggacggctgggaccaaagggctggcctccggcctgcgccctgtttgttttcctttcgccccctgaatactagattgagacgtaaagattacccg

SEQ ID NO: 4042 - DNA, 150 bp, Homo sapiens
  misc_feature 1..150: note = chr13:100630730-100630880
  misc_feature 1..150: note = hyper
  source 1..150: mol_type = genomic DNA
gaggagaactagagccgggaaagaatagccaggagcgcccaacccgtagggtctccggcgggaattaaggcgtccgccccaccgcccggccgcgcgcggcccctggaatccggcgcgagcgagcgcccagccgcgcgatccccaaacgcg

SEQ ID NO: 4043 - DNA, 51 bp, Homo sapiens; identical to SEQ ID NO: 1121
  misc_feature 1..51: note = chr13:100642150-100642201
  misc_feature 1..51: note = hyper
  source 1..51: mol_type = genomic DNA

SEQ ID NO: 4044 - DNA, 227 bp, Homo sapiens; identical to SEQ ID NO: 1122
  misc_feature 1..227: note = chr13:100649349-100649576
  misc_feature 1..227: note = hyper
  source 1..227: mol_type = genomic DNA

SEQ ID NO: 4045 - DNA, 86 bp, Homo sapiens; identical to SEQ ID NO: 1123
  misc_feature 1..86: note = chr13:100649799-100649885
  misc_feature 1..86: note = hyper
  source 1..86: mol_type = genomic DNA

SEQ ID NO: 4046 - DNA, 230 bp, Homo sapiens; identical to SEQ ID NO: 1124
  misc_feature 1..230: note = chr13:102569312-102569542
  misc_feature 1..230: note = hyper
  source 1..230: mol_type = genomic DNA

SEQ ID NO: 4047 - DNA, 307 bp, Homo sapiens
  misc_feature 1..307: note = chr13:103052521-103052828
  misc_feature 1..307: note = hyper
  source 1..307: mol_type = genomic DNA
acttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgcc

SEQ ID NO: 4048 - DNA, 380 bp, Homo sapiens
  misc_feature 1..380: note = chr13:103052829-103053209
  misc_feature 1..380: note = hyper
  source 1..380: mol_type = genomic DNA
ccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctca

SEQ ID NO: 4049 - DNA, 80 bp, Homo sapiens
  misc_feature 1..80: note = chr13:109147783-109147863
  misc_feature 1..80: note = hyper
  source 1..80: mol_type = genomic DNA
aggagtggagagaggcgcggtctcctggaacgcgcgggggaacgtggaaaggagggcgcgggagacccggagggctgccc

SEQ ID NO: 4050 - DNA, 115 bp, Homo sapiens
  misc_feature 1..115: note = chr13:109148154-109148269
  misc_feature 1..115: note = hyper
  source 1..115: mol_type = genomic DNA
cgggcacaggggcaactgccgacccctctcacccgccgcgcggggctggtttccgagccgagtcccggccatcgccgcgtcgcctggcgcccggctccggcggacccttctccgg

SEQ ID NO: 4051 - DNA, 132 bp, Homo sapiens
  misc_feature 1..132: note = chr13:110959517-110959649
  misc_feature 1..132: note = hyper
  source 1..132: mol_type = genomic DNA
cgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgc

SEQ ID NO: 4052 - DNA, 275 bp, Homo sapiens
  misc_feature 1..275: note = chr13:110959752-110960027
  misc_feature 1..275: note = hyper
  source 1..275: mol_type = genomic DNA
cgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacc

SEQ ID NO: 4053 - DNA, 176 bp, Homo sapiens
  misc_feature 1..176: note = chr13:112707743-112707919
  misc_feature 1..176: note = hyper
  source 1..176: mol_type = genomic DNA
tgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttc

SEQ ID NO: 4054 - DNA, 206 bp, Homo sapiens
  misc_feature 1..206: note = chr13:112708307-112708513
  misc_feature 1..206: note = hyper
  source 1..206: mol_type = genomic DNA
cgcaggacagcctcgctgcccggggccgagttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacaccc

SEQ ID NO: 4055 - DNA, 125 bp, Homo sapiens
  misc_feature 1..125: note = chr13:112711624-112711749
  misc_feature 1..125: note = hyper
  source 1..125: mol_type = genomic DNA
tgtttctctctgggtcgccatttttggggaggggggagggaggtcgagtctgtggatttgggggagaggttcttgtccgccacagctccgcgccccctccccgcccctcgcggctcccccaccct

SEQ ID NO: 4056 - DNA, 930 bp, Homo sapiens; identical to SEQ ID NO: 1125
  misc_feature 1..930: note = chr13:112712048-112712978
  misc_feature 1..930: note = hyper
  source 1..930: mol_type = genomic DNA

SEQ ID NO: 4057 - DNA, 260 bp, Homo sapiens; identical to SEQ ID NO: 1126
  misc_feature 1..260: note = chr13:112715354-112715614
  misc_feature 1..260: note = hyper
  source 1..260: mol_type = genomic DNA

SEQ ID NO: 4058 - DNA, 417 bp, Homo sapiens; identical to SEQ ID NO: 1127
  misc_feature 1..417: note = chr13:112715936-112716353
  misc_feature 1..417: note = hyper
  source 1..417: mol_type = genomic DNA

SEQ ID NO: 4059 - DNA, 509 bp, Homo sapiens
  misc_feature 1..509: note = chr13:112720518-112721027
  misc_feature 1..509: note = hyper
  source 1..509: mol_type = genomic DNA
tactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcc

SEQ ID NO: 4060 - DNA, 93 bp, Homo sapiens
  misc_feature 1..93: note = chr13:112722128-112722221
  misc_feature 1..93: note = hyper
  source 1..93: mol_type = genomic DNA
cggcccatgaacgccttcatggtgtggtcccgcgggcagcggcgcaagatggcccaggagaaccccaagatgcacaactcggagatcagcaag

SEQ ID NO: 4061 - DNA, 38 bp, Homo sapiens
  misc_feature 1..38: note = chr13:112722274-112722312
  misc_feature 1..38: note = hyper
  source 1..38: mol_type = genomic DNA
cgacgaggccaagcggctgcgcgcgctgcacatgaagg

SEQ ID NO: 4062 - DNA, 361 bp, Homo sapiens; identical to SEQ ID NO: 1128
  misc_feature 1..361: note = chr13:112758012-112758373
  misc_feature 1..361: note = hyper
  source 1..361: mol_type = genomic DNA

SEQ ID NO: 4063 - DNA, 196 bp, Homo sapiens; identical to SEQ ID NO: 1129
  misc_feature 1..196: note = chr13:112758495-112758691
  misc_feature 1..196: note = hyper
  source 1..196: mol_type = genomic DNA

SEQ ID NO: 4064 - DNA, 205 bp, Homo sapiens
  misc_feature 1..205: note = chr13:112759202-112759407
  misc_feature 1..205: note = hyper
  source 1..205: mol_type = genomic DNA
gaaagaaaagggtagcgcctcgcggagcgcgcgggggaagagggactgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcggg

SEQ ID NO: 4065 - DNA, 348 bp, Homo sapiens; identical to SEQ ID NO: 1130
  misc_feature 1..348: note = chr13:112760850-112761198
  misc_feature 1..348: note = hyper
  source 1..348: mol_type = genomic DNA

SEQ ID NO: 4066 - DNA, 323 bp, Homo sapiens; identical to SEQ ID NO: 1131
  misc_feature 1..323: note = chr14:24803594-24803917
  misc_feature 1..323: note = hyper
  source 1..323: mol_type = genomic DNA

SEQ ID NO: 4067 - DNA, 205 bp, Homo sapiens; identical to SEQ ID NO: 1132
  misc_feature 1..205: note = chr14:24803918-24804123
  misc_feature 1..205: note = hyper
  source 1..205: mol_type = genomic DNA

SEQ ID NO: 4068 - DNA, 23 bp, Homo sapiens
  misc_feature 1..23: note = chr14:24804424-24804447
  misc_feature 1..23: note = hyper
  source 1..23: mol_type = genomic DNA
cgcctccccgcttcagccccttc

SEQ ID NO: 4069 - DNA, 223 bp, Homo sapiens
  misc_feature 1..223: note = chr14:26674354-26674577
  misc_feature 1..223: note = hyper
  source 1..223: mol_type = genomic DNA
ggtttgcctaggactcgagttcctttcaaaggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatg

SEQ ID NO: 4070 - DNA, 82 bp, Homo sapiens
  misc_feature 1..82: note = chr14:29226033-29226115
  misc_feature 1..82: note = hyper
  source 1..82: mol_type = genomic DNA
gagatctcagatcttcgcgtttggggtggggagtgggggcgctggggaaaagtcgggaatagccccgcggtacctggggatc

SEQ ID NO: 4071 - DNA, 356 bp, Homo sapiens
  misc_feature 1..356: note = chr14:29228628-29228984
  misc_feature 1..356: note = hyper
  source 1..356: mol_type = genomic DNA
agaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgtta

SEQ ID NO: 4072 - DNA, 439 bp, Homo sapiens; identical to SEQ ID NO: 1134
  misc_feature 1..439: note = chr14:29234853-29235292
  misc_feature 1..439: note = hyper
  source 1..439: mol_type = genomic DNA

SEQ ID NO: 4073 - DNA, 15 bp, Homo sapiens
  misc_feature 1..15: note = chr14:29254425-29254440
  misc_feature 1..15: note = hyper
  source 1..15: mol_type = genomic DNA
ggcgcccgcagaagc

SEQ ID NO: 4074 - DNA, 32 bp, Homo sapiens
  misc_feature 1..32: note = chr14:29254611-29254643
  misc_feature 1..32: note = hyper
  source 1..32: mol_type = genomic DNA
cgcgtccgccgggaccccgtccctctttcccc

SEQ ID NO: 4075 - DNA, 655 bp, Homo sapiens
  misc_feature 1..655: note = chr14:36004080-36004735
  misc_feature 1..655: note = hyper
  source 1..655: mol_type = genomic DNA
cgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagatttt

SEQ ID NO: 4076 - DNA, 101 bp, Homo sapiens
  misc_feature 1..101: note = chr14:36004821-36004922
  misc_feature 1..101: note = hyper
  source 1..101: mol_type = genomic DNA
cgctagcgccgggctttggctccgaacgcggtgccccacttgccttcgcttgcccattgtgcggagcgcacttccctacagcagatatcagggagaagcac

SEQ ID NO: 4077 - DNA, 84 bp, Homo sapiens; identical to SEQ ID NO: 1135
  misc_feature 1..84: note = chr14:36973454-36973538
  misc_feature 1..84: note = hyper
  source 1..84: mol_type = genomic DNA

SEQ ID NO: 4078 - DNA, 230 bp, Homo sapiens
  misc_feature 1..230: note = chr14:36974533-36974763
  misc_feature 1..230: note = hyper
  source 1..230: mol_type = genomic DNA
tagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctgg

SEQ ID NO: 4079 - DNA, 427 bp, Homo sapiens
  misc_feature 1..427: note = chr14:36977503-36977930
  misc_feature 1..427: note = hyper
  source 1..427: mol_type = genomic DNA
ggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggccgagagcgaggctgccggctgggtgttgggagagaggccgcgggtggacggggtaaggactgggactggggagactgagagctggggggtgcggggaggatgaggctgcggacaggaaacgaagggcctgggacagctgcttctcttggtcctagaaaccaaactttcgtagcgagagaccctaagacagctcgagatttcaagtgtccacacttctagtttagacatttggcaaccaattcggaacagccgggccgcgaggggcccccaggtctttggcggcgt

SEQ ID NO: 4080 - DNA, 438 bp, Homo sapiens
  misc_feature 1..438: note = chr14:36983708-36984146
  misc_feature 1..438: note = hyper
  source 1..438: mol_type = genomic DNA
gacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagc

SEQ ID NO: 4081 - DNA, 171 bp, Homo sapiens; identical to SEQ ID NO: 1136
  misc_feature 1..171: note = chr14:36986301-36986472
  misc_feature 1..171: note = hyper
  source 1..171: mol_type = genomic DNA

SEQ ID NO: 4082 - DNA, 249 bp, Homo sapiens; identical to SEQ ID NO: 1137
  misc_feature 1..249: note = chr14:36987301-36987550
  misc_feature 1..249: note = hyper
  source 1..249: mol_type = genomic DNA

SEQ ID NO: 4083 - DNA, 172 bp, Homo sapiens
  misc_feature 1..172: note = chr14:36987960-36988132
  misc_feature 1..172: note = hyper
  source 1..172: mol_type = genomic DNA
gtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggc

SEQ ID NO: 4084 - DNA, 175 bp, Homo sapiens; identical to SEQ ID NO: 1138
  misc_feature 1..175: note = chr14:36990858-36991033
  misc_feature 1..175: note = hyper
  source 1..175: mol_type = genomic DNA

SEQ ID NO: 4085 - DNA, 92 bp, Homo sapiens; identical to SEQ ID NO: 1139
  misc_feature 1..92: note = chr14:36991094-36991186
  misc_feature 1..92: note = hyper
  source 1..92: mol_type = genomic DNA

SEQ ID NO: 4086 - DNA, 178 bp, Homo sapiens; identical to SEQ ID NO: 1140
  misc_feature 1..178: note = chr14:36991600-36991778
  misc_feature 1..178: note = hyper
  source 1..178: mol_type = genomic DNA

SEQ ID NO: 4087 - DNA, 37 bp, Homo sapiens; identical to SEQ ID NO: 1141
  misc_feature 1..37: note = chr14:36991988-36992025
  misc_feature 1..37: note = hyper
  source 1..37: mol_type = genomic DNA

SEQ ID NO: 4088 - DNA, 141 bp, Homo sapiens
  misc_feature 1..141: note = chr14:36993815-36993956
  misc_feature 1..141: note = hyper
  source 1..141: mol_type = genomic DNA
aagcttttctcaattcgtggcctgtgggcaggctggggggtggggcgccaagtcatccgagcgcggcttctgcttctccctttccctcacaggcatgctctacggagggtatgggaggcgagggcgcgtctatgagggcca

SEQ ID NO: 4089 - DNA, 643 bp, Homo sapiens
  misc_feature 1..643: note = chr14:36994366-36995009
  misc_feature 1..643: note = hyper
  source 1..643: mol_type = genomic DNA
gggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccac

SEQ ID NO: 4090 - DNA, 40 bp, Homo sapiens
  misc_feature 1..40: note = chr14:36995010-36995050
  misc_feature 1..40: note = hyper
  source 1..40: mol_type = genomic DNA
cattcgctcattctaactgtccgcccgaccatacgtcagg

SEQ ID NO: 4091 - DNA, 190 bp, Homo sapiens
  misc_feature 1..190: note = chr14:37116105-37116295
  misc_feature 1..190: note = hyper
  source 1..190: mol_type = genomic DNA
ctggagacttggggacgtgaagggggggttctgtgatcccggaaaaaaagtaacttctcttggtaggtgatactaggcagttgcgtcccggggagtccccgcctttctgcgcttcccctgacgggggcacaggggccggcgtgcgtgtgtgggtacgtagctcatcccggggagctgggatcctcttttc

SEQ ID NO: 4092 - DNA, 453 bp, Homo sapiens; identical to SEQ ID NO: 1142
  misc_feature 1..453: note = chr14:37123566-37124019
  misc_feature 1..453: note = hyper
  source 1..453: mol_type = genomic DNA

SEQ ID NO: 4093 - DNA, 91 bp, Homo sapiens; identical to SEQ ID NO: 1143
  misc_feature 1..91: note = chr14:37124481-37124572
  misc_feature 1..91: note = hyper
  source 1..91: mol_type = genomic DNA

SEQ ID NO: 4094 - DNA, 30 bp, Homo sapiens
  misc_feature 1..30: note = chr14:37124992-37125022
  misc_feature 1..30: note = hyper
  source 1..30: mol_type = genomic DNA
gcaagagaatccgcccggtagggcatagaa

SEQ ID NO: 4095 - DNA, 420 bp, Homo sapiens
  misc_feature 1..420: note = chr14:37125232-37125652
  misc_feature 1..420: note = hyper
  source 1..420: mol_type = genomic DNA
ggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactc

SEQ ID NO: 4096 - DNA, 173 bp, Homo sapiens
  misc_feature 1..173: note = chr14:37126156-37126329
  misc_feature 1..173: note = hyper
  source 1..173: mol_type = genomic DNA
gcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccg

SEQ ID NO: 4097 - DNA, 264 bp, Homo sapiens; identical to SEQ ID NO: 1144
  misc_feature 1..264: note = chr14:37132290-37132554
  misc_feature 1..264: note = hyper
  source 1..264: mol_type = genomic DNA

SEQ ID NO: 4098 - DNA, 33 bp, Homo sapiens; identical to SEQ ID NO: 1145
  misc_feature 1..33: note = chr14:37132602-37132635
  misc_feature 1..33: note = hyper
  source 1..33: mol_type = genomic DNA

SEQ ID NO: 4099 - DNA, 67 bp, Homo sapiens
  misc_feature 1..67: note = chr14:37136294-37136361
  misc_feature 1..67: note = hyper
  source 1..67: mol_type = genomic DNA
gttcggactttctctccggtggctctcggacaaacacgcttggccaatcctgcggagaggggcaccc

SEQ ID NO: 4100 - DNA, 382 bp, Homo sapiens; identical to SEQ ID NO: 1146
  misc_feature 1..382: note = chr14:38724978-38725360
  misc_feature 1..382: note = hyper
  source 1..382: mol_type = genomic DNA

SEQ ID NO: 4101 - DNA, 236 bp, Homo sapiens
  misc_feature 1..236: note = chr14:42075538-42075774
  misc_feature 1..236: note = hyper
  source 1..236: mol_type = genomic DNA
gttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgc

SEQ ID NO: 4102 - DNA, 164 bp, Homo sapiens
  misc_feature 1..164: note = chr14:42076803-42076967
  misc_feature 1..164: note = hyper
  source 1..164: mol_type = genomic DNA
gcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacct

SEQ ID NO: 4103 - DNA, 37 bp, Homo sapiens
  misc_feature 1..37: note = chr14:48144727-48144764
  misc_feature 1..37: note = hyper
  source 1..37: mol_type = genomic DNA
tagaggtgctctggccggccgcaccaattcccggagc

SEQ ID NO: 4104 - DNA, 126 bp, Homo sapiens
  misc_feature 1..126: note = chr14:48145236-48145362
  misc_feature 1..126: note = hyper
  source 1..126: mol_type = genomic DNA
cgcaggcggaccggcggccgggctgctgggctgctgggctgccggggaggaaggctgtgtgtggtcacgttgtgcgctacgtgctgagagcgcgagctgctagccgcagccgggcgacgtcaaagc

SEQ ID NO: 4105 - DNA, 197 bp, Homo sapiens
  misc_feature 1..197: note = chr14:48145469-48145666
  misc_feature 1..197: note = hyper
  source 1..197: mol_type = genomic DNA
cgaggccggcggcatctggcctccaacctcccccgccaaagcgctccctcgcctctcggggagctccgcggtggcgaatgcccgttatgtatttctgatgccgccgtctgcgtttgcacgctgaagggccagctaccaccttagacccagggtaattacatgacacgctatctcctctccgccgcccaaggtcttcc

SEQ ID NO: 4106 - DNA, 385 bp, Homo sapiens; identical to SEQ ID NO: 1147
  misc_feature 1..385: note = chr14:51560329-51560714
  misc_feature 1..385: note = hyper
  source 1..385: mol_type = genomic DNA

SEQ ID NO: 4107 - DNA, 523 bp, Homo sapiens; identical to SEQ ID NO: 1148
  misc_feature 1..523: note = chr14:51560770-51561293
  misc_feature 1..523: note = hyper
  source 1..523: mol_type = genomic DNA

SEQ ID NO: 4108 - DNA, 226 bp, Homo sapiens; identical to SEQ ID NO: 1149
  misc_feature 1..226: note = chr14:51561294-51561520
  misc_feature 1..226: note = hyper
  source 1..226: mol_type = genomic DNA

SEQ ID NO: 4109 - DNA, 379 bp, Homo sapiens; identical to SEQ ID NO: 1150
  misc_feature 1..379: note = chr14:52534648-52535027
  misc_feature 1..379: note = hyper
  source 1..379: mol_type = genomic DNA

SEQ ID NO: 4110 - DNA, 209 bp, Homo sapiens; identical to SEQ ID NO: 1151
  misc_feature 1..209: note = chr14:52535055-52535264
  misc_feature 1..209: note = hyper
  source 1..209: mol_type = genomic DNA

SEQ ID NO: 4111 - DNA, 91 bp, Homo sapiens; identical to SEQ ID NO: 1152
  misc_feature 1..91: note = chr14:52535334-52535425
  misc_feature 1..91: note = hyper
  source 1..91: mol_type = genomic DNA

SEQ ID NO: 4112 - DNA, 332 bp, Homo sapiens; identical to SEQ ID NO: 1153
  misc_feature 1..332: note = chr14:52535426-52535758
  misc_feature 1..332: note = hyper
  source 1..332: mol_type = genomic DNA

SEQ ID NO: 4113 - DNA, 214 bp, Homo sapiens; identical to SEQ ID NO: 1154
  misc_feature 1..214: note = chr14:52535759-52535973
  misc_feature 1..214: note = hyper
  source 1..214: mol_type = genomic DNA

SEQ ID NO: 4114 - DNA, 92 bp, Homo sapiens; identical to SEQ ID NO: 1155
  misc_feature 1..92: note = chr14:52535974-52536066
  misc_feature 1..92: note = hyper
  source 1..92: mol_type = genomic DNA

SEQ ID NO: 4115 - DNA, 38 bp, Homo sapiens; identical to SEQ ID NO: 1156
  misc_feature 1..38: note = chr14:52536067-52536105
  misc_feature 1..38: note = hyper
  source 1..38: mol_type = genomic DNA

SEQ ID NO: 4116 - DNA, 50 bp, Homo sapiens; identical to SEQ ID NO: 1157
  misc_feature 1..50: note = chr14:52536342-52536392
  misc_feature 1..50: note = hyper
  source 1..50: mol_type = genomic DNA

SEQ ID NO: 4117 - DNA, 332 bp, Homo sapiens
  misc_feature 1..332: note = chr14:52781525-52781857
  misc_feature 1..332: note = hyper
  source 1..332: mol_type = genomic DNA
cagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctg

SEQ ID NO: 4118 - DNA, 220 bp, Homo sapiens; identical to SEQ ID NO: 1158
  misc_feature 1..220: note = chr14:57260875-57261095
  misc_feature 1..220: note = hyper
  source 1..220: mol_type = genomic DNA

SEQ ID NO: 4119 - DNA, 234 bp, Homo sapiens; identical to SEQ ID NO: 1159
  misc_feature 1..234: note = chr14:57261174-57261408
  misc_feature 1..234: note = hyper
  source 1..234: mol_type = genomic DNA

SEQ ID NO: 4120 - DNA, 382 bp, Homo sapiens; identical to SEQ ID NO: 1160
  misc_feature 1..382: note = chr14:57261465-57261847
  misc_feature 1..382: note = hyper
  source 1..382: mol_type = genomic DNA

SEQ ID NO: 4121 - DNA, 567 bp, Homo sapiens; identical to SEQ ID NO: 1161
  misc_feature 1..567: note = chr14:57264079-57264646
  misc_feature 1..567: note = hyper
  source 1..567: mol_type = genomic DNA

SEQ ID NO: 4122 - DNA, 43 bp, Homo sapiens; identical to SEQ ID NO: 1162
  misc_feature 1..43: note = chr14:57264764-57264807
  misc_feature 1..43: note = hyper
  source 1..43: mol_type = genomic DNA

SEQ ID NO: 4123 - DNA, 93 bp, Homo sapiens; identical to SEQ ID NO: 1163
  misc_feature 1..93: note = chr14:57265147-57265240
  misc_feature 1..93: note = hyper
  source 1..93: mol_type = genomic DNA

SEQ ID NO: 4124 - DNA, 15 bp, Homo sapiens
  misc_feature 1..15: note = chr14:57270957-57270972
  misc_feature 1..15: note = hyper
  source 1..15: mol_type = genomic DNA
aagatgtctgggtac

SEQ ID NO: 4125 - DNA, 28 bp, Homo sapiens
  misc_feature 1..28: note = chr14:57271153-57271181
  misc_feature 1..28: note = hyper
  source 1..28: mol_type = genomic DNA
cgcagcagtcccccgttcctcacagccc

SEQ ID NO: 4126 - DNA, 58 bp, Homo sapiens
  misc_feature 1..58: note = chr14:57272009-57272067
  misc_feature 1..58: note = hyper
  source 1..58: mol_type = genomic DNA
agggtgttgcatccccggagggtgggcatggggaagaggggtgcgggagtgcagcagg

SEQ ID NO: 4127 - DNA, 322 bp, Homo sapiens; identical to SEQ ID NO: 1166
  misc_feature 1..322: note = chr14:57274417-57274739
  misc_feature 1..322: note = hyper
  source 1..322: mol_type = genomic DNA

SEQ ID NO: 4128 - DNA, 310 bp, Homo sapiens; identical to SEQ ID NO: 1167
  misc_feature 1..310: note = chr14:57274740-57275050
  misc_feature 1..310: note = hyper
  source 1..310: mol_type = genomic DNA

SEQ ID NO: 4129 - DNA, 17 bp, Homo sapiens
  misc_feature 1..17: note = chr14:57275210-57275227
  misc_feature 1..17: note = hyper
  source 1..17: mol_type = genomic DNA
cgcgagggagggaggaa

SEQ ID NO: 4130 - DNA, 201 bp, Homo sapiens
  misc_feature 1..201: note = chr14:57275485-57275686
  misc_feature 1..201: note = hyper
  source 1..201: mol_type = genomic DNA
agggtcggcgccgctcggccttcgctccccgcgcaccagttctatctgtgaaggaagcaaaagccaactcggtggaatcctgacaggggacttgggtttccaaaaatatgtcccgaaatcgggcatcgatttcaagagtcacttgaacgcaacaacgcgaagacttcttgggagtttgcagagcgacccgtcgcccgcgcc

SEQ ID NO: 4131 - DNA, 593 bp, Homo sapiens
  misc_feature 1..593: note = chr14:57276073-57276666
  misc_feature 1..593: note = hyper
  source 1..593: mol_type = genomic DNA
gggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctc

SEQ ID NO: 4132 - DNA, 417 bp, Homo sapiens; identical to SEQ ID NO: 1169
  misc_feature 1..417: note = chr14:57277979-57278396
  misc_feature 1..417: note = hyper
  source 1..417: mol_type = genomic DNA

SEQ ID NO: 4133 - DNA, 69 bp, Homo sapiens; identical to SEQ ID NO: 1170
  misc_feature 1..69: note = chr14:57278694-57278763
  misc_feature 1..69: note = hyper
  source 1..69: mol_type = genomic DNA

SEQ ID NO: 4134 - DNA, 728 bp, Homo sapiens; identical to SEQ ID NO: 1171
  misc_feature 1..728: note = chr14:57278837-57279565
  misc_feature 1..728: note = hyper
  source 1..728: mol_type = genomic DNA

SEQ ID NO: 4135 - DNA, 110 bp, Homo sapiens; identical to SEQ ID NO: 1172
  misc_feature 1..110: note = chr14:57283299-57283409
  misc_feature 1..110: note = hyper
  source 1..110: mol_type = genomic DNA

SEQ ID NO: 4136 - DNA, 592 bp, Homo sapiens; identical to SEQ ID NO: 1173
  misc_feature 1..592: note = chr14:57283445-57284037
  misc_feature 1..592: note = hyper
  source 1..592: mol_type = genomic DNA

SEQ ID NO: 4137 - DNA, 541 bp, Homo sapiens; identical to SEQ ID NO: 1174
  misc_feature 1..541: note = chr14:57284070-57284611
  misc_feature 1..541: note = hyper
  source 1..541: mol_type = genomic DNA

SEQ ID NO: 4138 - DNA, 330 bp, Homo sapiens
  misc_feature 1..330: note = chr14:60794473-60794803
  misc_feature 1..330: note = hyper
  source 1..330: mol_type = genomic DNA
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcggggcctgggtgcacttcgcgcctggctcggagggcgccgcctgcgggaggacctccgggagccgagctgcctccccgcaaacccggcccgggcccacgcgggctcagggcgccaggcggggtgcgccgaggtgcagctccccggccctaggcttcgctggggtgggggt

SEQ ID NO: 4139 - DNA, 225 bp, Homo sapiens; identical to SEQ ID NO: 1175
  misc_feature 1..225: note = chr14:60952195-60952420
  misc_feature 1..225: note = hyper
  source 1..225: mol_type = genomic DNA

SEQ ID NO: 4140 - DNA, 117 bp, Homo sapiens; identical to SEQ ID NO: 1176
  misc_feature 1..117: note = chr14:60952516-60952633
  misc_feature 1..117: note = hyper
  source 1..117: mol_type = genomic DNA

SEQ ID NO: 4141 - DNA, 218 bp, Homo sapiens; identical to SEQ ID NO: 1177
  misc_feature 1..218: note = chr14:60952729-60952947
  misc_feature 1..218: note = hyper
  source 1..218: mol_type = genomic DNA

SEQ ID NO: 4142 - DNA, 311 bp, Homo sapiens; identical to SEQ ID NO: 1178
  misc_feature 1..311: note = chr14:60973697-60974008
  misc_feature 1..311: note = hyper
  source 1..311: mol_type = genomic DNA

SEQ ID NO: 4143 - DNA, 441 bp, Homo sapiens; identical to SEQ ID NO: 1179
  misc_feature 1..441: note = chr14:60975448-60975889
  misc_feature 1..441: note = hyper
  source 1..441: mol_type = genomic DNA

SEQ ID NO: 4144 - DNA, 440 bp, Homo sapiens; identical to SEQ ID NO: 1180
  misc_feature 1..440: note = chr14:60976074-60976514
  misc_feature 1..440: note = hyper
  source 1..440: mol_type = genomic DNA

SEQ ID NO: 4145 - DNA, 279 bp, Homo sapiens
  misc_feature 1..279: note = chr14:60977434-60977713
  misc_feature 1..279: note = hyper
  source 1..279: mol_type = genomic DNA
ccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgc

SEQ ID NO: 4146 - DNA, 285 bp, Homo sapiens
  misc_feature 1..285: note = chr14:60977879-60978164
  misc_feature 1..285: note = hyper
  source 1..285: mol_type = genomic DNA
cgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcg

SEQ ID NO: 4147 - DNA, 567 bp, Homo sapiens
  misc_feature 1..567: note = chr14:60981226-60981793
  misc_feature 1..567: note = hyper
  source 1..567: mol_type = genomic DNA
ctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaagggg

SEQ ID NO: 4148 - DNA, 258 bp, Homo sapiens; identical to SEQ ID NO: 1181
  misc_feature 1..258: note = chr14:60982110-60982368
  misc_feature 1..258: note = hyper
  source 1..258: mol_type = genomic DNA

SEQ ID NO: 4149 - DNA, 316 bp, Homo sapiens; identical to SEQ ID NO: 1182
  misc_feature 1..316: note = chr14:61104241-61104557
  misc_feature 1..316: note = hyper
  source 1..316: mol_type = genomic DNA

SEQ ID NO: 4150 - DNA, 241 bp, Homo sapiens; identical to SEQ ID NO: 1183
  misc_feature 1..241: note = chr14:61104623-61104864
  misc_feature 1..241: note = hyper
  source 1..241: mol_type = genomic DNA

SEQ ID NO: 4151 - DNA, 154 bp, Homo sapiens
  misc_feature 1..154: note = chr14:62279322-62279476
  misc_feature 1..154: note = hyper
  source 1..154: mol_type = genomic DNA
cggccgcagggctggcggctgctgggcgcggggcggcgcggggcggcgcggcgcggcgggggcgcgcggcaggaggggctgtgcgcggcgcggcccccgagcgcaccgggcctgccgaggagcgcgcgcccggccgggctcggcgccggtttcc

SEQ ID NO: 4152 - DNA, 104 bp, Homo sapiens
  misc_feature 1..104: note = chr14:62279519-62279623
  misc_feature 1..104: note = hyper
  source 1..104: mol_type = genomic DNA
cgactgacagtgagtgcgctccggccgcggaggccaggggtggggggaggccgcggtgcccagggtgggaagttcgatttcagacgctgcctttgtgctggctc

SEQ ID NO: 4153 - DNA, 229 bp, Homo sapiens
  misc_feature 1..229: note = chr14:62279624-62279853
  misc_feature 1..229: note = hyper
  source 1..229: mol_type = genomic DNA
cggcagcagcggccgggtccctctccgctcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaa

SEQ ID NO: 4154 - DNA, 15 bp, Homo sapiens
  misc_feature 1..15: note = chr14:62279898-62279913
  misc_feature 1..15: note = hyper
  source 1..15: mol_type = genomic DNA
cgagttctgggtcgg

SEQ ID NO: 4155 - DNA, 124 bp, Homo sapiens
  misc_feature 1..124: note = chr14:63511883-63512007
  misc_feature 1..124: note = hyper
  source 1..124: mol_type = genomic DNA
ccctctcttgccccccggcatcctgggtctggagagcagcggccaggatccgcggcgggggagggggggatgcaggcaaagaaggtggaggaagaggaggaaaaggtggaagagaagattgagc

SEQ ID NO: 4156 - DNA, 646 bp, Homo sapiens
  misc_feature 1..646: note = chr14:63512063-63512709
  misc_feature 1..646: note = hyper
  source 1..646: mol_type = genomic DNA
cgacccggatgagcagctctggggaggaggaccaggcagttcatggtagtagcgctcccccggccgccgctgcccagactgtggcggtgccgcacacggggctcgggaactgcaggctccgcggggcacagtgcgcctgcgccgcccccgctgtcgctgtcccgccggtgctgatgctgaggctgctgctgaggctgctaccgcggcggccggcgcctgggcgcgggctctgcatctctccccctgctggggagcgcaagcgggaactcaagcccccaccctcccaatccccctcagctcagaccgagaccccttccccgcgccttcgtctcccggtctcctcgtccaccccctcgcgcagcgagctccgggctgaacagcgtagcccaacttctgggctgtgcgcctggtggttgctcctctccccggagatcgaggcaagcgatcgctgtccaatcgggccggtggaatgggagaagagggtgccagagagagcagtggccagtcggaggctcacatctcggcgtctcccgctcgggtcccgaatccgggctgctggcgcggacgcggctcccggggcggaggtgcgggcaggctccagctccagccccagccgaggctgagagcagggcagggactggctggg

SEQ ID NO: 4157 - DNA, 81 bp, Homo sapiens
  misc_feature 1..81: note = chr14:63512740-63512821
  misc_feature 1..81: note = hyper
  source 1..81: mol_type = genomic DNA
cgctgctaccgcccccctccgggctccggcgcctgaaaccttcctgaacactggcgctttccgcaccgcccttaccccacc

SEQ ID NO: 4158 - DNA, 73 bp, Homo sapiens
  misc_feature 1..73: note = chr14:63513035-63513108
  misc_feature 1..73: note = hyper
  source 1..73: mol_type = genomic DNA
tgaataattcacacccgagagagggggagtgaggagggcagtgttagcgatggaaaaacggtaaaggctgtgg

SEQ ID NO: 4159 - DNA, 246 bp, Homo sapiens
  misc_feature 1..246: note = chr14:70014699-70014945
  misc_feature 1..246: note = hyper
  source 1..246: mol_type = genomic DNA
acagacaaagccttgcgggctccacgggataatcaacagcgagaacgcccccagggacctccggaaagagacaccattggttgcaggcctccaggttctcgtctgcctggtgagtgaggtggcacgcagcgtcagtcgtctgcaggaatttgtgctggggtaaatgcgcgcttcgtgcagaccgcagagctggaggcggagggctggggtccctgggccgcgggcgggttccgcgtgcccctccct

SEQ ID NO: 4160 - DNA, 220 bp, Homo sapiens; identical to SEQ ID NO: 1184
  misc_feature 1..220: note = chr14:70654070-70654290
  misc_feature 1..220: note = hyper
  source 1..220: mol_type = genomic DNA

SEQ ID NO: 4161 - DNA, 306 bp, Homo sapiens; identical to SEQ ID NO: 1185
  misc_feature 1..306: note = chr14:70654291-70654597
  misc_feature 1..306: note = hyper
  source 1..306: mol_type = genomic DNA

SEQ ID NO: 4162 - DNA, 41 bp, Homo sapiens; identical to SEQ ID NO: 1186
  misc_feature 1..41: note = chr14:70654598-70654639
  misc_feature 1..41: note = hyper
  source 1..41: mol_type = genomic DNA

SEQ ID NO: 4163 - DNA, 147 bp, Homo sapiens; identical to SEQ ID NO: 1187
  misc_feature 1..147: note = chr14:70654640-70654787
  misc_feature 1..147: note = hyper
  source 1..147: mol_type = genomic DNA

SEQ ID NO: 4164 - DNA, 858 bp, Homo sapiens
  misc_feature 1..858: note = chr14:70655032-70655890
  misc_feature 1..858: note = hyper
  source 1..858: mol_type = genomic DNA
ctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcc

SEQ ID NO: 4165 - DNA, 171 bp, Homo sapiens
  misc_feature 1..171: note = chr14:70655919-70656090
  misc_feature 1..171: note = hyper
  source 1..171: mol_type = genomic DNA
cgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccggctttccccttgt

SEQ ID NO: 4166 - DNA, 547 bp, Homo sapiens
  misc_feature 1..547: note = chr14:72398686-72399233
  misc_feature 1..547: note = hyper
  source 1..547: mol_type = genomic DNA
ttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 4167 - skipped

SEQ ID NO: 4168 - DNA, 88 bp, Homo sapiens
  misc_feature 1..88: note = chr14:72399929-72400017
  misc_feature 1..88: note = hyper
  source 1..88: mol_type = genomic DNA
tttctgggtgtgaagcgcacaccgacggggacgagagcgcagaggatggcgcttttagatacttccagtcttccgatgttgtgatcgc

SEQ ID NO: 4169 - DNA, 351 bp, Homo sapiens; identical to SEQ ID NO: 1188
  misc_feature 1..351: note = chr14:74706046-74706397
  misc_feature 1..351: note = hyper
  source 1..351: mol_type = genomic DNA

SEQ ID NO: 4170 - DNA, 605 bp, Homo sapiens; identical to SEQ ID NO: 1189
  misc_feature 1..605: note = chr14:74706940-74707545
  misc_feature 1..605: note = hyper
  source 1..605: mol_type = genomic DNA

SEQ ID NO: 4171 - DNA, 176 bp, Homo sapiens; identical to SEQ ID NO: 1190
  misc_feature 1..176: note = chr14:74707572-74707748
  misc_feature 1..176: note = hyper
  source 1..176: mol_type = genomic DNA

SEQ ID NO: 4172 - DNA, 120 bp, Homo sapiens; identical to SEQ ID NO: 1191
  misc_feature 1..120: note = chr14:74707791-74707911
  misc_feature 1..120: note = hyper
  source 1..120: mol_type = genomic DNA

SEQ ID NO: 4173 - DNA, 418 bp, Homo sapiens; identical to SEQ ID NO: 1192
  misc_feature 1..418: note = chr14:74707912-74708330
  misc_feature 1..418: note = hyper
  source 1..418: mol_type = genomic DNA

SEQ ID NO: 4174 - DNA, 174 bp, Homo sapiens
  misc_feature 1..174: note = chr14:74708862-74709036
  misc_feature 1..174: note = hyper
  source 1..174: mol_type = genomic DNA
ctgcctgcctttctgcgggtgctgctcgcaggtgctgccccggcgctcacctcggagctatttccccgcaccccactccgtccccatcaggtggggccgccacagactctgcgccctttcaagacatttctccactagggcgttctctggcacccccgccgccacatcgttttc

SEQ ID NO: 4175 - DNA, 70 bp, Homo sapiens; identical to SEQ ID NO: 1193
  misc_feature 1..70: note = chr14:89817946-89818016
  misc_feature 1..70: note = hyper
  source 1..70: mol_type = genomic DNA

SEQ ID NO: 4176 - DNA, 487 bp, Homo sapiens
  misc_feature 1..487: note = chr14:90084100-90084587
  misc_feature 1..487: note = hyper
  source 1..487: mol_type = genomic DNA
aacataaaggtatctcgagcaaactgcacccaaatgaaaaaccgaccctgcagaaatctgtgcacaagagggctatctgaaactacagcacgattttaaaagaaggttttgggtgactgttttcataagtctcaatctaactgaccaatcagtgtgagagttaaagtgggctccagtcattcgtgcagccttcagagctctgcaccctccgagctgctctcctctccaaggcagagtcggcgatcaatgaaaaacagggaacaaaaggaatataacaggatgtcttccttagctaaggaaaacgattccctttttcctcaatgagccagtcgcaccctgcctacgacagctccacacgggagcttccagcagaccagtcctttcgggtgaggcacattttacatttgcaatcatgtgtcccaactgctagcaaatgtgtcaccttaagcacagcctgtgacggagggctccccgagcccaaccaatt

SEQ ID NO: 4177 - DNA, 358 bp, Homo sapiens
  misc_feature 1..358: note = chr14:95235025-95235383
  misc_feature 1..358: note = hyper
  source 1..358: mol_type = genomic DNA
cgcgcttcccccagtcccggggcacccggggagcttggtgtggcggcgggacaccccgcgcaggccaacaaaaggaggggagccgctcgctcccgcttccgcgttttcattcaacttcctgggcctaaagcgccctccagcagcctgcgggccgccatcgggatgtttttaaagtgcggggagagccaagcagggctgggcaaacccgactggggccccacctcgcggggaaggaccgctaggcgcccacggcaggccccggcgcctacctccactttctcctcgcggaggtgcactttccgggccagctgctcgcgcgtgcccacgtccgggtacttggtctcctggaagaggttct

SEQ ID NO: 4178 - DNA, 212 bp, Homo sapiens; identical to SEQ ID NO: 1194
  misc_feature 1..212: note = chr14:95239421-95239633
  misc_feature 1..212: note = hyper
  source 1..212: mol_type = genomic DNA

SEQ ID NO: 4179 - DNA, 132 bp, Homo sapiens
  misc_feature 1..132: note = chr14:96342892-96343024
  misc_feature 1..132: note = hyper
  source 1..132: mol_type = genomic DNA
ttgcggccgggtgggcgccccgccgctgcggtcgcggtcgccgctggtaagctgcgctctggggcttggggcaggaagcagtggggggcgctcgaagagcagggcagctacggccaccgtggccgccggacc

SEQ ID NO: 4180 - DNA, 131 bp, Homo sapiens
  misc_feature 1..131: note = chr14:97685497-97685628
  misc_feature 1..131: note = hyper
  source 1..131: mol_type = genomic DNA
taattggagaagattcggttttcttcgccatggcaggtccctttctcctgacccgcagttgcaggggctgagggtaggcgcaggtccgccctggggtcgaagccaccatcgggcctcgaggttgcccccct

SEQ ID NO: 4181 - DNA, 61 bp, Homo sapiens
  misc_feature 1..61: note = chr14:97685882-97685943
  misc_feature 1..61: note = hyper
  source 1..61: mol_type = genomic DNA
acgcggcggtctgggcgctgcaggatgcgcctggccgcggaggagacgaccagggagcggg

SEQ ID NO: 4182 - DNA, 171 bp, Homo sapiens
  misc_feature 1..171: note = chr14:101543828-101543999
  misc_feature 1..171: note = hyper
  source 1..171: mol_type = genomic DNA
gggatgcaatttccccggtgtttttcaggcccagagctattgaataaatgaagtgcgcgccggcggagtcagtaactcactgcgcggctcccggcaggcgggggcggagtgggggccgcagaaccggacgtgcctggcgaggttcagaggcgctagcggtgtggtgggtgg

SEQ ID NO: 4183 - DNA, 27 bp, Homo sapiens
  misc_feature 1..27: note = chr14:101924030-101924057
  misc_feature 1..27: note = hyper
  source 1..27: mol_type = genomic DNA
gacgccctggcccggtgtccccgacgc

SEQ ID NO: 4184 - DNA, 746 bp, Homo sapiens
  misc_feature 1..746: note = chr14:103021342-103022088
  misc_feature 1..746: note = hyper
  source 1..746: mol_type = genomic DNA
cgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagc

SEQ ID NO: 4185 - DNA, 201 bp, Homo sapiens
  misc_feature 1..201: note = chr14:103739949-103740150
  misc_feature 1..201: note = hyper
  source 1..201: mol_type = genomic DNA
ctccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagct

SEQ ID NO: 4186 - DNA, 190 bp, Homo sapiens
  misc_feature 1..190: note = chr15:23158337-23158527
  misc_feature 1..190: note = hyper
  source 1..190: mol_type = genomic DNA
cgggtcaccgcaccccgagatgtgcccccaaggctctttcgaccgccgtgaagtggcgggcccccttgaagtggccggcggctgcccggctccctcgaggcgcctccctggcgctcgcaggggcctcgcagagccggcggggatcccaccgcggctcagtgtctagggccggtcccggcagccctctctc

SEQ ID NO: 4187 - DNA, 104 bp, Homo sapiens
  misc_feature 1..104: note = chr15:26107640-26107744
  misc_feature 1..104: note = hyper
  source 1..104: mol_type = genomic DNA
gtcggcaccgggtcccgcgcagccgggccctccaccctgagtggagctgccttctaagcacccagcccctgccaatcactgtgcccaacaccaagttcccgggg

SEQ ID NO: 4188 - DNA, 482 bp, Homo sapiens
  misc_feature 1..482: note = chr15:26107845-26108327
  misc_feature 1..482: note = hyper
  source 1..482: mol_type = genomic DNA
cggctgtagtcctcccacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcccgcgccggcctcttaggttatcatcactcgcggcccggg

SEQ ID NO: 4189 - DNA, 261 bp, Homo sapiens; identical to SEQ ID NO: 1195
  misc_feature 1..261: note = chr15:28341719-28341980
  misc_feature 1..261: note = hyper
  source 1..261: mol_type = genomic DNA

SEQ ID NO: 4190 - DNA, 39 bp, Homo sapiens; identical to SEQ ID NO: 1196
  misc_feature 1..39: note = chr15:28341981-28342020
  misc_feature 1..39: note = hyper
  source 1..39: mol_type = genomic DNA

SEQ ID NO: 4191 - DNA, 15 bp, Homo sapiens
  misc_feature 1..15: note = chr15:28342521-28342536
  misc_feature 1..15: note = hyper
  source 1..15: mol_type = genomic DNA
cggccccaaggagct

SEQ ID NO: 4192 - DNA, 77 bp, Homo sapiens
  misc_feature 1..77: note = chr15:28352021-28352098
  misc_feature 1..77: note = hyper
  source 1..77: mol_type = genomic DNA
cctgtcctggtgccccgggcttccacccggcgggctggcgtgcgggggctggtcttcgccgagatcctgctgggagc

SEQ ID NO: 4193 - DNA, 22 bp, Homo sapiens
  misc_feature 1..22: note = chr15:28352099-28352121
  misc_feature 1..22: note = hyper
  source 1..22: mol_type = genomic DNA
ggctctggccccacggtgagcc

SEQ ID NO: 4194 - DNA, 270 bp, Homo sapiens
  misc_feature 1..270: note = chr15:28352152-28352422
  misc_feature 1..270: note = hyper
  source 1..270: mol_type = genomic DNA
cgcgcggggagggagagtccggcagggtcacgaggcgccggccccggggccgcttgaaacccgaagagaccccgctcgctcgcgcgcccgccggacgaatcctcgcggaggtcccggggcgcagccggcgtgagggtggggtctcatcgcaggggcgccgggagcctccccgctccgctagctcaaccaaggaccgctcagaggggctctcaccctgaacctcggcttttctaaaggaagggcagaccccagatttcccccttctcttct

SEQ ID NO: 4195 - DNA, 148 bp, Homo sapiens
  misc_feature 1..148: note = chr15:29077246-29077394
  misc_feature 1..148: note = hyper
  source 1..148: mol_type = genomic DNA
acttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaag

SEQ ID NO: 4196 - DNA, 170 bp, Homo sapiens
  misc_feature 1..170: note = chr15:29077428-29077598
  misc_feature 1..170: note = hyper
  source 1..170: mol_type = genomic DNA
cgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgt

SEQ ID NO: 4197 - DNA, 291 bp, Homo sapiens
  misc_feature 1..291: note = chr15:29130757-29131048
  misc_feature 1..291: note = hyper
  source 1..291: mol_type = genomic DNA
caaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcc

SEQ ID NO: 4198 - DNA, 99 bp, Homo sapiens
  misc_feature 1..99: note = chr15:29131532-29131631
  misc_feature 1..99: note = hyper
  source 1..99: mol_type = genomic DNA
cgagcgctccagagcgctgccctcccgactcagcgtggctgcggggcggccgccgctgggatatgggggtacagcccggcggccccactcctctctgac

SEQ ID NO: 4199 - DNA, 152 bp, Homo sapiens
  misc_feature 1..152: note = chr15:29131755-29131907
  misc_feature 1..152: note = hyper
  source 1..152: mol_type = genomic DNA
cggggctgtccgctcgactcctgccgggctggccgggctgcttggcaccggcatcaagtccccgtgccgggcggcaactactgagtttggggtcgcctctgggttcgctgcccccagagaacccaagcccagatcttcgcccccttcccttt

SEQ ID NO: 4200 - skipped

SEQ ID NO: 4201 - DNA, 155 bp, Homo sapiens
  misc_feature 1..155: note = chr15:31775483-31775638
  misc_feature 1..155: note = hyper
  source 1..155: mol_type = genomic DNA
cgcgccgcgccgctcagggccgggccccgcgcgcctcgcgccgccgccgcagctcctcgcggtagcagtaggagcagtagtgctcggtctcggcgcgcccgtagaacgcacagttctcgcgctggcagcgccgctgcaccggccccgggccgcca

SEQ ID NO: 4202 - DNA, 105 bp, Homo sapiens
  misc_feature 1..105: note = chr15:31775678-31775783
  misc_feature 1..105: note = hyper
  source 1..105: mol_type = genomic DNA
cgtcggcgaactccaggccgtcgcgcagggcgccgaagccgttggtgtaggtctgcgacttgtgctcggccgcccccgccgtccccgccgcgcccggtagggccc

SEQ ID NO: 4203 - DNA, 316 bp, Homo sapiens
  misc_feature 1..316: note = chr15:33010850-33011166
  misc_feature 1..316: note = hyper
  source 1..316: mol_type = genomic DNA
gcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccacc

SEQ ID NO: 4204 - DNA, 181 bp, Homo sapiens
  misc_feature 1..181: note = chr15:33011167-33011348
  misc_feature 1..181: note = hyper
  source 1..181: mol_type = genomic DNA
gctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccac

SEQ ID NO: 4205 - DNA, 491 bp, Homo sapiens
  misc_feature 1..491: note = chr15:33603118-33603609
  misc_feature 1..491: note = hyper
  source 1..491: mol_type = genomic DNA
ggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagc

SEQ ID NO: 4206 - DNA, 114 bp, Homo sapiens
  misc_feature 1..114: note = chr15:33603647-33603761
  misc_feature 1..114: note = hyper
  source 1..114: mol_type = genomic DNA
cgttggaagccctcgccccggggtcggccctctgacacctccatactccaccccagccccattcctcttccagggcgcccccacgcacaggggaacctccgggaaggagccagc

SEQ ID NO: 4207 - DNA, 334 bp, Homo sapiens; identical to SEQ ID NO: 1198
  misc_feature 1..334: note = chr15:34786610-34786944
  misc_feature 1..334: note = hyper
  source 1..334: mol_type = genomic DNA

SEQ ID NO: 4208 - DNA, 103 bp, Homo sapiens; identical to SEQ ID NO: 1199
  misc_feature 1..103: note = chr15:34787232-34787335
  misc_feature 1..103: note = hyper
  source 1..103: mol_type = genomic DNA

SEQ ID NO: 4209 - DNA, 291 bp, Homo sapiens; identical to SEQ ID NO: 1200
  misc_feature 1..291: note = chr15:37180507-37180798
  misc_feature 1..291: note = hyper
  source 1..291: mol_type = genomic DNA

SEQ ID NO: 4210 - DNA, 454 bp, Homo sapiens
  misc_feature 1..454: note = chr15:40211790-40212244
  misc_feature 1..454: note = hyper
  source 1..454: mol_type = genomic DNA
gaggagggggactcccgcctggatcccgctccatcctcgggccacgagaaagccctatttgaactcttctgctcccgcgtgggggctggagtccaccgtccctgcttaactacactgcagctacccgggatccttaagcttccttcaactctctgcactttgccaggcacccgaaacccacggcggctgggcggccctgctcccggctctccgagcctgtaccctcggggaggcccggtccggaggcgccccgcgggaggcttaccgagcagcgagcctatgaagatgacgacctgcacggtggtggtgaactggcggtacagctgcgcctcgccgaactccccgagcgcgctgcggttcacacccgcagcctcggcgccggacgcgttgtgcggctcgctggcatttggagagatccagctcccgttatgtcccatggcgaggctgggactcc

SEQ ID NO: 4211 - DNA, 544 bp, Homo sapiens
  misc_feature 1..544: note = chr15:41805028-41805572
  misc_feature 1..544: note = hyper
  source 1..544: mol_type = genomic DNA
gccggccgctggccccgcaggtagaaaacagccaagacccctcggtgcctgagagcaaggagcgaggcaagggtcgtcgagcccctggctgggccagaggggtctggtatggtgagcgaaagaggaaggaggcgtctaaagctcacccggagaattcagcggggaggctggctccaagatactaggcggggcgctgactttcgggtcccgggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcggccacacccgtcacccggcccagccgcgctctcagcctggaagccactacccgactccggtcgcagaagccccgcgggtgcgcgctgataggtctgccagtttctctcctcgagcgcctttcccagtgaataacttaggggccgcaatgaatttggt

SEQ ID NO: 4212 - DNA, 76 bp, Homo sapiens; identical to SEQ ID NO: 1201
  misc_feature 1..76: note = chr15:45403605-45403681
  misc_feature 1..76: note = hyper
  source 1..76: mol_type = genomic DNA

SEQ ID NO: 4213 - DNA, 202 bp, Homo sapiens; identical to SEQ ID NO: 1202
  misc_feature 1..202: note = chr15:45403798-45404000
  misc_feature 1..202: note = hyper
  source 1..202: mol_type = genomic DNA

SEQ ID NO: 4214 - DNA, 71 bp, Homo sapiens; identical to SEQ ID NO: 1203
  misc_feature 1..71: note = chr15:45479446-45479517
  misc_feature 1..71: note = hyper
  source 1..71: mol_type = genomic DNA

SEQ ID NO: 4215 - skipped

SEQ ID NO: 4216 - DNA, 438 bp, Homo sapiens; identical to SEQ ID NO: 1205
  misc_feature 1..438: note = chr15:48936775-48937213
  misc_feature 1..438: note = hyper
  source 1..438: mol_type = genomic DNA

SEQ ID NO: 4217 - DNA, 432 bp, Homo sapiens; identical to SEQ ID NO: 1206
  misc_feature 1..432: note = chr15:48937214-48937646
  misc_feature 1..432: note = hyper
  source 1..432: mol_type = genomic DNA

SEQ ID NO: 4218 - DNA, 638 bp, Homo sapiens; identical to SEQ ID NO: 1207
  misc_feature 1..638: note = chr15:48937709-48938347
  misc_feature 1..638: note = hyper
  source 1..638: mol_type = genomic DNA

SEQ ID NO: 4219 - DNA, 162 bp, Homo sapiens; identical to SEQ ID NO: 1208
  misc_feature 1..162: note = chr15:48938348-48938510
  misc_feature 1..162: note = hyper
  source 1..162: mol_type = genomic DNA

SEQ ID NO: 4220 - DNA, 342 bp, Homo sapiens
  misc_feature 1..342: note = chr15:51385864-51386206
  misc_feature 1..342: note = hyper
  source 1..342: mol_type = genomic DNA
cgggagctgtgggcacgtgaggagggcgagcgggtcctaggtgcgtagacccgtgggtggggggcggagcggaccggtggaggtgggcagagaccggcggcaagtcgacccacggctgtgggtggcttcctcctgttgctcagtatcagggagaggcgggggaggacattcattttttttcttccctaagtaagcatccacctattgctttaataactatcgattgtgaaaagccggcggggcctcttaaaggcgaagtcgggaggcgcgcgcccctgcgtctgtgttcggggaccagtccgcggggaccttctggaccttctccgccggctgcgcggcagc

SEQ ID NO: 4221 - DNA, 15 bp, Homo sapiens
  misc_feature 1..15: note = chr15:53075850-53075865
  misc_feature 1..15: note = hyper
  source 1..15: mol_type = genomic DNA
acaaaacaaaggaac

SEQ ID NO: 4222 - DNA, 1016 bp, Homo sapiens; identical to SEQ ID NO: 1210
  misc_feature 1..1016: note = chr15:53075985-53077001
  misc_feature 1..1016: note = hyper
  source 1..1016: mol_type = genomic DNA

SEQ ID NO: 4223 - DNA, 461 bp, Homo sapiens; identical to SEQ ID NO: 1211
  misc_feature 1..461: note = chr15:53077065-53077526
  misc_feature 1..461: note = hyper
  source 1..461: mol_type = genomic DNA

SEQ ID NO: 4224 - DNA, 414 bp, Homo sapiens
  misc_feature 1..414: note = chr15:53079264-53079678
  misc_feature 1..414: note = hyper
  source 1..414: mol_type = genomic DNA
ggaacctcagttgctcgcgggcagcccacgggtggagatatggtgccggtagcacaagagctagagagtggaaaaccgggggccagcgattcgctggggcgcccagcgagcctcttctcccctgactggttcccgggcgcaggctgcaggaacctgcatgaggactttgcctggggcgaacgaaggcagagctgggctggaaaacctggcagggcagagtctcagccagcgcggtgctttgggaccggtggcctgcagcgcccaaacccaaagaacgctttgggtcgcttcggggcacgaatcgcaggctggtcggcacctgccacccccagcttctcattggcaggcacgagttggaggagggggctttggcctcacgctttgattttagactgtgaaacggctcagtgcccc

SEQ ID NO: 4225 - DNA, 175 bp, Homo sapiens
  misc_feature 1..175: note = chr15:53079717-53079892
  misc_feature 1..175: note = hyper
  source 1..175: mol_type = genomic DNA
cgaattaatggagaacgatcagttaattaacaaaccctcattccggcttttaccttttctcttcgccaaggctcaggcctgggcgctgggctgagatggaggtggaggtggggggtgggggagtggggggggagggggcatggaccaggagtcaatcaacttggcaaccgccggc

SEQ ID NO: 4226 - DNA, 84 bp, Homo sapiens
  misc_feature 1..84: note = chr15:53079970-53080054
  misc_feature 1..84: note = hyper
  source 1..84: mol_type = genomic DNA
cgaatcctcctgaaatccccggtggggttcgggctgggctcagctttcttctctgcctatccgcggtctcggggagccaggcgc

SEQ ID NO: 4227 - DNA, 205 bp, Homo sapiens
  misc_feature 1..205: note = chr15:53080337-53080542
  misc_feature 1..205: note = hyper
  source 1..205: mol_type = genomic DNA
acagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcg

SEQ ID NO: 4228 - DNA, 56 bp, Homo sapiens
  misc_feature 1..56: note = chr15:53080935-53080991
  misc_feature 1..56: note = hyper
  source 1..56: mol_type = genomic DNA
gtaccttatctcccgcgcgcccagctccttggccggctcacctgctaagcggagcg

SEQ ID NO: 4229 - DNA, 243 bp, Homo sapiens
  misc_feature 1..243: note = chr15:53081054-53081297
  misc_feature 1..243: note = hyper
  source 1..243: mol_type = genomic DNA
cggatttgagtttgctccagggtttggggttgcgcagcaggtccgagagggtcccctgggagcggcagagcaccctctgcgcgaagatggcctgtgggatgctgtagcgcttgagctcggtggtgatacgctgcgccacctctttggtattgatctcttccatctgccctgaattacttccattgctgacctgcgcgccggtcaccgaagggttgggctcccgggctgtgcccaggagttgcc

SEQ ID NO: 4230 - DNA, 293 bp, Homo sapiens
  misc_feature 1..293: note = chr15:53081398-53081691
  misc_feature 1..293: note = hyper
  source 1..293: mol_type = genomic DNA
cggccgagcatggccgggtggtgggcttcgaagccgttgggggtgagcatcttgtcggtgggcatggcggcccccgggtgggcatagtgggggagcccttgctgggagttgtggatgctgcccagaccggagctggagaggggcgagaggctctggcccatgccggccacgtccttgtggtagggggtatagaggttattcatggaggccagcccgcgctcatcccgcatgagcgtgaagctaccgctcacgttgcccgccaggcgctggtggtggtgcgggtggtggtggtg

SEQ ID NO: 4231 - DNA, 15 bp, Homo sapiens
  misc_feature 1..15: note = chr15:53097554-53097569
  misc_feature 1..15: note = hyper
  source 1..15: mol_type = genomic DNA
tttttttcgctttgc

SEQ ID NO: 4232 - DNA, 59 bp, Homo sapiens
  misc_feature 1..59: note = chr15:53097777-53097836
  misc_feature 1..59: note = hyper
  source 1..59: mol_type = genomic DNA
gggggccttttggggcgccttttaccccagagctcagaaagctccgggcagcggggtgg

SEQ ID NO: 4233 - DNA, 274 bp, Homo sapiens
  misc_feature 1..274: note = chr15:53098416-53098690
  misc_feature 1..274: note = hyper
  source 1..274: mol_type = genomic DNA
gccggggcctggggccgcagtccccgcgccgctggccgcccgcagcttctggcgcccccgaaaatgaccatctgtcattcaattaaggtttcagggcagctgatgggggagccagggtcagcgaccccaggacaaaacggcctgctgcctcggataggagaagttcaaatgttaaatgcagaatattgtgccctctcccagtccggggccccacccggccgcaggtccggccagtggacagcagtagggtgaagggcaacggtcattagcactt

SEQ ID NO: 4234 - DNA, 548 bp, Homo sapiens; identical to SEQ ID NO: 1212
  misc_feature 1..548: note = chr15:60287038-60287586
  misc_feature 1..548: note = hyper
  source 1..548: mol_type = genomic DNA

SEQ ID NO: 4235 - DNA, 33 bp, Homo sapiens; identical to SEQ ID NO: 1213
  misc_feature 1..33: note = chr15:60287643-60287676
  misc_feature 1..33: note = hyper
  source 1..33: mol_type = genomic DNA

SEQ ID NO: 4236 - DNA, 189 bp, Homo sapiens
  misc_feature 1..189: note = chr15:60289310-60289499
  misc_feature 1..189: note = hyper
  source 1..189: mol_type = genomic DNA
tcagccaacagcccccgcgctgctagagcgcccaaagcagaggccggccgcgaggagggccagagtgcaccgcgggggggtttgcaccgcgctggggttggcaccgcgcgctaggacccacgaagcggcgcgctagtcccaggtgagcacgaaatgagcggaaggactctgccgcggaggggcggcgag

SEQ ID NO: 4237 - DNA, 266 bp, Homo sapiens; identical to SEQ ID NO: 1214
  misc_feature 1..266: note = chr15:60295917-60296183
  misc_feature 1..266: note = hyper
  source 1..266: mol_type = genomic DNA

SEQ ID NO: 4238 - DNA, 18 bp, Homo sapiens
  misc_feature 1..18: note = chr15:60296600-60296618
  misc_feature 1..18: note = hyper
  source 1..18: mol_type = genomic DNA
cgctgccaccatccgcgc

SEQ ID NO: 4239 - DNA, 256 bp, Homo sapiens; identical to SEQ ID NO: 1216
  misc_feature 1..256: note = chr15:60297153-60297409
  misc_feature 1..256: note = hyper
  source 1..256: mol_type = genomic DNA

SEQ ID NO: 4240 - DNA, 153 bp, Homo sapiens
  misc_feature 1..153: note = chr15:60297674-60297827
  misc_feature 1..153: note = hyper
  source 1..153: mol_type = genomic DNA
catcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgc

SEQ ID NO: 4241 - DNA, 228 bp, Homo sapiens
  misc_feature 1..228: note = chr15:60297941-60298169
  misc_feature 1..228: note = hyper
  source 1..228: mol_type = genomic DNA
cgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttc

SEQ ID NO: 4242 - DNA, 939 bp, Homo sapiens
  misc_feature 1..939: note = chr15:68115594-68116533
  misc_feature 1..939: note = hyper
  source 1..939: mol_type = genomic DNA
cggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccaggaccctcaactggggtacgctctcggctcgggcgctgtcttcactgtatgcgggccaggcatagttgccgatttcgagaaaccgagaagctgtcatttcccagcgctgcgcgccctccagccacctccaggagggcgcgaggcttgtcagccggggagttaggaca

SEQ ID NO: 4243 - DNA, 326 bp, Homo sapiens
  misc_feature 1..326: note = chr15:68117665-68117991
  misc_feature 1..326: note = hyper
  source 1..326: mol_type = genomic DNA
cttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcagaggggcggccgatccccgaagtccgggcttcaggacccgggccggcagcaccggctgcgagggttgccgaaggcgcacggatctgggcgctgaaaaagccaggatttggcaatggctttgctgtgtggccttgggcaagtcactctgcgtatctgggtttca

SEQ ID NO: 4244 - DNA, 809 bp, Homo sapiens; identical to SEQ ID NO: 1217
  misc_feature 1..809: note = chr15:68121149-68121958
  misc_feature 1..809: note = hyper
  source 1..809: mol_type = genomic DNA

SEQ ID NO: 4245 - DNA, 488 bp, Homo sapiens; identical to SEQ ID NO: 1218
  misc_feature 1..488: note = chr15:68125223-68125711
  misc_feature 1..488: note = hyper
  source 1..488: mol_type = genomic DNA

SEQ ID NO: 4246 - DNA, 647 bp, Homo sapiens
  misc_feature 1..647: note = chr15:68127766-68128413
  misc_feature 1..647: note = hyper
  source 1..647: mol_type = genomic DNA
ggctagtgggggtcccgggttgagcccttcttttatctttcctgggtctccgtttcggcctctatgaaataacacgcaggcctccgtccatgcggctcgtagaaggcgggcggcaggccccgcgccaccggccagcagctcgggaccgggagccctgggctgagggggccgggaagtttcgtggcgggttgtcttggtgggccttggacggagccggctagtaggggcgtgctctgggcctccccgaagctgtgcagacgaggagtcccgctgcgcggtacagccaggaagccagtccctagagtcctttgcgctgggggtcggagccttggagtcccaggatgttccgacggctaagaccagagcggacacaaaggagataacaatgaagagggcgccggcaaatggcgaagcatcgcctccggacaggccatctccgggcagggcccctctagggagcgggaacgtttcatatgcatgggacccaccagatccgctttccgctggaccggtggcgaaactgaggtccagagaggaagagactggagtctccaggccgcgccagggcccgcggaactgcgacggggcgggacagcgcgggtgtgggagtttgccggcccctttccccaccgcggattgcacctttg

SEQ ID NO: 4247 - DNA, 254 bp, Homo sapiens
  misc_feature 1..254: note = chr15:74658143-74658397
  misc_feature 1..254: note = hyper
  source 1..254: mol_type = genomic DNA
tggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccgggggg

SEQ ID NO: 4248 - DNA, 52 bp, Homo sapiens
  misc_feature 1..52: note = chr15:74658501-74658553
  misc_feature 1..52: note = hyper
  source 1..52: mol_type = genomic DNA
cgcggcccgggcggcggcgtgcgctgggaggaatgctgggtctgtcgctagc

SEQ ID NO: 4249 - DNA, 91 bp, Homo sapiens
  misc_feature 1..91: note = chr15:74658554-74658645
  misc_feature 1..91: note = hyper
  source 1..91: mol_type = genomic DNA
ccaaacttgaccacgctgcgaccttttcactctgtgctctgaccttcaaatctccctcccccgattttttttttttttttttttttgagac

SEQ ID NO: 4250 - DNA, 29 bp, Homo sapiens
  misc_feature 1..29: note = chr15:76627508-76627537
  misc_feature 1..29: note = hyper
  source 1..29: mol_type = genomic DNA
tcctaaaggtggaggcggagctcaaaagc

SEQ ID NO: 4251 - DNA, 251 bp, Homo sapiens; identical to SEQ ID NO: 1220
  misc_feature 1..251: note = chr15:76627575-76627826
  misc_feature 1..251: note = hyper
  source 1..251: mol_type = genomic DNA

SEQ ID NO: 4252 - DNA, 462 bp, Homo sapiens
  misc_feature 1..462: note = chr15:76628564-76629026
  misc_feature 1..462: note = hyper
  source 1..462: mol_type = genomic DNA
ccagctggacgatgacggtcacgtccaaacggatcccccttgtcctcggctctctcgtcctgagagtgggtttaatttttttttttttaatttatataagaagggagctcttaaaggagagccatctccaccctcaggtatccatcacccagctccagcgcgcctgggaaaaccgccccgaaagtccaagaggaagctcagagttgtaacggccgcggagccagctcggcggtgacgcaaggtccagtccagattgccaggcccggggcatgagagaggatccttgtaggtttcggaggtgggggggctgcactccattgttcactccgggccaatcagggttggcccacttcctcccagccaatctcccttcacccccagcctccaacccaacccaccccgcccatcagcccctggatccccatcacctcccccgcatccccggcagttctggggaagctt

SEQ ID NO: 4253 - DNA, 58 bp, Homo sapiens
  misc_feature 1..58: note = chr15:76629162-76629220
  misc_feature 1..58: note = hyper
  source 1..58: mol_type = genomic DNA
gggcgcgcgaccctcgtccttctgcccctggccgcacactttgcgcacatctcttttt

SEQ ID NO: 4254 - DNA, 281 bp, Homo sapiens; identical to SEQ ID NO: 1221
  misc_feature 1..281: note = chr15:76629814-76630095
  misc_feature 1..281: note = hyper
  source 1..281: mol_type = genomic DNA

SEQ ID NO: 4255 - DNA, 29 bp, Homo sapiens
  misc_feature 1..29: note = chr15:76630096-76630125
  misc_feature 1..29: note = hyper
  source 1..29: mol_type = genomic DNA
gccccgcgcccttccccggcagagaagcc

SEQ ID NO: 4256 - DNA, 244 bp, Homo sapiens; identical to SEQ ID NO: 1223
  misc_feature 1..244: note = chr15:76630519-76630763
  misc_feature 1..244: note = hyper
  source 1..244: mol_type = genomic DNA

SEQ ID NO: 4257 - DNA, 91 bp, Homo sapiens
  misc_feature 1..91: note = chr15:78912281-78912372
  misc_feature 1..91: note = hyper
  source 1..91: mol_type = genomic DNA
cctcggcaccgagggcggaaagcgctctgagctcacagccgcacgacagaccgccggcctgggccctccaggaattccctgcagccttgcc

SEQ ID NO: 4258 - DNA, 212 bp, Homo sapiens
  misc_feature 1..212: note = chr15:78912441-78912653
  misc_feature 1..212: note = hyper
  source 1..212: mol_type = genomic DNA
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggagg

SEQ ID NO: 4259 - DNA, 900 bp, Homo sapiens; identical to SEQ ID NO: 1224
  misc_feature 1..900: note = chr15:79382098-79382998
  misc_feature 1..900: note = hyper
  source 1..900: mol_type = genomic DNA

SEQ ID NO: 4260 - DNA, 258 bp, Homo sapiens; identical to SEQ ID NO: 1225
  misc_feature 1..258: note = chr15:79382999-79383257
  misc_feature 1..258: note = hyper
  source 1..258: mol_type = genomic DNA

SEQ ID NO: 4261 - DNA, 67 bp, Homo sapiens; identical to SEQ ID NO: 1226
  misc_feature 1..67: note = chr15:79383317-79383384
  misc_feature 1..67: note = hyper
  source 1..67: mol_type = genomic DNA

SEQ ID NO: 4262 - DNA, 81 bp, Homo sapiens; identical to SEQ ID NO: 1227
  misc_feature 1..81: note = chr15:79383438-79383519
  misc_feature 1..81: note = hyper
  source 1..81: mol_type = genomic DNA

SEQ ID NO: 4263 - DNA, 210 bp, Homo sapiens
  misc_feature 1..210: note = chr15:79724351-79724561
  misc_feature 1..210: note = hyper
  source 1..210: mol_type = genomic DNA
cgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggggttgagggtgaggccgcgtcccggggccgctggagcgcgggcgtcatgcgagactgtcc

SEQ ID NO: 4264 - DNA, 187 bp, Homo sapiens
  misc_feature 1..187: note = chr15:79724606-79724793
  misc_feature 1..187: note = hyper
  source 1..187: mol_type = genomic DNA
cggcgcgctggccctggccgggactgcagccaggtgggcgccgcgcgtgtgagcgccgcgcgtgtgagcgcagacctggactcgggcggcggaggcgaaagtcgctccatccgcggggtgcaaccctgggcgcggaatccgggctgccgggtgacagtgaccagctgactctggagcctaccggagg

SEQ ID NO: 4265 - DNA, 163 bp, Homo sapiens
  misc_feature 1..163: note = chr15:79724863-79725026
  misc_feature 1..163: note = hyper
  source 1..163: mol_type = genomic DNA
cgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcg

SEQ ID NO: 4266 - DNA, 75 bp, Homo sapiens
  misc_feature 1..75: note = chr15:79725422-79725497
  misc_feature 1..75: note = hyper
  source 1..75: mol_type = genomic DNA
acctgtcagaaagcacgggagctgggcctggcccgcggggagcgtaagctcgctcacacgcggtccaactcaggc

SEQ ID NO: 4267 - DNA, 180 bp, Homo sapiens
  misc_feature 1..180: note = chr15:82340007-82340187
  misc_feature 1..180: note = hyper
  source 1..180: mol_type = genomic DNA
tgccctgcctgaccccggctacaggaacgagcgctgtgggcctcggtttctcacccgtaaaatgaagaaaataatccccgcctttaccacctcgtgggtcgttcggaagattaaatgcgacagtggatgggcgcgcgcttacaaatcagtagacagttccgcaagcgcctttacttttga

SEQ ID NO: 4268 - DNA, 409 bp, Homo sapiens
  misc_feature 1..409: note = chr15:83316231-83316640
  misc_feature 1..409: note = hyper
  source 1..409: mol_type = genomic DNA
cgtgcgacggcagtgtgagaaagaaacgttccgggcgccggtgctcctttatgtccggtcagctcccgtctggacagacgctcgaggccgcctggaggccgcagtgcggctcggaggccccaccggccgcccccgcagggctgcggcgcctttaagcccaaaggccctgagtcacgaggaggctccctgcccccctcgccctccacccctccacgaggccccacgcccgcgggcacgtgaccgcgccccgcccgggactcgcccgcacggggcgggggatgggggtaccgcggcgccggacccggctgcgcgcggaccgttagctactgcggccgggacgcggccccgcccaggcgagcggcgggtggctcttaccagcgggaacgccatggggccggtgtggccctgc

SEQ ID NO: 4269 - DNA, 333 bp, Homo sapiens
  misc_feature 1..333: note = chr15:83316641-83316974
  misc_feature 1..333: note = hyper
  source 1..333: mol_type = genomic DNA
gggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaa

SEQ ID NO: 4270 - DNA, 542 bp, Homo sapiens
  misc_feature 1..542: note = chr15:83349070-83349612
  misc_feature 1..542: note = hyper
  source 1..542: mol_type = genomic DNA
gggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactg

SEQ ID NO: 4271 - DNA, 38 bp, Homo sapiens
  misc_feature 1..38: note = chr15:83349671-83349709
  misc_feature 1..38: note = hyper
  source 1..38: mol_type = genomic DNA
cgatcagcaggttacagagtttccggtagtttttgtga

SEQ ID NO: 4272 - DNA, 69 bp, Homo sapiens
  misc_feature 1..69: note = chr15:83775933-83776002
  misc_feature 1..69: note = hyper
  source 1..69: mol_type = genomic DNA
gggctcccccatagacgatcccgcgggcccttcctcctctgacaccctcggatctggttccacctttcc

SEQ ID NO: 4273 - DNA, 116 bp, Homo sapiens
  misc_feature 1..116: note = chr15:83776022-83776138
  misc_feature 1..116: note = hyper
  source 1..116: mol_type = genomic DNA
cgcctctccagctcttcgatgaccggttcccggccgtgccccgggccctccctcggagcgcgcgccgccaggggcacctgtccctgcgcgggggtgtcgccgcccctcggcgccgc

SEQ ID NO: 4274 - DNA, 112 bp, Homo sapiens
  misc_feature 1..112: note = chr15:83776157-83776269
  misc_feature 1..112: note = hyper
  source 1..112: mol_type = genomic DNA
cgtggcgcccctggcaggagcactgcaaggacgcctcccgggactgcaccgcggccctgcgcacttggggcgacggggccaggcgcgggggacggctgcgggctgggagggc

SEQ ID NO: 4275 - DNA, 37 bp, Homo sapiens
  misc_feature 1..37: note = chr15:83776270-83776307
  misc_feature 1..37: note = hyper
  source 1..37: mol_type = genomic DNA
cgcggaggagacaccgctgaggggacgccgctgaggg

SEQ ID NO: 4276 - DNA, 385 bp, Homo sapiens
  misc_feature 1..385: note = chr15:83776332-83776717
  misc_feature 1..385: note = hyper
  source 1..385: mol_type = genomic DNA
cgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgagtgagtgagccggcgcggcgggggtcgcgccgaggggcggcgggagttggctcgccgcgacgggagcctcgcaacttttccgagggggctgggaccgtccgccgcgggacagaggttcgtggccgcaggggctccccgcgcctggccagactaggggggcgccccaggggtcgcacgggccgggtcttggagc

SEQ ID NO: 4277 - DNA, 64 bp, Homo sapiens; identical to SEQ ID NO: 1228
  misc_feature 1..64: note = chr15:84115747-84115811
  misc_feature 1..64: note = hyper
  source 1..64: mol_type = genomic DNA

SEQ ID NO: 4278 - DNA, 42 bp, Homo sapiens; identical to SEQ ID NO: 1229
  misc_feature 1..42: note = chr15:84115812-84115854
  misc_feature 1..42: note = hyper
  source 1..42: mol_type = genomic DNA

SEQ ID NO: 4279 - DNA, 194 bp, Homo sapiens; identical to SEQ ID NO: 1230
  misc_feature 1..194: note = chr15:84115931-84116125
  misc_feature 1..194: note = hyper
  source 1..194: mol_type = genomic DNA

SEQ ID NO: 4280 - DNA, 42 bp, Homo sapiens; identical to SEQ ID NO: 1231
  misc_feature 1..42: note = chr15:84748578-84748620
  misc_feature 1..42: note = hyper
  source 1..42: mol_type = genomic DNA

SEQ ID NO: 4281 - DNA, 691 bp, Homo sapiens; identical to SEQ ID NO: 1232
  misc_feature 1..691: note = chr15:84748678-84749369
  misc_feature 1..691: note = hyper
  source 1..691: mol_type = genomic DNA

SEQ ID NO: 4282 - DNA, 492 bp, Homo sapiens; identical to SEQ ID NO: 1233
  misc_feature 1..492: note = chr15:88799507-88799999
  misc_feature 1..492: note = hyper
  source 1..492: mol_type = genomic DNA

SEQ ID NO: 4283 - DNA, 302 bp, Homo sapiens; identical to SEQ ID NO: 1234
  misc_feature 1..302: note = chr15:88800000-88800302
  misc_feature 1..302: note = hyper
  source 1..302: mol_type = genomic DNA

SEQ ID NO: 4284 - DNA, 555 bp, Homo sapiens; identical to SEQ ID NO: 1235
  misc_feature 1..555: note = chr15:88800412-88800967
  misc_feature 1..555: note = hyper
  source 1..555: mol_type = genomic DNA

SEQ ID NO: 4285 - DNA, 213 bp, Homo sapiens
  misc_feature 1..213: note = chr15:89149139-89149352
  misc_feature 1..213: note = hyper
  source 1..213: mol_type = genomic DNA
gcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaagggg

SEQ ID NO: 4286 - DNA, 289 bp, Homo sapiens; identical to SEQ ID NO: 1236
  misc_feature 1..289: note = chr15:89346038-89346327
  misc_feature 1..289: note = hyper
  source 1..289: mol_type = genomic DNA

SEQ ID NO: 4287 - DNA, 115 bp, Homo sapiens; identical to SEQ ID NO: 1237
  misc_feature 1..115: note = chr15:89346346-89346461
  misc_feature 1..115: note = hyper
  source 1..115: mol_type = genomic DNA

SEQ ID NO: 4288 - DNA, 383 bp, Homo sapiens; identical to SEQ ID NO: 1238
  misc_feature 1..383: note = chr15:89903431-89903814
  misc_feature 1..383: note = hyper
  source 1..383: mol_type = genomic DNA

SEQ ID NO: 4289 - DNA, 248 bp, Homo sapiens; identical to SEQ ID NO: 1239
  misc_feature 1..248: note = chr15:89922499-89922747
  misc_feature 1..248: note = hyper
  source 1..248: mol_type = genomic DNA

SEQ ID NO: 4290 - DNA, 326 bp, Homo sapiens; identical to SEQ ID NO: 1240
  misc_feature 1..326: note = chr15:89949616-89949942
  misc_feature 1..326: note = hyper
  source 1..326: mol_type = genomic DNA

SEQ ID NO: 4291 - DNA, 126 bp, Homo sapiens; identical to SEQ ID NO: 1241
  misc_feature 1..126: note = chr15:89950355-89950481
  misc_feature 1..126: note = hyper
  source 1..126: mol_type = genomic DNA

SEQ ID NO: 4292 - DNA, 15 bp, Homo sapiens
  misc_feature 1..15: note = chr15:89950722-89950737
  misc_feature 1..15: note = hyper
  source 1..15: mol_type = genomic DNA
agttagttacttagc

SEQ ID NO: 4293 - DNA, 208 bp, Homo sapiens
  misc_feature 1..208: note = chr15:89951081-89951289
  misc_feature 1..208: note = hyper
  source 1..208: mol_type = genomic DNA
ggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacaca

SEQ ID NO: 4294 - DNA, 28 bp, Homo sapiens
  misc_feature 1..28: note = chr15:89951349-89951377
  misc_feature 1..28: note = hyper
  source 1..28: mol_type = genomic DNA
gataaactcgcttttcttccggtaagtg

SEQ ID NO: 4295 - DNA, 90 bp, Homo sapiens
  misc_feature 1..90: note = chr15:89951465-89951555
  misc_feature 1..90: note = hyper
  source 1..90: mol_type = genomic DNA
cggaatgcagggccttaggaaagccctgtccggcgttccagccacaggggtcacacttgcatcaacatgcgggcacgctgccccttgggt

SEQ ID NO: 4296 - DNA, 308 bp, Homo sapiens; identical to SEQ ID NO: 1242
  misc_feature 1..308: note = chr15:89952145-89952453
  misc_feature 1..308: note = hyper
  source 1..308: mol_type = genomic DNA

SEQ ID NO: 4297 - DNA, 375 bp, Homo sapiens; identical to SEQ ID NO: 1243
  misc_feature 1..375: note = chr15:89952699-89953074
  misc_feature 1..375: note = hyper
  source 1..375: mol_type = genomic DNA

SEQ ID NO: 4298 - DNA, 35 bp, Homo sapiens
  misc_feature 1..35: note = chr15:92937700-92937735
  misc_feature 1..35: note = hyper
  source 1..35: mol_type = genomic DNA
ggggtcgagggagggcgccggggagtgtctcgggc

SEQ ID NO: 4299 - DNA, 293 bp, Homo sapiens
  misc_feature 1..293: note = chr15:92937736-92938029
  misc_feature 1..293: note = hyper
  source 1..293: mol_type = genomic DNA
ggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggct

SEQ ID NO: 4300 - DNA, 439 bp, Homo sapiens
  misc_feature 1..439: note = chr15:93632291-93632730
  misc_feature 1..439: note = hyper
  source 1..439: mol_type = genomic DNA
ggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagcaccggctgggtgggtgcggagtgcgccagcggccaagtcaagactccttgaatgctcaggttagggggcgc

SEQ ID NO: 4301 - DNA, 87 bp, Homo sapiens
  misc_feature 1..87: note = chr15:93632731-93632818
  misc_feature 1..87: note = hyper
  source 1..87: mol_type = genomic DNA
ggcggcaagtgcggcgactccccggggcgcctccaactttccgaatcgcccgcagggttgcggtggagcgcacggtgtccttcagtt

SEQ ID NO: 4302 - DNA, 221 bp, Homo sapiens
  misc_feature 1..221: note = chr15:93633045-93633266
  misc_feature 1..221: note = hyper
  source 1..221: mol_type = genomic DNA
tcgcactccctcccacggccgcggctctcccacggccgcggctcccccgcggtaaccttcggtcagggtgtgctctgccgcggttctttccagtctctgcgcttttacatgcacacgcacagattgcgagtggaatctcctgggcttttcaaaagaatgttttcaacattaagcgcatgcacacagtggcttgaacacggccacgtcgggagcagtaaatc

SEQ ID NO: 4303 - DNA, 149 bp, Homo sapiens
  misc_feature 1..149: note = chr15:100913447-100913596
  misc_feature 1..149: note = hyper
  source 1..149: mol_type = genomic DNA
ctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacaggtg

SEQ ID NO: 4304 - DNA, 214 bp, Homo sapiens
  misc_feature 1..214: note = chr16:215659-215873
  misc_feature 1..214: note = hyper
  source 1..214: mol_type = genomic DNA
agggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccgg

SEQ ID NO: 4305 - DNA, 48 bp, Homo sapiens
  misc_feature 1..48: note = chr16:215912-215960
  misc_feature 1..48: note = hyper
  source 1..48: mol_type = genomic DNA
cgataaggacgggcggggtgcccggaggctctataaggaggccagggc

SEQ ID NO: 4306 - DNA, 263 bp, Homo sapiens
  misc_feature 1..263: note = chr16:215961-216224
  misc_feature 1..263: note = hyper
  source 1..263: mol_type = genomic DNA
gcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagcccc

SEQ ID NO: 4307 - DNA, 114 bp, Homo sapiens; identical to SEQ ID NO: 1244
  misc_feature 1..114: note = chr16:2040847-2040961
  misc_feature 1..114: note = hyper
  source 1..114: mol_type = genomic DNA

SEQ ID NO: 4308 - skipped

SEQ ID NO: 4309 - DNA, 531 bp, Homo sapiens; identical to SEQ ID NO: 1246
  misc_feature 1..531: note = chr16:2040982-2041513
  misc_feature 1..531: note = hyper
  source 1..531: mol_type = genomic DNA

SEQ ID NO: 4310 - DNA, 619 bp, Homo sapiens; identical to SEQ ID NO: 1247
  misc_feature 1..619: note = chr16:2041581-2042200
  misc_feature 1..619: note = hyper
  source 1..619: mol_type = genomic DNA

SEQ ID NO: 4311 - DNA, 275 bp, Homo sapiens
  misc_feature 1..275: note = chr16:3017156-3017431
  misc_feature 1..275: note = hyper
  source 1..275: mol_type = genomic DNA
cgctgcgcctgggcactgccgcgctgctgctcaccttccgaagcgacgcgcgcggccacgcgcaaggcttcgcgctcacctaccgcggtgagcctcagctcggcgcgccctgcccgctgttcccaccccgctctccccaccccgcctcacgcccctctccgcagggctgcaggacgccgctgaggacccagaggcccccgagggctcggcccagacccccgcggcgcccctcgacggggccaacgtgagctgcagccccaggcctggggctccgc

SEQ ID NO: 4312 - DNA, 40 bp, Homo sapiens
  misc_feature 1..40: note = chr16:3220590-3220630
  misc_feature 1..40: note = hyper
  source 1..40: mol_type = genomic DNA
cggagactgagttggctgcggccaccgggtccccggacac

SEQ ID NO: 4313 - DNA, 560 bp, Homo sapiens; identical to SEQ ID NO: 1248
  misc_feature 1..560: note = chr16:3221141-3221701
  misc_feature 1..560: note = hyper
  source 1..560: mol_type = genomic DNA

SEQ ID NO: 4314 - DNA, 267 bp, Homo sapiens; identical to SEQ ID NO: 1249
  misc_feature 1..267: note = chr16:3221786-3222053
  misc_feature 1..267: note = hyper
  source 1..267: mol_type = genomic DNA

SEQ ID NO: 4315 - DNA, 15 bp, Homo sapiens
  misc_feature 1..15: note = chr16:3222113-3222128
  misc_feature 1..15: note = hyper
  source 1..15: mol_type = genomic DNA
cgagccctagaagtg

SEQ ID NO: 4316 - DNA, 376 bp, Homo sapiens; identical to SEQ ID NO: 1251
  misc_feature 1..376: note = chr16:3232641-3233017
  misc_feature 1..376: note = hyper
  source 1..376: mol_type = genomic DNA

SEQ ID NO: 4317 - DNA, 133 bp, Homo sapiens; identical to SEQ ID NO: 1252
  misc_feature 1..133: note = chr16:3233198-3233331
  misc_feature 1..133: note = hyper
  source 1..133: mol_type = genomic DNA

SEQ ID NO: 4318 - DNA, 670 bp, Homo sapiens; identical to SEQ ID NO: 1253
  misc_feature 1..670: note = chr16:3233434-3234104
  misc_feature 1..670: note = hyper
  source 1..670: mol_type = genomic DNA

SEQ ID NO: 4319 - DNA, 196 bp, Homo sapiens; identical to SEQ ID NO: 1254
  misc_feature 1..196: note = chr16:3234164-3234360
  misc_feature 1..196: note = hyper
  source 1..196: mol_type = genomic DNA

SEQ ID NO: 4320 - DNA, 164 bp, Homo sapiens; identical to SEQ ID NO: 1255
  misc_feature 1..164: note = chr16:3237900-3238064
  misc_feature 1..164: note = hyper
  source 1..164: mol_type = genomic DNA

SEQ ID NO: 4321 - DNA, 1500 bp, Homo sapiens; identical to SEQ ID NO: 1256
  misc_feature 1..1500: note = chr16:3238124-3239624
  misc_feature 1..1500: note = hyper
  source 1..1500: mol_type = genomic DNA

SEQ ID NO: 4322 - DNA, 164 bp, Homo sapiens; identical to SEQ ID NO: 1257
  misc_feature 1..164: note = chr16:3239684-3239848
  misc_feature 1..164: note = hyper
  source 1..164: mol_type = genomic DNA

SEQ ID NO: 4323 - DNA, 202 bp, Homo sapiens
  misc_feature 1..202: note = chr16:10276597-10276799
  misc_feature 1..202: note = hyper
  source 1..202: mol_type = genomic DNA
cccggtcccatgatccggccaagccctaggagctcccctccaagatccctagctccgcttcctgccccactccggacggcaactgcccggtcctctgagcgcgccggagcaccctctccgcaacccagctccgggctggtgtgtttgagggcgagtgtgtgtgtgagtgtgggagcgcgctcgcgtgtggccggggatcccc

SEQ ID NO: 4324 - DNA, 251 bp, Homo sapiens
  misc_feature 1..251: note = chr16:10276800-10277051
  misc_feature 1..251: note = hyper
  source 1..251: mol_type = genomic DNA
cggtccccggccgagagaggcgcgggcggggaaaggcagctccctccgggcccttcgctgctgggccagctccgcgccgggcgttcggctccccacttcccagcgggagtccggtgagcgcctggacaccctggttcacagcactggcaaagccgggttcccggggcgtctttctgctgcggtcgcctccgaggaagaggagaaggaaggtagcggcgccctccacaccaacttagggacttgttctcagc

SEQ ID NO: 4325 - DNA, 328 bp, Homo sapiens
  misc_feature 1..328: note = chr16:10277071-10277399
  misc_feature 1..328: note = hyper
  source 1..328: mol_type = genomic DNA
cgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagtta

SEQ ID NO: 4326 - DNA, 287 bp, Homo sapiens
  misc_feature 1..287: note = chr16:12994459-12994746
  misc_feature 1..287: note = hyper
  source 1..287: mol_type = genomic DNA
gaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctggggga

SEQ ID NO: 4327 - DNA, 143 bp, Homo sapiens; identical to SEQ ID NO: 1258
  misc_feature 1..143: note = chr16:22825327-22825470
  misc_feature 1..143: note = hyper
  source 1..143: mol_type = genomic DNA

SEQ ID NO: 4328 - DNA, 88 bp, Homo sapiens
  misc_feature 1..88: note = chr16:22825937-22826025
  misc_feature 1..88: note = hyper
  source 1..88: mol_type = genomic DNA
tatagggtcctgggccgcgcggggccacctcagccgcggagggcgcgcaggctgctcttcgccttcacgctctcgctctcctgcactt

SEQ ID NO: 4329 - DNA, 216 bp, Homo sapiens; identical to SEQ ID NO: 1259
  misc_feature 1..216: note = chr16:23846838-23847054
  misc_feature 1..216: note = hyper
  source 1..216: mol_type = genomic DNA

SEQ ID NO: 4330 - DNA, 15 bp, Homo sapiens
  misc_feature 1..15: note = chr16:23847310-23847325
  misc_feature 1..15: note = hyper
  source 1..15: mol_type = genomic DNA
cggcagcagctgggc

SEQ ID NO: 4331 - DNA, 186 bp, Homo sapiens; identical to SEQ ID NO: 1261
  misc_feature 1..186: note = chr16:23847326-23847512
  misc_feature 1..186: note = hyper
  source 1..186: mol_type = genomic DNA

SEQ ID NO: 4332 - DNA, 28 bp, Homo sapiens
  misc_feature 1..28: note = chr16:23847788-23847816
  misc_feature 1..28: note = hyper
  source 1..28: mol_type = genomic DNA
ggactcccggctccggaccctgctgccc

SEQ ID NO: 4333 - DNA, 58 bp, Homo sapiens; identical to SEQ ID NO: 1263
  misc_feature 1..58: note = chr16:23847817-23847875
  misc_feature 1..58: note = hyper
  source 1..58: mol_type = genomic DNA

SEQ ID NO: 4334 - DNA, 70 bp, Homo sapiens; identical to SEQ ID NO: 1264
  misc_feature 1..70: note = chr16:23847933-23848003
  misc_feature 1..70: note = hyper
  source 1..70: mol_type = genomic DNA

SEQ ID NO: 4335 - DNA, 68 bp, Homo sapiens; identical to SEQ ID NO: 1265
  misc_feature 1..68: note = chr16:23848004-23848072
  misc_feature 1..68: note = hyper
  source 1..68: mol_type = genomic DNA

SEQ ID NO: 4336 - DNA, 120 bp, Homo sapiens
  misc_feature 1..120: note = chr16:24267025-24267145
  misc_feature 1..120: note = hyper
  source 1..120: mol_type = genomic DNA
aggattgaagaatgccgcgttgggtgggtgctgagggagcgccagagtgcgctacgggcttcgctccccttcccctttccttaacccttcctagagcggaggaaccgggtcgtgctgcag

SEQ ID NO: 4337 - DNA, 388 bp, Homo sapiens
  misc_feature 1..388: note = chr16:24267220-24267608
  misc_feature 1..388: note = hyper
  source 1..388: mol_type = genomic DNA
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccctcacccccag

SEQ ID NO: 4338 - DNA, 971 bp, Homo sapiens
  misc_feature 1..971: note = chr16:25703152-25704123
  misc_feature 1..971: note = hyper
  source 1..971: mol_type = genomic DNA
cgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgc

SEQ ID NO: 4339 - DNA, 255 bp, Homo sapiens
  misc_feature 1..255: note = chr16:25704389-25704644
  misc_feature 1..255: note = hyper
  source 1..255: mol_type = genomic DNA
cgcgtgcacccggacgtgcgggcggtgggcgtagagccgcacttcttcgacaggaactacgaaaaggggttggagtggtacaggtaggaccctgggctccgcgggctggtggagacgcgtgggggagacgcggaggggaagccgcggctttccacgcccttcgagcatccaggcaccgtcccgagaggcccaagcccccgcgagggctctgcaaaccctggcggcgttgctcagggggatcggctgagagggctg

SEQ ID NO: 4340 - skipped

SEQ ID NO: 4341 - DNA, 259 bp, Homo sapiens
  misc_feature 1..259: note = chr16:31580480-31580739
  misc_feature 1..259: note = hyper
  source 1..259: mol_type = genomic DNA
tctttggtgtcatttcgatttataaatccatatccatttctgacgttgaaccatttgacagtgccaaggactttggtggcgagaacttttttctccgcgtcttcgctgtcggcggcggtggctaaagaggcggcggccgcggtgcccgtggctgcgggggccccgtccccacccgggtttcctgcgacgagggcggcgggcgccggggccgcggcttggggtgcaccgctgcccacccggctcttggtcgcggggtcct

SEQ ID NO: 4342 - DNA, 340 bp, Homo sapiens
  misc_feature 1..340: note = chr16:49309108-49309448
  misc_feature 1..340: note = hyper
  source 1..340: mol_type = genomic DNA
tgttctcattaagagcggatgcgcccgggctctgagcattagcgctccagtgcagcttggaaggcatgctcccagctcggctaatggtggaagcggcggccgggcagcaagcgagctggggggcaggcgcggggcccagcgcaacccagcgctgctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgca

SEQ ID NO: 4343 - DNA, 523 bp, Homo sapiens
  misc_feature 1..523: note = chr16:49311467-49311990
  misc_feature 1..523: note = hyper
  source 1..523: mol_type = genomic DNA
acagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagagg

SEQ ID NO: 4344 - DNA, 199 bp, Homo sapiens
  misc_feature 1..199: note = chr16:49312032-49312231
  misc_feature 1..199: note = hyper
  source 1..199: mol_type = genomic DNA
cgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaa

SEQ ID NO: 4345 - DNA, 347 bp, Homo sapiens
  misc_feature 1..347: note = chr16:49313363-49313710
  misc_feature 1..347: note = hyper
  source 1..347: mol_type = genomic DNA
cccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacat

SEQ ID NO: 4346 - DNA, 625 bp, Homo sapiens
  misc_feature 1..625: note = chr16:49313936-49314561
  misc_feature 1..625: note = hyper
  source 1..625: mol_type = genomic DNA
ccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtc

SEQ ID NO: 4347 - DNA, 552 bp, Homo sapiens; identical to SEQ ID NO: 1266
  misc_feature 1..552: note = chr16:49315764-49316316
  misc_feature 1..552: note = hyper
  source 1..552: mol_type = genomic DNA

SEQ ID NO: 4348 - DNA, 100 bp, Homo sapiens
  misc_feature 1..100: note = chr16:51184324-51184424
  misc_feature 1..100: note = hyper
  source 1..100: mol_type = genomic DNA
ttgtgggaagagatgcggagataaattttgcgagccagaccccgacactttccccgtccgtttgcaccgtctccggaacaactggcggccagcagcactc

SEQ ID NO: 4349 - DNA, 188 bp, Homo sapiens
  misc_feature 1..188: note = chr16:51184770-51184958
  misc_feature 1..188: note = hyper
  source 1..188: mol_type = genomic DNA
ccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaat

SEQ ID NO: 4350 - DNA, 238 bp, Homo sapiens
  misc_feature 1..238: note = chr16:51185054-51185292
  misc_feature 1..238: note = hyper
  source 1..238: mol_type = genomic DNA
cggcgcgggccggagcactcaccatctcgccgggggagcgaggccacttcggggtcggattggaaatgttgaggcttcgcttgcttcctccgcgacatgctggctcaaacatcagctggggcagaataaaaaattactaaaaaaaaatcttctcaaaattacggaaatcgagcggcggcggcggcggcggctccccccgcccgccggcccgcccgccccctccccggctccccggccc

SEQ ID NO: 4351 - DNA, 423 bp, Homo sapiens
  misc_feature 1..423: note = chr16:51185542-51185965
  misc_feature 1..423: note = hyper
  source 1..423: mol_type = genomic DNA
gggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatcaggggggagggcgtcccgtttcgtgagtgtttcttcgtttctttaagagctaccagaaagcagcccacccccacccccattaaaaaaaaaaataagcgagtggggaagagccagccccacgc

SEQ ID NO: 4352 - DNA, 200 bp, Homo sapiens
  misc_feature 1..200: note = chr16:51186025-51186225
  misc_feature 1..200: note = hyper
  source 1..200: mol_type = genomic DNA
cgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccagga

SEQ ID NO: 4353 - DNA, 176 bp, Homo sapiens
  misc_feature 1..176: note = chr16:54628691-54628867
  misc_feature 1..176: note = hyper
  source 1..176: mol_type = genomic DNA
gggagcagagttaatcgaataaactaatcttcgctgtggagattaactctcagtagctgcaggaaaccgggcaagggagaatgcaaatagcagagacctcaaggtgctggaggagttaggaatctcccctccctcactctaacgctgccgccgccgcaccccgccacctccccccc

SEQ ID NO: 4354 - DNA, 66 bp, Homo sapiens
  misc_feature 1..66: note = chr16:54967141-54967207
  misc_feature 1..66: note = hyper
  source 1..66: mol_type = genomic DNA
ccggcgggccctccccggctgggccagcggcggcgcggctggcggaggacccggcccctcactacc

SEQ ID NO: 4355 - DNA, 87 bp, Homo sapiens; identical to SEQ ID NO: 1267
  misc_feature 1..87: note = chr16:55363136-55363223
  misc_feature 1..87: note = hyper
  source 1..87: mol_type = genomic DNA

SEQ ID NO: 4356 - DNA, 225 bp, Homo sapiens
  misc_feature 1..225: note = chr16:56224557-56224782
  misc_feature 1..225: note = hyper
  source 1..225: mol_type = genomic DNA
ggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgc

SEQ ID NO: 4357 - DNA, 10 bp, Homo sapiens
  misc_feature 1..10: note = chr16:56224783-56224793
  misc_feature 1..10: note = hyper
  source 1..10: mol_type = genomic DNA
ggtttattcc

SEQ ID NO: 4358 - DNA, 39 bp, Homo sapiens
  misc_feature 1..39: note = chr16:56224794-56224833
  misc_feature 1..39: note = hyper
  source 1..39: mol_type = genomic DNA
acccactaccacatcgcgtttcctgaggtaacccggcct

SEQ ID NO: 4359 - DNA, 89 bp, Homo sapiens
  misc_feature 1..89: note = chr16:56224880-56224969
  misc_feature 1..89: note = hyper
  source 1..89: mol_type = genomic DNA
cgggcgacaagatggagagccggcccgagagggacagaggccgcgctggcagcgagctggggggcccacctgaccgtcctgcgggcagc

SEQ ID NO: 4360 - DNA, 610 bp, Homo sapiens; identical to SEQ ID NO: 1268
  misc_feature 1..610: note = chr16:56659128-56659738
  misc_feature 1..610: note = hyper
  source 1..610: mol_type = genomic DNA

SEQ ID NO: 4361 - DNA, 30 bp, Homo sapiens; identical to SEQ ID NO: 1269
  misc_feature 1..30: note = chr16:56672513-56672543
  misc_feature 1..30: note = hyper
  source 1..30: mol_type = genomic DNA

SEQ ID NO: 4362 - DNA, 317 bp, Homo sapiens
  misc_feature 1..317: note = chr16:58018579-58018896
  misc_feature 1..317: note = hyper
  source 1..317: mol_type = genomic DNA
acgagggaaagctggcgcccatcgcgccaggcatcaaccgagtggactggccctgcttcacgcgcgccatcgaggactggtcccacttcgtgtcctcggccggggagttcaagctgccttgcctgaggaagcgaggtcagtctacgggccgctgaaggaactgccgggcaggtgggccgcggggctggagcagggaacgtggactgcggacgggaacgcaggcggcgggccaggcagaaacagggcggggccgctgagatgaagctgtggcacttgcggtgggtggagccgagacgtgcgcgcggatctggaggcag

SEQ ID NO: 4363 - DNA, 271 bp, Homo sapiens
  misc_feature 1..271: note = chr16:58019164-58019435
  misc_feature 1..271: note = hyper
  source 1..271: mol_type = genomic DNA
ctggcgggtagggagcgctgcgcgcagacccgtccctgagcggggagcgggggtcctggtggggagcggcttaagccgggggttgaggggggaggagacccagagcagggcctcccagtcttcaggaccacggtctctagcaggaagccctgtgtggggcgtgggcagggcgtccgtgctcccccgactcaccgcgcccctatccctgctgcccgcctcagtactgcctcagccagaaccccagcctggaccgctacggacagaagcccct

SEQ ID NO: 4364 - DNA, 262 bp, Homo sapiens
  misc_feature 1..262: note = chr16:66461578-66461840
  misc_feature 1..262: note = hyper
  source 1..262: mol_type = genomic DNA
gaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagc

SEQ ID NO: 4365 - DNA, 245 bp, Homo sapiens
  misc_feature 1..245: note = chr16:68676360-68676605
  misc_feature 1..245: note = hyper
  source 1..245: mol_type = genomic DNA
aagtggttggcacatcgccggctgtcagcaaatgtttttgaaatgaatgaatgagtgaatgaccgacaaggggagctaaggggaaggcagcggtgcggtccgcgtcgcaggcagaagagctgactctccaatctccgctcctctctccgcccccgtccggaatgctgagtgcccgagaaggaggcggaaatgagcgcgctcaacagcccaccagccgggtgtttacttaattagggcctgcatcc

SEQ ID NO: 4366 - DNA, 15 bp, Homo sapiens
  misc_feature 1..15: note = chr16:68676841-68676856
  misc_feature 1..15: note = hyper
  source 1..15: mol_type = genomic DNA
cgtggtccaccccca

SEQ ID NO: 4367 - DNA, 110 bp, Homo sapiens; identical to SEQ ID NO: 1270
  misc_feature 1..110: note = chr16:71459979-71460089
  misc_feature 1..110: note = hyper
  source 1..110: mol_type = genomic DNA

SEQ ID NO: 4368 - DNA, 81 bp, Homo sapiens; identical to SEQ ID NO: 1271
  misc_feature 1..81: note = chr16:71460270-71460351
  misc_feature 1..81: note = hyper
  source 1..81: mol_type = genomic DNA

SEQ ID NO: 4369 - DNA, 85 bp, Homo sapiens
  misc_feature 1..85: note = chr16:77822334-77822419
  misc_feature 1..85: note = hyper
  source 1..85: mol_type = genomic DNA
ctggagttgaggcttcgttgggacaggaaagaagggtggggcgggggtgaagcgcttagggcacggctcttgtgaggattacggc

SEQ ID NO: 4370 - DNA, 688 bp, Homo sapiens
  misc_feature 1..688: note = chr16:77822420-77823108
  misc_feature 1..688: note = hyper
  source 1..688: mol_type = genomic DNA
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtc

SEQ ID NO: 4371 - DNA, 152 bp, Homo sapiens
  misc_feature 1..152: note = chr16:86320901-86321053
  misc_feature 1..152: note = hyper
  source 1..152: mol_type = genomic DNA
ccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcat

SEQ ID NO: 4372 - DNA, 46 bp, Homo sapiens
  misc_feature 1..46: note = chr16:86530947-86530993
  misc_feature 1..46: note = hyper
  source 1..46: mol_type = genomic DNA
ccgagccccgagtcccggcaacgcgccccgggtgctccggtccact

SEQ ID NO: 4373 - DNA, 273 bp, Homo sapiens
  misc_feature 1..273: note = chr16:86531016-86531289
  misc_feature 1..273: note = hyper
  source 1..273: mol_type = genomic DNA
cggccgaggtggcttcgggtggctctgaagcctcggtcttcccggctcccaggacgccccccccgcccccgcccctccattcagcctgtcatctcggccctccgccgcctccggagccccgacggaggtgctgagttgtcaacgcaaattcctagttaagccacttgttgataaaccctctaggcaaattggttccgtctttacctgcccgccccgcccccgcccccggccccagccggcgcgcccctaattgctggaggagctcgacgccgg

SEQ ID NO: 4374 - DNA, 107 bp, Homo sapiens
  misc_feature 1..107: note = chr16:86531374-86531481
  misc_feature 1..107: note = hyper
  source 1..107: mol_type = genomic DNA
cgggaggtgagacgcagcctgggacctccggcctggggttggaggcccacgcttgctggggtgggcttttggtggaggaagagcaatcatgcggagggctctgccgc

SEQ ID NO: 4375 - DNA, 93 bp, Homo sapiens
  misc_feature 1..93: note = chr16:86531527-86531620
  misc_feature 1..93: note = hyper
  source 1..93: mol_type = genomic DNA
cgttccctggttcacaaccaccccacccccacgcgcctgtgcacatgtccctcccgccgcgcagggtctccgcgggcgcgccccgccccaaat

SEQ ID NO: 4376 - DNA, 56 bp, Homo sapiens; identical to SEQ ID NO: 1272
  misc_feature 1..56: note = chr16:86544502-86544558
  misc_feature 1..56: note = hyper
  source 1..56: mol_type = genomic DNA

SEQ ID NO: 4377 - DNA, 364 bp, Homo sapiens; identical to SEQ ID NO: 1273
  misc_feature 1..364: note = chr16:86599480-86599844
  misc_feature 1..364: note = hyper
  source 1..364: mol_type = genomic DNA

SEQ ID NO: 4378 - DNA, 95 bp, Homo sapiens
  misc_feature 1..95: note = chr17:5000401-5000496
  misc_feature 1..95: note = hyper
  source 1..95: mol_type = genomic DNA
gagcagcctcagcagcgcaggtggacacagtcgtcaaccactcgctggccgcctgcgacgtgaagcacctgcgctgggcgcggcgggtaagcgcc

SEQ ID NO: 4379 - DNA, 246 bp, Homo sapiens
  misc_feature 1..246: note = chr17:6616637-6616883
  misc_feature 1..246: note = hyper
  source 1..246: mol_type = genomic DNA
cagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaac

SEQ ID NO: 4380 - DNA, 174 bp, Homo sapiens
  misc_feature 1..174: note = chr17:6616884-6617058
  misc_feature 1..174: note = hyper
  source 1..174: mol_type = genomic DNA
cttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttc

SEQ ID NO: 4381 - DNA, 48 bp, Homo sapiens; identical to SEQ ID NO: 1274
  misc_feature 1..48: note = chr17:8868620-8868668
  misc_feature 1..48: note = hyper
  source 1..48: mol_type = genomic DNA

SEQ ID NO: 4382 - DNA, 399 bp, Homo sapiens; identical to SEQ ID NO: 1275
  misc_feature 1..399: note = chr17:8868814-8869213
  misc_feature 1..399: note = hyper
  source 1..399: mol_type = genomic DNA

SEQ ID NO: 4383 - DNA, 171 bp, Homo sapiens; identical to SEQ ID NO: 1276
  misc_feature 1..171: note = chr17:8869214-8869385
  misc_feature 1..171: note = hyper
  source 1..171: mol_type = genomic DNA

SEQ ID NO: 4384 - DNA, 434 bp, Homo sapiens; identical to SEQ ID NO: 1277
  misc_feature 1..434: note = chr17:8907294-8907728
  misc_feature 1..434: note = hyper
  source 1..434: mol_type = genomic DNA

SEQ ID NO: 4385 - DNA, 22 bp, Homo sapiens
  misc_feature 1..22: note = chr17:8907776-8907798
  misc_feature 1..22: note = hyper
  source 1..22: mol_type = genomic DNA
cgggtgacggaggctttatcct

SEQ ID NO: 4386 - DNA, 15 bp, Homo sapiens
  misc_feature 1..15: note = chr17:10101095-10101110
  misc_feature 1..15: note = hyper
  source 1..15: mol_type = genomic DNA
actccggggtggaga

SEQ ID NO: 4387 - DNA, 317 bp, Homo sapiens; identical to SEQ ID NO: 1280
  misc_feature 1..317: note = chr17:10101131-10101448
  misc_feature 1..317: note = hyper
  source 1..317: mol_type = genomic DNA

SEQ ID NO: 4388 - DNA, 106 bp, Homo sapiens
  misc_feature 1..106: note = chr17:13505466-13505572
  misc_feature 1..106: note = hyper
  source 1..106: mol_type = genomic DNA
tcccccattcctccccgcggcttcgcccccttccagtggatccggtgtctgcggcggctccggggttgcctgagtgacagctaaggccggccggatctctgggggc

SEQ ID NO: 4389 - DNA, 289 bp, Homo sapiens
  misc_feature 1..289: note = chr17:29249650-29249939
  misc_feature 1..289: note = hyper
  source 1..289: mol_type = genomic DNA
ccccacctgcagctccgcgccgagccccgcggtgcgccccccgcgccctcctctcggttccttctgagtcccttcacttccacgtcgcgcagcctcagactctctccccgggccctgaactgcctccaggatcttcaccccggtcgccgcgcagcggccggtgggctaaccagaaggtgccaggctggccgcttagttcgccttaggtgggagaaggggcgccccacctgccccagtgccccgagcccagccctggtttcttcaccgcgctttccgctcagctcctctc

SEQ ID NO: 4390 - DNA, 118 bp, Homo sapiens; identical to SEQ ID NO: 1281
  misc_feature 1..118: note = chr17:31618291-31618409
  misc_feature 1..118: note = hyper
  source 1..118: mol_type = genomic DNA

SEQ ID NO: 4391 - DNA, 344 bp, Homo sapiens; identical to SEQ ID NO: 1282
  misc_feature 1..344: note = chr17:31618410-31618754
  misc_feature 1..344: note = hyper
  source 1..344: mol_type = genomic DNA

SEQ ID NO: 4392 - DNA, 383 bp, Homo sapiens
  misc_feature 1..383: note = chr17:31618954-31619337
  misc_feature 1..383: note = hyper
  source 1..383: mol_type = genomic DNA
gatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggct

SEQ ID NO: 4393 - DNA, 85 bp, Homo sapiens
  misc_feature 1..85: note = chr17:32907620-32907705
  misc_feature 1..85: note = hyper
  source 1..85: mol_type = genomic DNA
cttggaggaagaaagcggcgctatccatgtgcggttactaccgaaaccgaggaaactggggattgcgttggaagtcggcaccctc

SEQ ID NO: 4394 - DNA, 99 bp, Homo sapiens
  misc_feature 1..99: note = chr17:32907706-32907805
  misc_feature 1..99: note = hyper
  source 1..99: mol_type = genomic DNA
agtgagttcggattcgagctgggccgtgaggccgggagattcagcactgggctctaggtagcccccgggacgcccgcggccaccgggctccggactgca

SEQ ID NO: 4395 - DNA, 274 bp, Homo sapiens
  misc_feature 1..274: note = chr17:32907873-32908147
  misc_feature 1..274: note = hyper
  source 1..274: mol_type = genomic DNA
cgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccctgctctgcctctcag

SEQ ID NO: 4396 - DNA, 204 bp, Homo sapiens
  misc_feature 1..204: note = chr17:32908170-32908374
  misc_feature 1..204: note = hyper
  source 1..204: mol_type = genomic DNA
cgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtg

SEQ ID NO: 4397 - DNA, 349 bp, Homo sapiens
  misc_feature 1..349: note = chr17:32908582-32908931
  misc_feature 1..349: note = hyper
  source 1..349: mol_type = genomic DNA
gcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcggg

SEQ ID NO: 4398 - DNA, 475 bp, Homo sapiens
  misc_feature 1..475: note = chr17:35294006-35294481
  misc_feature 1..475: note = hyper
  source 1..475: mol_type = genomic DNA
gaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgc

SEQ ID NO: 4399 - skipped

SEQ ID NO: 4400 - DNA, 1133 bp, Homo sapiens
  misc_feature 1..1133: note = chr17:35294492-35295625
  misc_feature 1..1133: note = hyper
  source 1..1133: mol_type = genomic DNA
cccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctc

SEQ ID NO: 4401 - DNA, 430 bp, Homo sapiens
  misc_feature 1..430: note = chr17:35296716-35297146
  misc_feature 1..430: note = hyper
  source 1..430: mol_type = genomic DNA
cgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 4402 - DNA, 90 bp, Homo sapiens
  misc_feature 1..90: note = chr17:35297147-35297237
  misc_feature 1..90: note = hyper
  source 1..90: mol_type = genomic DNA
cgcacgtttatatagagttctaattgtaattcgacttttctgaatctaatcggaaaataagtgccccgttccccccgcccacacaggtca

SEQ ID NO: 4403 - DNA, 228 bp, Homo sapiens; identical to SEQ ID NO: 1283
  misc_feature 1..228: note = chr17:35297936-35298164
  misc_feature 1..228: note = hyper
  source 1..228: mol_type = genomic DNA

SEQ ID NO: 4404 - DNA, 259 bp, Homo sapiens; identical to SEQ ID NO: 1284
  misc_feature 1..259: note = chr17:35299185-35299444
  misc_feature 1..259: note = hyper
  source 1..259: mol_type = genomic DNA

SEQ ID NO: 4405 - DNA, 89 bp, Homo sapiens; identical to SEQ ID NO: 1285
  misc_feature 1..89: note = chr17:35299600-35299689
  misc_feature 1..89: note = hyper
  source 1..89: mol_type = genomic DNA

SEQ ID NO: 4406 - DNA, 56 bp, Homo sapiens; identical to SEQ ID NO: 1286
  misc_feature 1..56: note = chr17:35299910-35299966
  misc_feature 1..56: note = hyper
  source 1..56: mol_type = genomic DNA

SEQ ID NO: 4407 - DNA, 453 bp, Homo sapiens; identical to SEQ ID NO: 1287
  misc_feature 1..453: note = chr17:35300260-35300713
  misc_feature 1..453: note = hyper
  source 1..453: mol_type = genomic DNA

SEQ ID NO: 4408 - DNA, 30 bp, Homo sapiens; identical to SEQ ID NO: 1288
  misc_feature 1..30: note = chr17:35300812-35300842
  misc_feature 1..30: note = hyper
  source 1..30: mol_type = genomic DNA

SEQ ID NO: 4409 - DNA, 210 bp, Homo sapiens; identical to SEQ ID NO: 1289
  misc_feature 1..210: note = chr17:35303325-35303535
  misc_feature 1..210: note = hyper
  source 1..210: mol_type = genomic DNA

SEQ ID NO: 4410 - DNA, 63 bp, Homo sapiens
  misc_feature 1..63: note = chr17:36103540-36103603
  misc_feature 1..63: note = hyper
  source 1..63: mol_type = genomic DNA
gccaaggctcagccccgaaatcgcggcgcttcagtgtccgaagccacgcgatgggctctgtcc

SEQ ID NO: 4411 - DNA, 334 bp, Homo sapiens
  misc_feature 1..334: note = chr17:36104217-36104551
  misc_feature 1..334: note = hyper
  source 1..334: mol_type = genomic DNA
cgcgtgggcaaacctcccggcaaagggctccacagctccagttctccccggcccagccccagccccgcggggaaaagcccttgggtctcggacgctggcctgggcctggggagaagaagcccggtgggccgcagggtcgtcccgctaagggattgggaagggtccgggtgttgggagagaagcagagcgccccccgggggacttctctggtgggaaacgggcttggcgagtgtggtcgggcgcagtgtcactcaggcccggggccggggctccaggggttcgggtgggtcccctccacctcgctctgcgcctacctgagcatccggtccacctc

SEQ ID NO: 4412 - DNA, 189 bp, Homo sapiens
  misc_feature 1..189: note = chr17:36104643-36104832
  misc_feature 1..189: note = hyper
  source 1..189: mol_type = genomic DNA
cgtcgccggacaagcggcccttggcgtggccgttggtgagagtatggaagaccggcttggtgtcgggctcggccccgctgccaggggacaggggcagcgtctccagcttcaccccgaagttcggggatggcagcaactcctccaaggcctgaaccagcacctccttggtgaccccggagctcagcaggg

SEQ ID NO: 4413 - DNA, 213 bp, Homo sapiens
  misc_feature 1..213: note = chr17:36105137-36105350
  misc_feature 1..213: note = hyper
  source 1..213: mol_type = genomic DNA
ggggagggggaaacccggagagagggagagccggaggggcagacctggagagcagaagacctgggccgggagcggggctttgccagggtccattgtactcacgctggggggctagagaccttcttttactggttctgcttatcagccaaacttcacctaacctttggacttgttaagccagtgccttgcagcctaggcgcggggcttttccac

SEQ ID NO: 4414 - DNA, 254 bp, Homo sapiens
  misc_feature 1..254: note = chr17:36105458-36105712
  misc_feature 1..254: note = hyper
  source 1..254: mol_type = genomic DNA
cgaagagtagagaccctggatgcgtcccggccgacgcaggtggtgggccaggagagcccgcagggcggaagagaaactgaccacttaggaaggggcgccgaggccacgggggaggtgaggcagcgttaggtgtggtgagcatgccctggagggactccatttatttctacctcggttactacctccaggccccagaacctccctggcctggtctggcggtttgggtttgcagaactgcccgccagagagcgtag

SEQ ID NO: 4415 - DNA, 327 bp, Homo sapiens
  misc_feature 1..327: note = chr17:37321298-37321625
  misc_feature 1..327: note = hyper
  source 1..327: mol_type = genomic DNA
gctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcc

SEQ ID NO: 4416 - DNA, 78 bp, Homo sapiens
  misc_feature 1..78: note = chr17:37321787-37321865
  misc_feature 1..78: note = hyper
  source 1..78: mol_type = genomic DNA
cgccgggacccaagaggagcaggcagggacgggggcaggggaggccgcggggcagtcgaggagcgcccatatacgacc

SEQ ID NO: 4417 - DNA, 462 bp, Homo sapiens
  misc_feature 1..462: note = chr17:37366090-37366552
  misc_feature 1..462: note = hyper
  source 1..462: mol_type = genomic DNA
cccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggcttgggggactgcggggacgaggctgacctcggatgggtactgagccctcccagacccccggcacgcccggtctcggagggcacctctgggtgggcaagatcggcctcgacggccctggcgcgcaggagcatgtccgcccctgcgcgactcaggtgcacatggaggcggaaagtgaccgcagccccaagccgtttccctccagcgtccccagacctcc

SEQ ID NO: 4418 - DNA, 423 bp, Homo sapiens; identical to SEQ ID NO: 1290
  misc_feature 1..423: note = chr17:37381007-37381430
  misc_feature 1..423: note = hyper
  source 1..423: mol_type = genomic DNA

SEQ ID NO: 4419 - DNA, 157 bp, Homo sapiens; identical to SEQ ID NO: 1291
  misc_feature 1..157: note = chr17:37381570-37381727
  misc_feature 1..157: note = hyper
  source 1..157: mol_type = genomic DNA

SEQ ID NO: 4420 - DNA, 292 bp, Homo sapiens; identical to SEQ ID NO: 1292
  misc_feature 1..292: note = chr17:37381825-37382117
  misc_feature 1..292: note = hyper
  source 1..292: mol_type = genomic DNA

SEQ ID NO: 4421 - DNA, 196 bp, Homo sapiens
  misc_feature 1..196: note = chr17:42393910-42394106
  misc_feature 1..196: note = hyper
  source 1..196: mol_type = genomic DNA
gcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctccccca

SEQ ID NO: 4422 - DNA, 466 bp, Homo sapiens; identical to SEQ ID NO: 1293
  misc_feature 1..466: note = chr17:42635294-42635760
  misc_feature 1..466: note = hyper
  source 1..466: mol_type = genomic DNA

SEQ ID NO: 4423 - DNA, 343 bp, Homo sapiens
  misc_feature 1..343: note = chr17:42733556-42733899
  misc_feature 1..343: note = hyper
  source 1..343: mol_type = genomic DNA
cacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggaggggcgggcctcacagcggggcggggcgcgcctgtgccgtgtcgcgtgccgagccgcgagccccaggcaggccaggtaacggcctctgcccccgcccctccctccccgctcggacttcccttacccgcacactggctccaggcagcgcccgggcggcggaggcggctgcggagacggcggggtgcgggctga

SEQ ID NO: 4424 - DNA, 96 bp, Homo sapiens; identical to SEQ ID NO: 1294
  misc_feature 1..96: note = chr17:43047752-43047848
  misc_feature 1..96: note = hyper
  source 1..96: mol_type = genomic DNA

SEQ ID NO: 4425 - DNA, 258 bp, Homo sapiens
  misc_feature 1..258: note = chr17:43339641-43339899
  misc_feature 1..258: note = hyper
  source 1..258: mol_type = genomic DNA
cctctccgaagacctcgggggtggggctcgcgcttccgcagcgggcctagagcgagaggcaggcggcaggtaagcctggctgtgctggacaggacttgcacccgctctgcacgccagcggctcagggctgccgcccttttcgtggtcccagggcccttccaagaaccggctaaaccaacccaagccgcgcgcacacacacttgtgcacacagggagtgtggagccagattcgataaggcaccccgtgtgccccagctc

SEQ ID NO: 4426 - DNA, 127 bp, Homo sapiens
  misc_feature 1..127: note = chr17:43974231-43974358
  misc_feature 1..127: note = hyper
  source 1..127: mol_type = genomic DNA
gtgatgaacctggtacgcacggttttctggttaattctatcgctgaaaactggtgcggggggcgcacttctgagacggaagagcatctaggagctgaatcctccacgcgggtcgcccaggttgatct

SEQ ID NO: 4427 - DNA, 569 bp, Homo sapiens
  misc_feature 1..569: note = chr17:45810772-45811341
  misc_feature 1..569: note = hyper
  source 1..569: mol_type = genomic DNA
ggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcct

SEQ ID NO: 4428 - DNA, 811 bp, Homo sapiens
  misc_feature 1..811: note = chr17:46620623-46621434
  misc_feature 1..811: note = hyper
  source 1..811: mol_type = genomic DNA
cttctggcaatggcccgggctccagcccgccggccccgcgcagcgcgcagccgggactcgacgcgcctgcgccctctaagcgaacggctaaaggccgggggtccgcgcttaaggcccccggcaccacctccggcgggtgacagcaggcttcccacgccgcccgcgaggcggaggggccgcccgggctggccgcgggttcctcggcagggtcgcagatgtcctccagggctcccgggcaggcaggctccccatccggcggctctcggtgctgcgtctgccgcttgtgcttcatgcgccggttctgaaaccagactttgacctgcctttcggtgaggtccagcaaggccgcgatctcgacgcggcgtggccggcacaggtacttattaaagtggaattccttctccagttccagcagctgcgtgttggtgtaagccgtgcgcagcctgcgcgccccgccgccaccagcctccggcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggagagcggctcccttcggcgccggaacctcagatccccctcccaagccctcccagtggacccctcaattcggaactttccaact

SEQ ID NO: 4429 - DNA, 324 bp, Homo sapiens; identical to SEQ ID NO: 1295
  misc_feature 1..324: note = chr17:46655070-46655394
  misc_feature 1..324: note = hyper
  source 1..324: mol_type = genomic DNA

SEQ ID NO: 4430 - DNA, 24 bp, Homo sapiens
  misc_feature 1..24: note = chr17:46655395-46655419
  misc_feature 1..24: note = hyper
  source 1..24: mol_type = genomic DNA
gcgcaggagcccgaggggacagac

SEQ ID NO: 4431 - DNA, 111 bp, Homo sapiens; identical to SEQ ID NO: 1297
  misc_feature 1..111: note = chr17:46655450-46655561
  misc_feature 1..111: note = hyper
  source 1..111: mol_type = genomic DNA

SEQ ID NO: 4432 - DNA, 437 bp, Homo sapiens; identical to SEQ ID NO: 1298
  misc_feature 1..437: note = chr17:46655562-46655999
  misc_feature 1..437: note = hyper
  source 1..437: mol_type = genomic DNA

SEQ ID NO: 4433 - DNA, 341 bp, Homo sapiens; identical to SEQ ID NO: 1299
  misc_feature 1..341: note = chr17:46656057-46656398
  misc_feature 1..341: note = hyper
  source 1..341: mol_type = genomic DNA

SEQ ID NO: 4434 - DNA, 480 bp, Homo sapiens
  misc_feature 1..480: note = chr17:46659429-46659909
  misc_feature 1..480: note = hyper
  source 1..480: mol_type = genomic DNA
gccacaggttgctagcgtgacctcgcccctcccagccaccctccgccgtccaggcgtgcccagtccgctaggaatcatcaccttttgttggcggggagaagggactcagcgagggagcgaaaccgaaggcccgagcggaggcgagtccccagccggcctgcgcaccggcggcggcggcgcggaggagagaaaggcccagagggggcgcgggcgagggtactcaccgggaggctccccagccccgccggccgccgagccgcccgcggacgcgccgggcaacagctgagctctctcctgtccactattgtgtgtccggaaaaccggaccgcggcggcggacacagccacgggctccctcagaagccggaacgtgacttttttttttggtgtgtttttgttttggaagcgcaagttttcgtgttaatctcatactttggcagtctttgttaaacagctaggcgcgtcacgaggctctcaaaca

SEQ ID NO: 4435 - DNA, 37 bp, Homo sapiens
  misc_feature 1..37: note = chr17:46674933-46674970
  misc_feature 1..37: note = hyper
  source 1..37: mol_type = genomic DNA
acagcgagagacccccggccggcgcccaatcttcttc

SEQ ID NO: 4436 - DNA, 393 bp, Homo sapiens
  misc_feature 1..393: note = chr17:46675170-46675563
  misc_feature 1..393: note = hyper
  source 1..393: mol_type = genomic DNA
cacgctcttgtcctgcgcgcagtccgacttccgcggctcggggtggaacgggggctgctcgtcggcgccggagagtgcgcaggccgactctttctcgcggtagaaggccggcgccggcccgtagtcgcagggcgccgctcggccgtagccaccgcccgccggcgggtaataggaggaagtggcaaagcccttgtcctggcccggccctggcccgtagggcgcggggtaatgtctcagcgggtccgcatagcccgacgaatagagcggtagctggcccaggaaggactcctgcccgctggccagagtgacggggaaggtggagttcacgaaataggaactcattgggaggggaggcgcgcgcggccgctgctgctccgccgggtttatgatttg

SEQ ID NO: 4437 - DNA, 238 bp, Homo sapiens
  misc_feature 1..238: note = chr17:46690467-46690705
  misc_feature 1..238: note = hyper
  source 1..238: mol_type = genomic DNA
gggccagagctctctcgggcaggggcgcgcggcggcggcgcggccgggacccgcggacgtgcgggcggccgcggccctggcagtcccagctgaagcctacttcttgtcgcccttctgcgcgtcgccctcgtccgccgcctctggggcccgctccagcttctgtttctccagctcctcctgctcgcatttgctgctggggaacttgtctttgttgttctcttttttccacttcatcctc

SEQ ID NO: 4438 - DNA, 28 bp, Homo sapiens
  misc_feature 1..28: note = chr17:46690852-46690880
  misc_feature 1..28: note = hyper
  source 1..28: mol_type = genomic DNA
cgcctgcgtccggcggctgctgggaatg

SEQ ID NO: 4439 - skipped

SEQ ID NO: 4440 - DNA, 378 bp, Homo sapiens
  misc_feature 1..378: note = chr17:46691987-46692365
  misc_feature 1..378: note = hyper
  source 1..378: mol_type = genomic DNA
cgcagtcataataattggggcgcagggactccccggttttgtatttggagaacagtgagttgacgaaataagagctcattttattgaattttgaggcggcggcggcggcggaggctatagttgggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccacc

SEQ ID NO: 4441 - DNA, 938 bp, Homo sapiens; identical to SEQ ID NO: 1300
  misc_feature 1..938: note = chr17:46795436-46796374
  misc_feature 1..938: note = hyper
  source 1..938: mol_type = genomic DNA

SEQ ID NO: 4442 - DNA, 55 bp, Homo sapiens; identical to SEQ ID NO: 1301
  misc_feature 1..55: note = chr17:46796498-46796553
  misc_feature 1..55: note = hyper
  source 1..55: mol_type = genomic DNA

SEQ ID NO: 4443 - DNA, 25 bp, Homo sapiens
  misc_feature 1..25: note = chr17:46796613-46796638
  misc_feature 1..25: note = hyper
  source 1..25: mol_type = genomic DNA
cagcactactaccgtctgagcaggc

SEQ ID NO: 4444 - DNA, 74 bp, Homo sapiens
  misc_feature 1..74: note = chr17:46797140-46797214
  misc_feature 1..74: note = hyper
  source 1..74: mol_type = genomic DNA
ttttagctgcaggcccggcgggtgttccccggaaggcaaggattggaagctctttgataaagccgcgcgaggcc

SEQ ID NO: 4445 - DNA, 31 bp, Homo sapiens
  misc_feature 1..31: note = chr17:46797274-46797305
  misc_feature 1..31: note = hyper
  source 1..31: mol_type = genomic DNA
cgtctcggcctggctccggaggggtgaagga

SEQ ID NO: 4446 - DNA, 197 bp, Homo sapiens
  misc_feature 1..197: note = chr17:46800518-46800715
  misc_feature 1..197: note = hyper
  source 1..197: mol_type = genomic DNA
tttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggg

SEQ ID NO: 4447 - DNA, 87 bp, Homo sapiens
  misc_feature 1..87: note = chr17:46800961-46801048
  misc_feature 1..87: note = hyper
  source 1..87: mol_type = genomic DNA
atttggagtagggatcgcctgcagggaaggcggggcggattctcggctggcggcggcctcgcagggttcccggaagcgctagccagc

SEQ ID NO: 4448 - DNA, 169 bp, Homo sapiens
  misc_feature 1..169: note = chr17:46801108-46801277
  misc_feature 1..169: note = hyper
  source 1..169: mol_type = genomic DNA
cgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgaga

SEQ ID NO: 4449 - DNA, 606 bp, Homo sapiens; identical to SEQ ID NO: 1303
  misc_feature 1..606: note = chr17:46802306-46802912
  misc_feature 1..606: note = hyper
  source 1..606: mol_type = genomic DNA

SEQ ID NO: 4450 - DNA, 117 bp, Homo sapiens; identical to SEQ ID NO: 1304
  misc_feature 1..117: note = chr17:46802993-46803110
  misc_feature 1..117: note = hyper
  source 1..117: mol_type = genomic DNA

SEQ ID NO: 4451 - DNA, 318 bp, Homo sapiens; identical to SEQ ID NO: 1305
  misc_feature 1..318: note = chr17:46804107-46804425
  misc_feature 1..318: note = hyper
  source 1..318: mol_type = genomic DNA

SEQ ID NO: 4452 - DNA, 728 bp, Homo sapiens
  misc_feature 1..728: note = chr17:46810368-46811096
  misc_feature 1..728: note = hyper
  source 1..728: mol_type = genomic DNA
tcctggcagaccctccgggagcccggagcctcccccagctttctttactgacccagccaaaagcgctgaaagcctcagcgtgctcctttacatacccgccagacacctccaggaaggtaaaggccaagttgaaagttaagagtctgtttacctccaggagcccattcagctcggccccacagacagcctgtgacctttacagcccggcctttgagcgcggccgccgcgcccccgggggttccggcaacggggacttggcacctcggtgtcagctcccgcccccacccaggctagggacccgccaacgaggggtgggggcgggaggcgcccacccgtcgcactagtgggcatttgctaaactacgttttatttttttgtaaagtgagcgcccgctgccttcgttctcccaactggagcaaactctgtggcggcgacgatggcggccgtcaggtcggtggtgatgaatagagaggatttctctgcagcgcgacgctcccctctcccgaaaggttggctccacggtcccgccggccgcgcaggtctggctgaactgcttggggtcgcccggctcctctcgattttatgaaaatggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 4453 - DNA, 213 bp, Homo sapiens
  misc_feature 1..213: note = chr17:46816511-46816724
  misc_feature 1..213: note = hyper
  source 1..213: mol_type = genomic DNA
gccagcacctcgggccgcgcagacccctacatctctaatcccatagccctccaggggtccttggggcagtccctttggaaagtcttcgaagtgcagggtactttaagtaccctgtagacgccttttatttaatccgcacaacaaaagaacggggcaggagtggggggaaattgttacttccgttttgtagataagagaactgagccgggacgg

SEQ ID NO: 4454 - DNA, 347 bp, Homo sapiens; identical to SEQ ID NO: 1306
  misc_feature 1..347: note = chr17:46824568-46824915
  misc_feature 1..347: note = hyper
  source 1..347: mol_type = genomic DNA

SEQ ID NO: 4455 - DNA, 469 bp, Homo sapiens; identical to SEQ ID NO: 1307
  misc_feature 1..469: note = chr17:46824916-46825385
  misc_feature 1..469: note = hyper
  source 1..469: mol_type = genomic DNA

SEQ ID NO: 4456 - DNA, 63 bp, Homo sapiens
  misc_feature 1..63: note = chr17:46826997-46827060
  misc_feature 1..63: note = hyper
  source 1..63: mol_type = genomic DNA
aaagacctcagtcctcgcatccccaccccgacccccggcagcctctttcgctctaagcctcag

SEQ ID NO: 4457 - DNA, 121 bp, Homo sapiens
  misc_feature 1..121: note = chr17:46827381-46827502
  misc_feature 1..121: note = hyper
  source 1..121: mol_type = genomic DNA
ggtctggagggctggcggggcaggagttgggggccaggtaggaaagccaggggtcgaagggatcgattctaggggccgcagaggctactctcgtgctctggagaagcaccgcatctttctc

SEQ ID NO: 4458 - DNA, 49 bp, Homo sapiens
  misc_feature 1..49: note = chr17:46827625-46827674
  misc_feature 1..49: note = hyper
  source 1..49: mol_type = genomic DNA
cgccagcattttgccggggtttatgcctcaatcccgcattccagccact

SEQ ID NO: 4459 - DNA, 157 bp, Homo sapiens
  misc_feature 1..157: note = chr17:46829979-46830136
  misc_feature 1..157: note = hyper
  source 1..157: mol_type = genomic DNA
ccccaggttggttcacgcgagttttaaaatgaatcggaggtgaaatggagctcattaccctctcttcagcccgaccctcaatctttggcagcgaggggcagttatgggacggggggcgggtgggaagagcgcccagggccccctccgggttctccca

SEQ ID NO: 4460 - DNA, 502 bp, Homo sapiens; identical to SEQ ID NO: 1308
  misc_feature 1..502: note = chr17:46831824-46832326
  misc_feature 1..502: note = hyper
  source 1..502: mol_type = genomic DNA

SEQ ID NO: 4461 - DNA, 150 bp, Homo sapiens; identical to SEQ ID NO: 1309
  misc_feature 1..150: note = chr17:46832489-46832639
  misc_feature 1..150: note = hyper
  source 1..150: mol_type = genomic DNA

SEQ ID NO: 4462 - DNA, 198 bp, Homo sapiens
  misc_feature 1..198: note = chr17:47074751-47074949
  misc_feature 1..198: note = hyper
  source 1..198: mol_type = genomic DNA
cattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgcc

SEQ ID NO: 4463 - DNA, 177 bp, Homo sapiens; identical to SEQ ID NO: 1310
  misc_feature 1..177: note = chr17:47075225-47075402
  misc_feature 1..177: note = hyper
  source 1..177: mol_type = genomic DNA

SEQ ID NO: 4464 - DNA, 589 bp, Homo sapiens
  misc_feature 1..589: note = chr17:47987525-47988114
  misc_feature 1..589: note = hyper
  source 1..589: mol_type = genomic DNA
ggaggtgagaggaaccgcgaggcagcagcggtgtggggaaggcactcagctttcctggaggagcggctcccggtggcggcgggctgcctggaggaggaggcagggccaggctgggcgctgaggaggccgccccggtggcgctcccacgacccgggcaaggcagtctgggcgccgtctccggtctcggggcctgcggtcggggcaccgcggtgccgcgtttgagccggtcagctccctgcggaaattacaggggcgctcggcgctgcggtcgcgccccccggggcagcgcccgctggttggaggcgtttaaattgaaagcagctttggggagagggggcggacgcgggccgccgagcaaggggagggggcggcccggcacagcgaccccattgtctgtgcccgccgaggggtggaaccttgcggtgagctcggcgcggcgccccctccccgagctccggcccagcggcgctctcagctggttcccacgctgcgcagcgctggccacgacccctcgtcccttctccacctgggtctgcctcttggctcgctgactgcaagcctggcagcgcgcacgcgcacacttcctcca

SEQ ID NO: 4465 - DNA, 239 bp, Homo sapiens; identical to SEQ ID NO: 1311
  misc_feature 1..239: note = chr17:48042409-48042648
  misc_feature 1..239: note = hyper
  source 1..239: mol_type = genomic DNA

SEQ ID NO: 4466 - DNA, 206 bp, Homo sapiens; identical to SEQ ID NO: 1312
  misc_feature 1..206: note = chr17:48042750-48042956
  misc_feature 1..206: note = hyper
  source 1..206: mol_type = genomic DNA

SEQ ID NO: 4467 - DNA, 1027 bp, Homo sapiens; identical to SEQ ID NO: 1313
  misc_feature 1..1027: note = chr17:48049499-48050526
  misc_feature 1..1027: note = hyper
  source 1..1027: mol_type = genomic DNA

SEQ ID NO: 4468 - DNA, 53 bp, Homo sapiens
  misc_feature 1..53: note = chr17:48071806-48071859
  misc_feature 1..53: note = hyper
  source 1..53: mol_type = genomic DNA
cgatcctcatccgggaccgcggcgcactgcgcacatcgcgccccaaatgcttg

SEQ ID NO: 4469 - DNA, 534 bp, Homo sapiens
  misc_feature 1..534: note = chr17:48636701-48637235
  misc_feature 1..534: note = hyper
  source 1..534: mol_type = genomic DNA
tggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacga

SEQ ID NO: 4470 - DNA, 197 bp, Homo sapiens
  misc_feature 1..197: note = chr17:53341227-53341424
  misc_feature 1..197: note = hyper
  source 1..197: mol_type = genomic DNA
cgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttat

SEQ ID NO: 4471 - DNA, 70 bp, Homo sapiens
  misc_feature 1..70: note = chr17:58217229-58217299
  misc_feature 1..70: note = hyper
  source 1..70: mol_type = genomic DNA
ttccagggtaaagaccgcggaaccaggcgggggtctggggagcctggctgcgacctcggctgcaggcttc

SEQ ID NO: 4472 - DNA, 249 bp, Homo sapiens
  misc_feature 1..249: note = chr17:58217356-58217605
  misc_feature 1..249: note = hyper
  source 1..249: mol_type = genomic DNA
cgccacctaccggaagccgcgtccgcgctacagcctccactcaggattcgacccgaactccaagacgcgtccgcactggtccaacaaccctcatggatcgtcgcctgcctcaactgtttagaccaccgcgggtttcacccggaagcaccggggaggtcggagcttgcctgagaggctcagcgaaggtccatgccttgttcagtcccaggcagtgcgggacaggtgggcgaagctcgaaccccatgctct

SEQ ID NO: 4473 - DNA, 200 bp, Homo sapiens
  misc_feature 1..200: note = chr17:58498777-58498977
  misc_feature 1..200: note = hyper
  source 1..200: mol_type = genomic DNA
gtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgcc

SEQ ID NO: 4474 - DNA, 355 bp, Homo sapiens
  misc_feature 1..355: note = chr17:58498978-58499333
  misc_feature 1..355: note = hyper
  source 1..355: mol_type = genomic DNA
ggaccccgccgtgtgccgcccagggacgcgagggggcgctgctgccgcgccaggggcgagggtcccggggcctcctgagcacctcccggccctgcccggccaactcagactacacccggactctgcccaccgcgtttccgccctcggcctcgggtccctggagggctcgcgggtaggaagagtcggggtggcgggactttcgccgacacccggctccccgcctggtggctgcgcacacgaggccggcgacgggacttgcccgcgtctcagcgcctcctgtgtgaagcgggaccgctgcggtacctgccccagggaaggccgcggggagggttacagagcccgtaggcactggcgg

SEQ ID NO: 4475 - DNA, 71 bp, Homo sapiens
  misc_feature 1..71: note = chr17:59474176-59474247
  misc_feature 1..71: note = hyper
  source 1..71: mol_type = genomic DNA
actcggacgcaagtccgtcgtccgctctgccacgcggccgcacagcccgagcttcctgctgcccactgccc

SEQ ID NO: 4476 - DNA, 403 bp, Homo sapiens
  misc_feature 1..403: note = chr17:59474741-59475144
  misc_feature 1..403: note = hyper
  source 1..403: mol_type = genomic DNA
cgccaggggagggggttcctgggaagggggagggggccggcctaggtgggggaggggcccagcggaggcctcacggcgccgctccagggcctcccaggcctccccagcgccagctttcggtgagcctcgggcattcctagctggagagtttggctgggggtcgctacagactcttcagagcggctgcagcaggacctcagggtgatcgcgggaccgcggggcggggcgagtggtgggatcctggcccggacagagccccggaaagccagagggaaggtcggtgccactgtaggtggggtcgccgtccccagatgcagccgctgcactgtcgccgccaggtttctcggtcaaataacccaggcctgagtgtttcaaactcttcaggcctcggacccctggacca

SEQ ID NO: 4477 - DNA, 414 bp, Homo sapiens; identical to SEQ ID NO: 1314
  misc_feature 1..414: note = chr17:59478133-59478547
  misc_feature 1..414: note = hyper
  source 1..414: mol_type = genomic DNA

SEQ ID NO: 4478 - DNA, 275 bp, Homo sapiens; identical to SEQ ID NO: 1315
  misc_feature 1..275: note = chr17:59528876-59529151
  misc_feature 1..275: note = hyper
  source 1..275: mol_type = genomic DNA

SEQ ID NO: 4479 - DNA, 12 bp, Homo sapiens
  misc_feature 1..12: note = chr17:59529253-59529265
  misc_feature 1..12: note = hyper
  source 1..12: mol_type = genomic DNA
cgacctcgggac

SEQ ID NO: 4480 - DNA, 233 bp, Homo sapiens; identical to SEQ ID NO: 1317
  misc_feature 1..233: note = chr17:59529843-59530076
  misc_feature 1..233: note = hyper
  source 1..233: mol_type = genomic DNA

SEQ ID NO: 4481 - DNA, 49 bp, Homo sapiens
  misc_feature 1..49: note = chr17:59530303-59530352
  misc_feature 1..49: note = hyper
  source 1..49: mol_type = genomic DNA
caaggaagagggccccggtactggagcgaaaatccgtgtagatatgtga

SEQ ID NO: 4482 - DNA, 207 bp, Homo sapiens
  misc_feature 1..207: note = chr17:59531811-59532018
  misc_feature 1..207: note = hyper
  source 1..207: mol_type = genomic DNA
accccgcggtgctggcggcggccgagcgcgcccaagctcgaggtccgagaggaccgcgaggacggccgccccgggccagccgggcgtggaaaaaaggaaattgctgggaagggggcaagctgtcccgaggtctggatgtggcttcgtggcggagagaaaaggaagaggcaaaccctgagcccgggagggagagcactgagcaggcct

SEQ ID NO: 4483 - DNA, 170 bp, Homo sapiens; identical to SEQ ID NO: 1318
  misc_feature 1..170: note = chr17:59533874-59534044
  misc_feature 1..170: note = hyper
  source 1..170: mol_type = genomic DNA

SEQ ID NO: 4484 - DNA, 66 bp, Homo sapiens; identical to SEQ ID NO: 1319
  misc_feature 1..66: note = chr17:59534340-59534406
  misc_feature 1..66: note = hyper
  source 1..66: mol_type = genomic DNA

SEQ ID NO: 4485 - DNA, 225 bp, Homo sapiens; identical to SEQ ID NO: 1320
  misc_feature 1..225: note = chr17:59534556-59534781
  misc_feature 1..225: note = hyper
  source 1..225: mol_type = genomic DNA

SEQ ID NO: 4486 - DNA, 21 bp, Homo sapiens
  misc_feature 1..21: note = chr17:61778053-61778074
  misc_feature 1..21: note = hyper
  source 1..21: mol_type = genomic DNA
cccgccgccaggggccgcccc

SEQ ID NO: 4487 - DNA, 15 bp, Homo sapiens
  misc_feature 1..15: note = chr17:61778234-61778249
  misc_feature 1..15: note = hyper
  source 1..15: mol_type = genomic DNA
ggtatgcgtggttcc

SEQ ID NO: 4488 - DNA, 153 bp, Homo sapiens
  misc_feature 1..153: note = chr17:61926172-61926325
  misc_feature 1..153: note = hyper
  source 1..153: mol_type = genomic DNA
ccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggc

SEQ ID NO: 4489 - DNA, 96 bp, Homo sapiens
  misc_feature 1..96: note = chr17:61926507-61926603
  misc_feature 1..96: note = hyper
  source 1..96: mol_type = genomic DNA
cgcgctcccctcccgtcgttgtagcttcctgctcgcccctctcatctcagccaaccctgctgagctttcgcgtgggcgtcacgagtttctaggcag

SEQ ID NO: 4490 - DNA, 21 bp, Homo sapiens
  misc_feature 1..21: note = chr17:70113546-70113567
  misc_feature 1..21: note = hyper
  source 1..21: mol_type = genomic DNA
cttccacaagaaactcgtgtc

SEQ ID NO: 4491 - DNA, 372 bp, Homo sapiens; identical to SEQ ID NO: 1322
  misc_feature 1..372: note = chr17:70113647-70114019
  misc_feature 1..372: note = hyper
  source 1..372: mol_type = genomic DNA

SEQ ID NO: 4492 - DNA, 365 bp, Homo sapiens; identical to SEQ ID NO: 1323
  misc_feature 1..365: note = chr17:70114152-70114517
  misc_feature 1..365: note = hyper
  source 1..365: mol_type = genomic DNA

SEQ ID NO: 4493 - DNA, 640 bp, Homo sapiens; identical to SEQ ID NO: 1324
  misc_feature 1..640: note = chr17:70215667-70216307
  misc_feature 1..640: note = hyper
  source 1..640: mol_type = genomic DNA

SEQ ID NO: 4494 - DNA, 54 bp, Homo sapiens; identical to SEQ ID NO: 1325
  misc_feature 1..54: note = chr17:70216392-70216446
  misc_feature 1..54: note = hyper
  source 1..54: mol_type = genomic DNA

SEQ ID NO: 4495 - DNA, 525 bp, Homo sapiens
  misc_feature 1..525: note = chr17:71948390-71948915
  misc_feature 1..525: note = hyper
  source 1..525: mol_type = genomic DNA
actccattcatctcccggttcctcgcattcatcccccaccgaacccacccacaaaatgctgaatcggtgggtgagatccccatagcaacggctccgatgccagaacccaggattacgacaccggatcagccagagacgcgctggaggggcccaggaggggctgcagcgcgccgcaaatcccccggggcttacgggagccgctctttaggagacagcgctggacgaaccgggcggggtggggatggataatcttcaggcgccaacgcaaaacggccgcaagacgtggccaggccaggaggctcctgggtcccgggcccgcgatgtggcccttgcgcggggacaaagacgaggccatcgccctcacgtgttcccaaagacgcccaacctcatcaggaggccgccccatccgccacctgggagcgtcccacacgcccgggcccttgaggatgtcccctcggcgatgtgcctgaccgggcgctccccgcccgccaacctccaacctccaacctccgccctccaccctcc

SEQ ID NO: 4496 - DNA, 324 bp, Homo sapiens
  misc_feature 1..324: note = chr17:72856941-72857265
  misc_feature 1..324: note = hyper
  source 1..324: mol_type = genomic DNA
tggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacga

SEQ ID NO: 4497 - DNA, 38 bp, Homo sapiens; identical to SEQ ID NO: 1326
  misc_feature 1..38: note = chr17:74072998-74073036
  misc_feature 1..38: note = hyper
  source 1..38: mol_type = genomic DNA

SEQ ID NO: 4498 - DNA, 144 bp, Homo sapiens
  misc_feature 1..144: note = chr17:74534219-74534363
  misc_feature 1..144: note = hyper
  source 1..144: mol_type = genomic DNA
acactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccg

SEQ ID NO: 4499 - DNA, 15 bp, Homo sapiens
  misc_feature 1..15: note = chr17:74534387-74534402
  misc_feature 1..15: note = hyper
  source 1..15: mol_type = genomic DNA
cgcccaggctctggg

SEQ ID NO: 4500 - DNA, 567 bp, Homo sapiens
  misc_feature 1..567: note = chr17:74865591-74866158
  misc_feature 1..567: note = hyper
  source 1..567: mol_type = genomic DNA
ccctcccgtcccgcccgtctgcccctaggtcggctaccccccaacccctccgcctgtgccaccctctccccagcctttggtggcactgctctcctccccgcggggctcgggcctggctccgacgagagggtcccgagattagagcgaggactcgctcatcccaggattcgcccccgatcgcaggcgtcggagaggcgggggcaggggcggcgctgcagggctacggggcggctggagccgaggctgcggcggagcgtggtgggcgggcggtggcgaaggcgacacgcttcgggcggccaacacctgggggcccaggccaggcagggctggggccgcgcgggactcactggacccagccaggggcccccagggcccagcggtgccggggcagccccctctcctcccaggcatccgcggaaccggcccgcagcggggtggggagggggcgctgcccagtggacgcccggcggggcccgagtgtcaccccgtgggtagctgggcagcgaggaagctgggggagtgaccgccccggcgcgggggccggactcgggacgtggccacaggtgg

SEQ ID NO: 4501 - DNA, 18 bp, Homo sapiens
  misc_feature 1..18: note = chr17:75369440-75369458
  misc_feature 1..18: note = hyper
  source 1..18: mol_type = genomic DNA
gcctaggggctcctccgg

SEQ ID NO: 4502 - DNA, 228 bp, Homo sapiens; identical to SEQ ID NO: 1328
  misc_feature 1..228: note = chr17:75369492-75369720
  misc_feature 1..228: note = hyper
  source 1..228: mol_type = genomic DNA

SEQ ID NO: 4503 - DNA, 389 bp, Homo sapiens
  misc_feature 1..389: note = chr17:76227773-76228162
  misc_feature 1..389: note = hyper
  source 1..389: mol_type = genomic DNA
agggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcg

SEQ ID NO: 4504 - DNA, 130 bp, Homo sapiens
  misc_feature 1..130: note = chr17:76228213-76228343
  misc_feature 1..130: note = hyper
  source 1..130: mol_type = genomic DNA
cggacgccggcaatggcagcgcctggcccgggcgcgcagagctgctctcctcgcactcggggctctggcgcatctgcgaaggtaaccggccaccgcgccggccctcctccctccgcgacctcgtccctcc

SEQ ID NO: 4505 - DNA, 102 bp, Homo sapiens
  misc_feature 1..102: note = chr17:77178962-77179064
  misc_feature 1..102: note = hyper
  source 1..102: mol_type = genomic DNA
cgctccccgccccgagtccccagcggcccggcgcgaagttccccaaagtgacccgggcgccgagaacccccgccccctcccctcgggcttccccggagactc

SEQ ID NO: 4506 - DNA, 249 bp, Homo sapiens
  misc_feature 1..249: note = chr17:77179081-77179330
  misc_feature 1..249: note = hyper
  source 1..249: mol_type = genomic DNA
cgcgccttcggaaaagttgcgagcgacgccccaaactccggcccccccgcctcgcgccgcgcgcgccctgggcgcccccgcgctcggccgccgcgcaggggcgcagttccccctaccccagccccggcgccatgacgcggggagcgcagcgggggccaccggtggcggcggcggcgcagaggcggccaagtgcggggcgtgggcggcagcgcggggcgcacgtgcgccgggccgggggccggggccggg

SEQ ID NO: 4507 - DNA, 75 bp, Homo sapiens
  misc_feature 1..75: note = chr17:77179380-77179455
  misc_feature 1..75: note = hyper
  source 1..75: mol_type = genomic DNA
cggagtgcgggagcatgctgccggagttggacagcaggaggcagcccgagttcgccatggagcacagcatggggc

SEQ ID NO: 4508 - DNA, 27 bp, Homo sapiens
  misc_feature 1..27: note = chr17:77179456-77179483
  misc_feature 1..27: note = hyper
  source 1..27: mol_type = genomic DNA
gcaggggggcgcccggcggcggctctg

SEQ ID NO: 4509 - DNA, 92 bp, Homo sapiens
  misc_feature 1..92: note = chr17:77179617-77179709
  misc_feature 1..92: note = hyper
  source 1..92: mol_type = genomic DNA
cgcgcctctgcccggtgttccccctgcccgggcggggaggctggagagagcgcgcgcgagaatacggccagagagtctgtgcgcgagagatc

SEQ ID NO: 4510 - DNA, 25 bp, Homo sapiens
  misc_feature 1..25: note = chr17:77179710-77179735
  misc_feature 1..25: note = hyper
  source 1..25: mol_type = genomic DNA
ggcgagcgggcgagagcaggagtca

SEQ ID NO: 4511 - DNA, 64 bp, Homo sapiens
  misc_feature 1..64: note = chr17:77777585-77777649
  misc_feature 1..64: note = hyper
  source 1..64: mol_type = genomic DNA
acttttttgctgggacgtcgggacctcaagtcagttccaaagtgggagtctctcagccggtgcc

SEQ ID NO: 4512 - DNA, 254 bp, Homo sapiens
  misc_feature 1..254: note = chr17:77777650-77777904
  misc_feature 1..254: note = hyper
  source 1..254: mol_type = genomic DNA
ttcccttgcgagattgttaacgccaagagccacagtccagcttccccttttagagatcagaaaatcctaagtgcagggcctgccgggtcattcgagaaggcacaagctgcggaggccagtctggggcctctcgcagaacctcggggaacagaggcgtctgccgggccgcctaccctccgcaagagtgggccacgcgggcggcaaacccgagggcagacgtttgggagctgaccgagaaaacgcgacggtgccgg

SEQ ID NO: 4513 - DNA, 18 bp, Homo sapiens
  misc_feature 1..18: note = chr17:77777943-77777961
  misc_feature 1..18: note = hyper
  source 1..18: mol_type = genomic DNA
cgacgcctttcctcgcag

SEQ ID NO: 4514 - DNA, 263 bp, Homo sapiens
  misc_feature 1..263: note = chr17:80329738-80330001
  misc_feature 1..263: note = hyper
  source 1..263: mol_type = genomic DNA
gtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggc

SEQ ID NO: 4515 - DNA, 890 bp, Homo sapiens
  misc_feature 1..890: note = chr18:500373-501263
  misc_feature 1..890: note = hyper
  source 1..890: mol_type = genomic DNA
gcgccctggcagccccgactccccgggcccgcagcccaagggaaggttcgcgcgggaggcacctccgtggcctcccgcgcgccccgaagcccgttccccccgcccagagccccgcggagctgccgccgccctacctttcatggtgaccgtggggacgcaccgccggccggggagctccgcgcgagcgccgcgcagccgaggaagtcgtcccgagcggctgctcaccgcacgcccatggtagccgcgccgcgcgccggccgtctgcgcccccgtcctccctcgccgccgccggcccgcgctccccgcgctcccggctccgcgctctgctgcctcggggctgccgcgcgcgccgctctcgctctcccagcgcccctccccctggcccgacccggccgagcgagcggccgcgcccacgcccctctcgcgccctcccgcgcccgccccgccctcggcccgcgcctgccctcgccgggcactttctcgcccgccctctcctgcgcgccctggccccactcgcgcgggctctctctttttcccgttgcaccagcgtcgggatgaagtcgggagcaaagcccttcccggggcggtccagcgttcaccttcggcgagcacctaaggtgccgctgctgctggggtcgcttctacaccccaaactacctagcaagtgttgggcgagaggatggggagctgctgtgccccgggggtggcggggggtaaggtgggcccttccccaaacggctctggggcatggagaggtacagaacgtcctccgggttcagagtttccaagtgcgtgcgctggttgacgcctgaaggagaccaagcagcagggaacactctctctgtcacccagggagagcccgagtggccagaatccgaagtcaccattag

SEQ ID NO: 4516 - DNA, 171 bp, Homo sapiens
  misc_feature 1..171: note = chr18:906736-906907
  misc_feature 1..171: note = hyper
  source 1..171: mol_type = genomic DNA
tccaggggtccaaagcgagagggatttgttttaacccatctctacccgtcctgtgtcaagaacggaggctgtagagggcgactgcgaagtcgccaggcactcgctggatctcggtccccctcctcgtgctctggggttgagatggggcaccgccatcgataacagatcagc

SEQ ID NO: 4517 - DNA, 270 bp, Homo sapiens
  misc_feature 1..270: note = chr18:3499101-3499371
  misc_feature 1..270: note = hyper
  source 1..270: mol_type = genomic DNA
agggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcac

SEQ ID NO: 4518 - DNA, 68 bp, Homo sapiens
  misc_feature 1..68: note = chr18:5196575-5196643
  misc_feature 1..68: note = hyper
  source 1..68: mol_type = genomic DNA
cgcctccttctcctcgggaggccaggaggacccgggtcactttgccaattctgcggagggggaagtag

SEQ ID NO: 4519 - DNA, 199 bp, Homo sapiens
  misc_feature 1..199: note = chr18:11149561-11149760
  misc_feature 1..199: note = hyper
  source 1..199: mol_type = genomic DNA
cttcaatgaaactttcgaagccctcactcggggacgggcgtgtcccccggccaatgggatggcggctccggggcctgcgcgcgcggagcccgcccctgagcggctggggaagtgagagccttgcaccggcgcggagggcaagcccccacccgcggctcccgcgcctgggagagacccggcctggcctgccagtgggctg

SEQ ID NO: 4520 - DNA, 52 bp, Homo sapiens
  misc_feature 1..52: note = chr18:11149779-11149831
  misc_feature 1..52: note = hyper
  source 1..52: mol_type = genomic DNA
cgcgggcactcctgccccactggctcccgcagccccgcggctctgcgtggtt

SEQ ID NO: 4521 - DNA, 252 bp, Homo sapiens
  misc_feature 1..252: note = chr18:11752127-11752379
  misc_feature 1..252: note = hyper
  source 1..252: mol_type = genomic DNA
ggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctct

SEQ ID NO: 4522 - skipped

SEQ ID NO: 4523 - DNA, 90 bp, Homo sapiens
  misc_feature 1..90: note = chr18:11752640-11752730
  misc_feature 1..90: note = hyper
  source 1..90: mol_type = genomic DNA
cgccaggctgggcgggcagggccgggcgagggtcgcgcgcacctctgggccgcggagcccagacggcggccggggcgagctcctccagcc

SEQ ID NO: 4524 - DNA, 148 bp, Homo sapiens
  misc_feature 1..148: note = chr18:12254432-12254580
  misc_feature 1..148: note = hyper
  source 1..148: mol_type = genomic DNA
cgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatcc

SEQ ID NO: 4525 - DNA, 324 bp, Homo sapiens; identical to SEQ ID NO: 1329
  misc_feature 1..324: note = chr18:12307602-12307926
  misc_feature 1..324: note = hyper
  source 1..324: mol_type = genomic DNA

SEQ ID NO: 4526 - DNA, 350 bp, Homo sapiens; identical to SEQ ID NO: 1330
  misc_feature 1..350: note = chr18:13868570-13868920
  misc_feature 1..350: note = hyper
  source 1..350: mol_type = genomic DNA

SEQ ID NO: 4527 - DNA, 459 bp, Homo sapiens
  misc_feature 1..459: note = chr18:22929260-22929719
  misc_feature 1..459: note = hyper
  source 1..459: mol_type = genomic DNA
cgcgcacgcccgtggcgtttcttttttcactgtcgacacttggatctttcaggccctgggtctaggtttcccccagaaaaatgaggggcccatgtgacggaaaccaccagacacactgtgtggagacacatgccaatgattcacctcgttcccgaactaaaacttctgcgctttaggaaaaaagcaagcgttccaatctgcgaggccctcccccaccccgtcccttcccaggagaagaaagaaagggctttgtgtgtgcggtgagggctccgttcatcgagttcaaaaatgcacagcggccgggggccgggaggcgtggggcgccgggccctgcccaccccttttccccgggccggcggcgagtcgggaagctggtgcgggaaccggggccacggggcgccgcggcccggcagccaggaggaagaggatgctgcgccgccggggaccagagggcggggc

SEQ ID NO: 4528 - DNA, 357 bp, Homo sapiens
  misc_feature 1..357: note = chr18:22929926-22930283
  misc_feature 1..357: note = hyper
  source 1..357: mol_type = genomic DNA
ggacctcgcggctcccctcggccgcccgcccccgatttcctcggaaggaggctcgcgaaggtggaggaggcggccgaggaggaggaggaggccgccacgtgactctcctcgccacattccaacacagccatcagatcgataacttcagggacccccgcccccgccgcagccagctagtgcgcccccaaaatcccgcacgcacgccccgcaacttccctctccaacagggacgacggagagctggaccccaccgcgaaacgcaaaggactccaggggcggcggggagaagtaggggcgaggggcggtcaacttctgggaatggccaagaggggtgctctgaggcccgagccggggtcc

SEQ ID NO: 4529 - DNA, 865 bp, Homo sapiens
  misc_feature 1..865: note = chr18:22930284-22931149
  misc_feature 1..865: note = hyper
  source 1..865: mol_type = genomic DNA
gtgcccgcggccggcggccggggtctgtttactccggcgacgtgcggagaggacccaagcaggacgcgggcgggcgggaggcggcggccgggaccccgggccacgtttgtcacgagcgggggctgctccccacctccgagatgacttttttcttcttccaaagaaaaggaaaaaagaagcaccgcacggttttgcatatttattctttgcgaaaacacacaacagaaactttttcctccagcccagatgtagatctcagacgggatatttttttttcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcgcagccacgcagccctcgctccgctacccacagtgacactcgcggatgggggaaagcggggagcagggggttcctccttacctttgagggatctcggtttcgcttgcttgcggcgagacatcctaaaagcaaacagctgaagttgtttcaattcagccctgaaagaaactatacttcctcgtggccgcgcgcccctcgggccgcggcgcctcgcgccctccgctcggcctccctcgcgccctcgctccgcgctccgctcctcgctccggctccggctcgcgctcgcgcgcggggctcgcggctgcccgagctccgcgctctgcacgacggcggcggcggcggcggcggctgctgcaccaa

SEQ ID NO: 4530 - DNA, 125 bp, Homo sapiens
  misc_feature 1..125: note = chr18:28620831-28620956
  misc_feature 1..125: note = hyper
  source 1..125: mol_type = genomic DNA
gttaatttacccatccggtccgaaattgcaagtgtttgtaaactgacaattgcagatgaaatagtcattttctgtgcactttccggtatttaagtctccagatacagcatttaacctaaactcaa

SEQ ID NO: 4531 - DNA, 135 bp, Homo sapiens
  misc_feature 1..135: note = chr18:28621033-28621168
  misc_feature 1..135: note = hyper
  source 1..135: mol_type = genomic DNA
cgcgcaccttcttccttgccacagctcgacacccccacccatgccttgccgggaaagctcctggtcttccatggcctctgggagcctcgagcgaatgcgagaaattctgagagcagcacccgtagtttcgttccc

SEQ ID NO: 4532 - DNA, 279 bp, Homo sapiens
  misc_feature 1..279: note = chr18:28621709-28621988
  misc_feature 1..279: note = hyper
  source 1..279: mol_type = genomic DNA
tctcctagaggatttcgtcctgggcggcaggtttccgtagactcgaaaccccaggctgtgctccggccgcgcagtcctccccggagccggagtaagtacgacgcaaccccaccgcatccatcatcccccaccactgtcaccctctacccgcctccacacctcggcagcatccccaaaacacaacacgaccccaacccccattctggcccggtcttcccacactttcgcgcccccggcacatcccgcccccagctgggtggctggcgggggtggaccgct

SEQ ID NO: 4533 - DNA, 63 bp, Homo sapiens
  misc_feature 1..63: note = chr18:31020448-31020511
  misc_feature 1..63: note = hyper
  source 1..63: mol_type = genomic DNA
gggtgaagaactagtcgactctaactccctcagggtggccagggaattgcatttggttctccc

SEQ ID NO: 4534 - DNA, 526 bp, Homo sapiens; identical to SEQ ID NO: 1331
  misc_feature 1..526: note = chr18:31739116-31739642
  misc_feature 1..526: note = hyper
  source 1..526: mol_type = genomic DNA

SEQ ID NO: 4535 - DNA, 122 bp, Homo sapiens
  misc_feature 1..122: note = chr18:35065024-35065146
  misc_feature 1..122: note = hyper
  source 1..122: mol_type = genomic DNA
gctataaaccagggccgaggcgcgatagtttatcaaagacgagggctggctccttaaataaaccgcggtgatctcacttgcggcgccccctcccacgccggccccctcctcccccactagag

SEQ ID NO: 4536 - DNA, 135 bp, Homo sapiens
  misc_feature 1..135: note = chr18:35065516-35065651
  misc_feature 1..135: note = hyper
  source 1..135: mol_type = genomic DNA
cgctctgggccttcagcgctgactcacgctcgcagtaggtgaggaaggcgcagcctggggaggaaagcaagcgccaagaagggtcagtggggcgcccccgggcccgccgacgcgccctgccgcccgccctccagg

SEQ ID NO: 4537 - DNA, 262 bp, Homo sapiens; identical to SEQ ID NO: 1332
  misc_feature 1..262: note = chr18:44336188-44336450
  misc_feature 1..262: note = hyper
  source 1..262: mol_type = genomic DNA

SEQ ID NO: 4538 - DNA, 164 bp, Homo sapiens; identical to SEQ ID NO: 1333
  misc_feature 1..164: note = chr18:44337012-44337176
  misc_feature 1..164: note = hyper
  source 1..164: mol_type = genomic DNA

SEQ ID NO: 4539 - DNA, 202 bp, Homo sapiens; identical to SEQ ID NO: 1334
  misc_feature 1..202: note = chr18:44337416-44337618
  misc_feature 1..202: note = hyper
  source 1..202: mol_type = genomic DNA

SEQ ID NO: 4540 - DNA, 193 bp, Homo sapiens; identical to SEQ ID NO: 1335
  misc_feature 1..193: note = chr18:44337649-44337842
  misc_feature 1..193: note = hyper
  source 1..193: mol_type = genomic DNA

SEQ ID NO: 4541 - DNA, 140 bp, Homo sapiens; identical to SEQ ID NO: 1336
  misc_feature 1..140: note = chr18:44772977-44773117
  misc_feature 1..140: note = hyper
  source 1..140: mol_type = genomic DNA

SEQ ID NO: 4542 - DNA, 501 bp, Homo sapiens; identical to SEQ ID NO: 1337
  misc_feature 1..501: note = chr18:44773466-44773967
  misc_feature 1..501: note = hyper
  source 1..501: mol_type = genomic DNA

SEQ ID NO: 4543 - DNA, 277 bp, Homo sapiens
  misc_feature 1..277: note = chr18:44778049-44778326
  misc_feature 1..277: note = hyper
  source 1..277: mol_type = genomic DNA
ggggacgccacccagcgggcagggtgacgtcaccgtctccctgacactccacattaaagggctggcatgttacagggagggagggggagagcgaaagccagcgcgagcaacagagagatcctttctcagcaggcacgaaagctaccaacctaaccaactcgcaattgacaacaacctcctcagccccggagtaaactgcagcaatggtgctggagccgcagatctgatttaggagtggaaagcgaacagtctgcctgcatcccgggacctagatcct

SEQ ID NO: 4544 - DNA, 68 bp, Homo sapiens
  misc_feature 1..68: note = chr18:44787746-44787814
  misc_feature 1..68: note = hyper
  source 1..68: mol_type = genomic DNA
tagcttgctcagatccgcacccccccactccccacctcagacctctctgacgccgcctgttggtcagg

SEQ ID NO: 4545 - DNA, 98 bp, Homo sapiens
  misc_feature 1..98: note = chr18:44789865-44789963
  misc_feature 1..98: note = hyper
  source 1..98: mol_type = genomic DNA
gccgggctccgcctccggaaggcgggcggggagggtagttgctgggggtccctaggccgggccccaggacatctaggacatgccgggggctgtttgct

SEQ ID NO: 4546 - DNA, 76 bp, Homo sapiens
  misc_feature 1..76: note = chr18:49867303-49867379
  misc_feature 1..76: note = hyper
  source 1..76: mol_type = genomic DNA
tctcatttcatttggcgagtagtagaattggggtgggggatagcaagagatttggcgcttgcgctgcccccatttg

SEQ ID NO: 4547 - DNA, 139 bp, Homo sapiens
  misc_feature 1..139: note = chr18:52989807-52989946
  misc_feature 1..139: note = hyper
  source 1..139: mol_type = genomic DNA
gggccccggcctccccggagctggtgggaagcgcggccgcccatgaacttcacctcgccccgccgcagacagccgcatgggcccagagcctacggaggggctggggcgctgctcccctcgctggcgctgggcgccccaa

SEQ ID NO: 4548 - DNA, 361 bp, Homo sapiens
  misc_feature 1..361: note = chr18:53256942-53257303
  misc_feature 1..361: note = hyper
  source 1..361: mol_type = genomic DNA
caccatggactcccccgtggagtcacattgataataataggtttccctgaaagatacattgtaatccattcacatccgggaactgcgggcttataaagagaaggagctgcggccgcggctgctcctccagacaatgactgggaaggggcggggcgggagcaggcgaccatagagtggtaaacagagcgcctagagaggcggccaagatggcggtgctggtcgaccacgcctcctccgggagcggaggcgggtggctgttctcgggtaggcgtcgcgcgtggggcggcactgtgggagttcccgaggccgaggtcgttcgcaggccccatttccctgcgctcttattcgtgttgccgcttct

SEQ ID NO: 4549 - DNA, 609 bp, Homo sapiens; identical to SEQ ID NO: 1338
  misc_feature 1..609: note = chr18:53446866-53447475
  misc_feature 1..609: note = hyper
  source 1..609: mol_type = genomic DNA

SEQ ID NO: 4550 - DNA, 57 bp, Homo sapiens; identical to SEQ ID NO: 1339
  misc_feature 1..57: note = chr18:53447798-53447855
  misc_feature 1..57: note = hyper
  source 1..57: mol_type = genomic DNA

SEQ ID NO: 4551 - DNA, 102 bp, Homo sapiens
  misc_feature 1..102: note = chr18:55020597-55020699
  misc_feature 1..102: note = hyper
  source 1..102: mol_type = genomic DNA
gcagagatggacaggcgtgaggggagcgccctccccgcgccctgtccgcagactccgcgggccgggcccggggcggtgctggcggtttaatggcgcaggcgc

SEQ ID NO: 4552 - DNA, 141 bp, Homo sapiens
  misc_feature 1..141: note = chr18:55020804-55020945
  misc_feature 1..141: note = hyper
  source 1..141: mol_type = genomic DNA
cgcagccaccgccccccaccagctttccgggatttctgcaattcccccgccccctgcgggaagcgagcctcggaagggccgcccaccctcgccaggtcggagtcaccgctccgcgctgggccggcctgtgaaggctccagg

SEQ ID NO: 4553 - DNA, 277 bp, Homo sapiens
  misc_feature 1..277: note = chr18:55020965-55021242
  misc_feature 1..277: note = hyper
  source 1..277: mol_type = genomic DNA
cgagagcccccgccccgctctgtgaccccgggaactctcccagcagggcctcctgacgggcaggtggcaactacaaagtgccacctgtggtccaagctgggaccgaggcgaggaacccagaggagcctcgcctggaccgaggagcggagtaggccggcggcccccgggggtccccagccaagttataggaagtgaaatcggacgtgggtttgggaaggaagaggttaaggcaggaaccacccccagactttccctgggtctccggtttcctctgccc

SEQ ID NO: 4554 - DNA, 133 bp, Homo sapiens
  misc_feature 1..133: note = chr18:56888490-56888623
  misc_feature 1..133: note = hyper
  source 1..133: mol_type = genomic DNA
cccctagaacccaggcggagaggacggccgcgctgcgggtgcggagggcgcctgcgggtggggtcaggattccgccctgcgcgcactcgctgctttcgctcagctgggaggcaggaagcgcctggcagcctcg

SEQ ID NO: 4555 - DNA, 363 bp, Homo sapiens
  misc_feature 1..363: note = chr18:56934956-56935319
  misc_feature 1..363: note = hyper
  source 1..363: mol_type = genomic DNA
gctcaggcgggagtccgggactctccttcttcagagagtctcaggagattgtgaagcgggctgagatttcgagattccttcctcgccctagagccggcgccaaagaactgcagatactgtccagggcacgcccgcaagaactagctctcggggcggtggcgtagggcgctccaggacactctccgagcgcggcacctcaccagacgcgccttttaccgaactctgggttggcgagtgtggagcgagttggggaggttagagagtctcgcggctccgaaaaggaaaagcatctctttgcctcagttcttgtaccgctggtgatcaaccttgggtgttagggactggcaccgaaccggagatctg

SEQ ID NO: 4556 - DNA, 154 bp, Homo sapiens; identical to SEQ ID NO: 1340
  misc_feature 1..154: note = chr18:56939498-56939652
  misc_feature 1..154: note = hyper
  source 1..154: mol_type = genomic DNA

SEQ ID NO: 4557 - DNA, 408 bp, Homo sapiens; identical to SEQ ID NO: 1341
  misc_feature 1..408: note = chr18:56939763-56940171
  misc_feature 1..408: note = hyper
  source 1..408: mol_type = genomic DNA

SEQ ID NO: 4558 - DNA, 680 bp, Homo sapiens; identical to SEQ ID NO: 1342
  misc_feature 1..680: note = chr18:56940565-56941245
  misc_feature 1..680: note = hyper
  source 1..680: mol_type = genomic DNA

SEQ ID NO: 4559 - DNA, 240 bp, Homo sapiens; identical to SEQ ID NO: 1343
  misc_feature 1..240: note = chr18:56941557-56941797
  misc_feature 1..240: note = hyper
  source 1..240: mol_type = genomic DNA

SEQ ID NO: 4560 - DNA, 515 bp, Homo sapiens
  misc_feature 1..515: note = chr18:59000829-59001344
  misc_feature 1..515: note = hyper
  source 1..515: mol_type = genomic DNA
ccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggcagctacgtgagcagaacgcccgccctggagcagttaggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaagcagggaagctggggcgcaccggggcaggtggaggacgtggcg

SEQ ID NO: 4561 - DNA, 208 bp, Homo sapiens
  misc_feature 1..208: note = chr18:59001497-59001705
  misc_feature 1..208: note = hyper
  source 1..208: mol_type = genomic DNA
cgcacagagatgtgcgccgggaaggggaccagagagccaggctccggggaggcgcaggcacctacggggccgatccctggtccgtgcctcgcgccgcgcccccgccggagctcggctgtgggaggagaatgtggtgggtactcgagtccccgccacctgccggacttcgccaactccccggatttcctgtcctcgggccctgacactc

SEQ ID NO: 4562 - DNA, 235 bp, Homo sapiens
  misc_feature 1..235: note = chr18:60263660-60263895
  misc_feature 1..235: note = hyper
  source 1..235: mol_type = genomic DNA
cgctcccgcgcgggtcagcaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatc

SEQ ID NO: 4563 - DNA, 155 bp, Homo sapiens
  misc_feature 1..155: note = chr18:67067500-67067655
  misc_feature 1..155: note = hyper
  source 1..155: mol_type = genomic DNA
cctagttaacgaaaacgcatgcataaatcaaccactcgggtcggtcggtcttctccactccttcagcagaggacgtcggcgcccggctgcctcgcccgcctgcctgtctctaggctgcgggaggattagacacatgcgcacgattggtctctttg

SEQ ID NO: 4564 - DNA, 182 bp, Homo sapiens; identical to SEQ ID NO: 1344
  misc_feature 1..182: note = chr18:70535373-70535555
  misc_feature 1..182: note = hyper
  source 1..182: mol_type = genomic DNA

SEQ ID NO: 4565 - DNA, 80 bp, Homo sapiens; identical to SEQ ID NO: 1345
  misc_feature 1..80: note = chr18:70535575-70535655
  misc_feature 1..80: note = hyper
  source 1..80: mol_type = genomic DNA

SEQ ID NO: 4566 - DNA, 264 bp, Homo sapiens
  misc_feature 1..264: note = chr18:74961385-74961649
  misc_feature 1..264: note = hyper
  source 1..264: mol_type = genomic DNA
tcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggcccgcggcatccggcag

SEQ ID NO: 4567 - DNA, 78 bp, Homo sapiens; identical to SEQ ID NO: 1346
  misc_feature 1..78: note = chr18:77547970-77548048
  misc_feature 1..78: note = hyper
  source 1..78: mol_type = genomic DNA

SEQ ID NO: 4568 - DNA, 258 bp, Homo sapiens; identical to SEQ ID NO: 1347
  misc_feature 1..258: note = chr18:77548351-77548609
  misc_feature 1..258: note = hyper
  source 1..258: mol_type = genomic DNA

SEQ ID NO: 4569 - DNA, 415 bp, Homo sapiens; identical to SEQ ID NO: 1348
  misc_feature 1..415: note = chr18:77557982-77558397
  misc_feature 1..415: note = hyper
  source 1..415: mol_type = genomic DNA

SEQ ID NO: 4570 - DNA, 726 bp, Homo sapiens; identical to SEQ ID NO: 1349
  misc_feature 1..726: note = chr18:77558416-77559142
  misc_feature 1..726: note = hyper
  source 1..726: mol_type = genomic DNA

SEQ ID NO: 4571 - DNA, 72 bp, Homo sapiens
  misc_feature 1..72: note = chr19:1524442-1524514
  misc_feature 1..72: note = hyper
  source 1..72: mol_type = genomic DNA
cgtgtccgtgggttgcgtgtccggggtgtgggcgtgcggctcggcctcgggatgcgacgctgtgttgcccct

SEQ ID NO: 4572 - DNA, 856 bp, Homo sapiens
  misc_feature 1..856: note = chr19:2252588-2253444
  misc_feature 1..856: note = hyper
  source 1..856: mol_type = genomic DNA
cggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcg

SEQ ID NO: 4573 - DNA, 266 bp, Homo sapiens
  misc_feature 1..266: note = chr19:2290006-2290272
  misc_feature 1..266: note = hyper
  source 1..266: mol_type = genomic DNA
ttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggc

SEQ ID NO: 4574 - DNA, 238 bp, Homo sapiens
  misc_feature 1..238: note = chr19:2290630-2290868
  misc_feature 1..238: note = hyper
  source 1..238: mol_type = genomic DNA
ggggtggcgcaggccggcagccgcccgtcgaagttgagggtcttgcgacgctgcacgatccacagcaggcgacagtcgcaggccagcgggttcccgtccacgcgcagcgtctctagcgtgttcaccgagtggaaggtgctctcctccaacgtggagagcaggttgttggagaggttgagcaggcggatctggcgcaggcccaggaaggcctgcggctccaccacagccagcagggccc

SEQ ID NO: 4575 - DNA, 199 bp, Homo sapiens; identical to SEQ ID NO: 1350
  misc_feature 1..199: note = chr19:3785637-3785836
  misc_feature 1..199: note = hyper
  source 1..199: mol_type = genomic DNA

SEQ ID NO: 4576 - DNA, 357 bp, Homo sapiens; identical to SEQ ID NO: 1351
  misc_feature 1..357: note = chr19:3785864-3786221
  misc_feature 1..357: note = hyper
  source 1..357: mol_type = genomic DNA

SEQ ID NO: 4577 - DNA, 16 bp, Homo sapiens
  misc_feature 1..16: note = chr19:3786583-3786599
  misc_feature 1..16: note = hyper
  source 1..16: mol_type = genomic DNA
gcgcggcggggaccgg

SEQ ID NO: 4578 - DNA, 141 bp, Homo sapiens; identical to SEQ ID NO: 1353
  misc_feature 1..141: note = chr19:6590370-6590511
  misc_feature 1..141: note = hyper
  source 1..141: mol_type = genomic DNA

SEQ ID NO: 4579 - DNA, 118 bp, Homo sapiens; identical to SEQ ID NO: 1354
  misc_feature 1..118: note = chr19:9473938-9474056
  misc_feature 1..118: note = hyper
  source 1..118: mol_type = genomic DNA

SEQ ID NO: 4580 - DNA, 40 bp, Homo sapiens
  misc_feature 1..40: note = chr19:9609379-9609419
  misc_feature 1..40: note = hyper
  source 1..40: mol_type = genomic DNA
attctagtttccctccgcgtgggtgcggaggtatcaaggg

SEQ ID NO: 4581 - skipped

SEQ ID NO: 4582 - DNA, 133 bp, Homo sapiens
  misc_feature 1..133: note = chr19:10406278-10406411
  misc_feature 1..133: note = hyper
  source 1..133: mol_type = genomic DNA
cgcgtggccggtaagtggcagctggggagaggcggggcgaggtatctgagagggggcgtgacctgggtcttggggcggccggccccgcctgcctccctctcggtcccggtagactagacggaagtgggacaga

SEQ ID NO: 4583 - skipped

SEQ ID NO: 4584 - DNA, 443 bp, Homo sapiens; identical to SEQ ID NO: 1356
  misc_feature 1..443: note = chr19:10624965-10625408
  misc_feature 1..443: note = hyper
  source 1..443: mol_type = genomic DNA

SEQ ID NO: 4585 - DNA, 154 bp, Homo sapiens
  misc_feature 1..154: note = chr19:11591031-11591185
  misc_feature 1..154: note = hyper
  source 1..154: mol_type = genomic DNA
cccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctccc

SEQ ID NO: 4586 - DNA, 585 bp, Homo sapiens
  misc_feature 1..585: note = chr19:11592710-11593295
  misc_feature 1..585: note = hyper
  source 1..585: mol_type = genomic DNA
gccggtgcatgtttacgtcggggcgcgggaactagcacacactggggcggggtcgccagggcgtgaggcttcagcaccacagacagcaatccgacagtccggtcgagggcgctgccggcgaggtagcccagaccccctaactggagagcggcagtccccacccaatcctcgttcctgcacgccctttaggctccagactgtcagagagcgccaccagcgaggagagcctaatttgcccaatcaggggcggcccttgagataaccagttactggaagatgccctagagatcgagccaatgggagtgcgcgcaccaggggatgctgccacgcctggaaagggcaggccaatcgcagtggcccgcgcaataggggcggtggcggtgcagatccccgggtggcccctcttgggctcgccggggcgacctggctgcgggcgctaggggccccaagcgatggtctgttccccaccccgtgttcctcccggtttccgtcatcggaaactgagctaggaggggggctgctcctgggcgcgcggaccccgctgcggttcccatggaaacctgccggctccggcagtgcggggag

SEQ ID NO: 4587 - DNA, 97 bp, Homo sapiens
  misc_feature 1..97: note = chr19:11959663-11959760
  misc_feature 1..97: note = hyper
  source 1..97: mol_type = genomic DNA
tcgctctgtcacctgcgctatgccctgctttactcacaggagctgtagagaggaccccggtacatctgaaagccgggaaatggtgcgtgtgctggcc

SEQ ID NO: 4588 - DNA, 272 bp, Homo sapiens
  misc_feature 1..272: note = chr19:11959761-11960033
  misc_feature 1..272: note = hyper
  source 1..272: mol_type = genomic DNA
ggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcg

SEQ ID NO: 4589 - DNA, 336 bp, Homo sapiens; identical to SEQ ID NO: 1357
  misc_feature 1..336: note = chr19:12203013-12203349
  misc_feature 1..336: note = hyper
  source 1..336: mol_type = genomic DNA

SEQ ID NO: 4590 - DNA, 343 bp, Homo sapiens; identical to SEQ ID NO: 1358
  misc_feature 1..343: note = chr19:12203350-12203693
  misc_feature 1..343: note = hyper
  source 1..343: mol_type = genomic DNA

SEQ ID NO: 4591 - DNA, 289 bp, Homo sapiens
  misc_feature 1..289: note = chr19:12267019-12267308
  misc_feature 1..289: note = hyper
  source 1..289: mol_type = genomic DNA
cacgaaccacacacccgaggcaggattgcctccatgaccctcccgtggtctccgcacaatctggggagacgcgggactacgggcgcggagctccccagagagggctccggggccggggccagggccggggtcgcagtcgcagcgcagagacgggacaggacgcctggggtcccggctgccggcccaaccccaccctgcggccgaagggaccgagggccgagctacgccagggggactccgctctgcagacccgaagtcgctgcaggaaggcctgggtcctgctagagcc

SEQ ID NO: 4592 - DNA, 342 bp, Homo sapiens
  misc_feature 1..342: note = chr19:12267309-12267651
  misc_feature 1..342: note = hyper
  source 1..342: mol_type = genomic DNA
gttcgagccggttcctcccggcccctcccccgtctcgggacccccggccccgcacactcaccatttcccggcttccaggtgtcctggcctcctctccacggatccctctaacagtccagtcacagtgcgggcgatggagcgacagaagctatggcggaggcacctggtccctctcggggccggaaaaccgagatcccgacctccctttggtgcaagacgcctgggagtcaggaaagcgggaatgcggcctccccttccccggatggacagttggcaggaccccgccccagcgcccctgattggatgaggctccagtccccgtcccatcggtcctgagtgaca

SEQ ID NO: 4593 - DNA, 15 bp, Homo sapiens
  misc_feature 1..15: note = chr19:12306229-12306244
  misc_feature 1..15: note = hyper
  source 1..15: mol_type = genomic DNA
cgtgtctccccagat

SEQ ID NO: 4594 - DNA, 261 bp, Homo sapiens; identical to SEQ ID NO: 1359
  misc_feature 1..261: note = chr19:13616696-13616957
  misc_feature 1..261: note = hyper
  source 1..261: mol_type = genomic DNA

SEQ ID NO: 4595 - DNA, 307 bp, Homo sapiens; identical to SEQ ID NO: 1360
  misc_feature 1..307: note = chr19:13617158-13617465
  misc_feature 1..307: note = hyper
  source 1..307: mol_type = genomic DNA

SEQ ID NO: 4596 - DNA, 29 bp, Homo sapiens
  misc_feature 1..29: note = chr19:13617489-13617518
  misc_feature 1..29: note = hyper
  source 1..29: mol_type = genomic DNA
cggtttgcaaaggacgccccccccgggac

SEQ ID NO: 4597 - DNA, 173 bp, Homo sapiens
  misc_feature 1..173: note = chr19:14584240-14584413
  misc_feature 1..173: note = hyper
  source 1..173: mol_type = genomic DNA
ggcccaccatctccacgtcgtgggcgcgagctctgcgtgccgagccgctgctccgagagccgccaaagaaggtggaggccgaagcgatggacgaggcggacgaggcggaggccgagcggggtccgtgcgccccccagcgacgccggctgtcggggcctgaggccgggggaggc

SEQ ID NO: 4598 - DNA, 26 bp, Homo sapiens
  misc_feature 1..26: note = chr19:14584536-14584562
  misc_feature 1..26: note = hyper
  source 1..26: mol_type = genomic DNA
cgccagccgcccgggggacccaggcc

SEQ ID NO: 4599 - DNA, 477 bp, Homo sapiens
  misc_feature 1..477: note = chr19:15090075-15090552
  misc_feature 1..477: note = hyper
  source 1..477: mol_type = genomic DNA
acgggcagggagacccggggataactaaggggataggaaactcaccagaacgaccaggagaaaagcggtggcaacggctctaaggggcaagcaggagctcagagacaaagggcggcggagaagtggggacgtgggcgcagggagcgccccacacgcctgaccccagcgcctcggatcccccacctgcccgcaacctccgcgccgcagccacaccgagtccccgcgccgagccgcggagtccccactcaccggcgtccggagcggcgggggcggcctgcccgcgcctcggcctgcgcgctgcgcccggatgcaggagccggagcccggcgaagcgcccggccggggccgcggggacccgccagggactgtgcagcaccggcgcggggaccggaccgtggaggcaccggcgcggagccgggacgcgctatgctgcgggagggatccgggccggccctgcgctcacgtgggtgtgggggc

SEQ ID NO: 4600 - DNA, 138 bp, Homo sapiens; identical to SEQ ID NO: 1362
  misc_feature 1..138: note = chr19:17007251-17007389
  misc_feature 1..138: note = hyper
  source 1..138: mol_type = genomic DNA

SEQ ID NO: 4601 - DNA, 347 bp, Homo sapiens; identical to SEQ ID NO: 1363
  misc_feature 1..347: note = chr19:17007446-17007793
  misc_feature 1..347: note = hyper
  source 1..347: mol_type = genomic DNA

SEQ ID NO: 4602 - DNA, 44 bp, Homo sapiens
  misc_feature 1..44: note = chr19:17008475-17008519
  misc_feature 1..44: note = hyper
  source 1..44: mol_type = genomic DNA
gggcggcagtggctccgcgcactcacccgggccccgggcagggg

SEQ ID NO: 4603 - DNA, 114 bp, Homo sapiens
  misc_feature 1..114: note = chr19:17008585-17008699
  misc_feature 1..114: note = hyper
  source 1..114: mol_type = genomic DNA
cgttgtagaagcgagtggcctcgaaggctacgggacgagggtggcgggtgaccaagtgcaggcgcgacgggtcagggaccgggccgggccgggggtgcgggcgcgcgggcctac

SEQ ID NO: 4604 - DNA, 398 bp, Homo sapiens
  misc_feature 1..398: note = chr19:17501241-17501639
  misc_feature 1..398: note = hyper
  source 1..398: mol_type = genomic DNA
ctctatacacgtccccgcagaccccccccccatatgtgtcctccaggccgacgcccccttccggcagggggccgactcaccctcgtgcgcgccgcgccggccgccggcagcccccggagggtccggagcgagagcgcgagcgagggctgggccggggtcgggaccccgagcggggacgcggccggggcactctgcgctgtgggctcatctcggcttccaggacgttactgccgggaagggggaagggggctgtcagcctctggacccctgtccccagacatcgccagccctcatccgccagagcgtccctttgctgggaactccatccccagagatccccatctcccagggtttcccgctccccaggatccggcatccgttctcgacccccagccatt

SEQ ID NO: 4605 - DNA, 606 bp, Homo sapiens
  misc_feature 1..606: note = chr19:18901603-18902209
  misc_feature 1..606: note = hyper
  source 1..606: mol_type = genomic DNA
actgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacctccgaggccccactgcgctcctctagtctcggtcccgccacctgctttctgcgcccggcacgtcccctacgaacagtccgtgagccccaaacagcctggatcccgggcctctcacgggtcctacagtccgttgtggggccgtgggcacggcgcgggtgctaacgcggcttacccaacgggctctggccctgtccggacgcgccgagggcagccagggtgagcagaagaacgcaggcggtgtcggggaccatggcggtggcggggagctgggtggctgctcgctttctaccgcccacgaggcccgcggggcctatttatccccaaggcacggccggccccagggacggcccaccacagccctgcccaacgtccagcctcaagg

SEQ ID NO: 4606 - DNA, 336 bp, Homo sapiens
  misc_feature 1..336: note = chr19:19651512-19651848
  misc_feature 1..336: note = hyper
  source 1..336: mol_type = genomic DNA
cgtcaggaggcccagcgggtcaggacccatgtccggccccctggaacgcatctccctcccgctgccctcatttgagcatctgtaagagctcagttctgtggagtgtcttgagcccaaatgcgtgcaggatgcagggagaaaagcaggactgatccccgggaccttatgcgggggtggggaggtgggtcggtacctaaactatgtcttcgacaggcgcgcctaggggagcatgggtgggggcgatggcagatctgctctctggagtgtccgcccttggatgcacatatgtgagggggttggggaagaagggtcctttagtcccaggttacccggagg

SEQ ID NO: 4607 - DNA, 50 bp, Homo sapiens
  misc_feature 1..50: note = chr19:19651990-19652040
  misc_feature 1..50: note = hyper
  source 1..50: mol_type = genomic DNA
cgctggggatgcgtgtcccgggcgtcctctggaggcgcagaagtgcgtgc

SEQ ID NO: 4608 - DNA, 300 bp, Homo sapiens
  misc_feature 1..300: note = chr19:22018420-22018720
  misc_feature 1..300: note = hyper
  source 1..300: mol_type = genomic DNA
tgctgggattaaaggcgtgacccaccgcgcccggccgactctcctgtttctaatagaccaaaagagggactagaaatgccacggaccaaagctcttcctattcatgaaactgcatcacgagtcaggattctctcctgacgaccctcctgtggcccctgcacaatttgggagagacgccgcgttgcggctgcagagctgcccacagagggctgcaggccgggacacagtcactgcgcagagaagagacaggacgcccggggctgcctcccagagcagccgccatcttatggctgaagggga

SEQ ID NO: 4609 - DNA, 58 bp, Homo sapiens
  misc_feature 1..58: note = chr19:22018900-22018958
  misc_feature 1..58: note = hyper
  source 1..58: mol_type = genomic DNA
cagagccacagaggctggacctctagcagcagaggacacagaagaacgaagacgagac

SEQ ID NO: 4610 - DNA, 61 bp, Homo sapiens
  misc_feature 1..61: note = chr19:22018959-22019020
  misc_feature 1..61: note = hyper
  source 1..61: mol_type = genomic DNA
cagagctccaactgcagccagagacaaaggccccgccacatcccggaagccgccctgtcct

SEQ ID NO: 4611 - DNA, 28 bp, Homo sapiens
  misc_feature 1..28: note = chr19:22019080-22019108
  misc_feature 1..28: note = hyper
  source 1..28: mol_type = genomic DNA
aaggtcctgcccccgcaaaccctgaatg

SEQ ID NO: 4612 - DNA, 39 bp, Homo sapiens
  misc_feature 1..39: note = chr19:22034379-22034418
  misc_feature 1..39: note = hyper
  source 1..39: mol_type = genomic DNA
tgaagaccccagggccgcagctcctcctgcgcacacacc

SEQ ID NO: 4613 - skipped

SEQ ID NO: 4614 - DNA, 592 bp, Homo sapiens
  misc_feature 1..592: note = chr19:22034446-22035038
  misc_feature 1..592: note = hyper
  source 1..592: mol_type = genomic DNA
cgggcatccctgaacaatctgggaaatactcggggctgctggtgcagagctgaccagagagctccagacagggtaccgcgcaggaatggggcgggacgcgggaggctcggctgcgggcccagccgccatcttgcggccagaggggcctggggcggagctgcgccagcgaccaggactcaggagcggactgtgaggaggccggtcccgccactttcacagcctgctctcccctctcgggatgcctaaccccgcacactcaccatttcccagcttccaggatgtccgggcatcttagctgtgcgtctcccaggacttgcagatcacagggtaacggaggctgcgacaaagtcaccggggattcccgagttggagaacgcggaaaagcagaggcgggtcccaaggtctagcgggagctggagacaaaggccccgccaaaagccggaagccacggccccctctccaactgcgcgtctgattgggtggttcccacgccagcgccactgattggataaagctccaggacccaccctccctagcgtttgcgcattttatggacagggaaacaggctcaagtaggcggggcacatgccca

SEQ ID NO: 4615 - DNA, 256 bp, Homo sapiens; identical to SEQ ID NO: 1364
  misc_feature 1..256: note = chr19:23257752-23258008
  misc_feature 1..256: note = hyper
  source 1..256: mol_type = genomic DNA

SEQ ID NO: 4616 - DNA, 287 bp, Homo sapiens; identical to SEQ ID NO: 1365
  misc_feature 1..287: note = chr19:23258305-23258592
  misc_feature 1..287: note = hyper
  source 1..287: mol_type = genomic DNA

SEQ ID NO: 4617 - DNA, 79 bp, Homo sapiens; identical to SEQ ID NO: 1366
  misc_feature 1..79: note = chr19:23258652-23258731
  misc_feature 1..79: note = hyper
  source 1..79: mol_type = genomic DNA

SEQ ID NO: 4618 - DNA, 218 bp, Homo sapiens
  misc_feature 1..218: note = chr19:23299712-23299930
  misc_feature 1..218: note = hyper
  source 1..218: mol_type = genomic DNA
cagggcctgagggggcggggccttaaacgttatccaatcggggacactgggcggggggccgtccaatcaggcccgcagctggagcagacagggcggcttccgggatttggcgcggcctttgtttctcgctgccgccgaagctccaattttcgtctgtctgctttgtgtcctctgcacgtagaagcccagcctgtgtggccctgcgacctgcgggtatt

SEQ ID NO: 4619 - DNA, 391 bp, Homo sapiens; identical to SEQ ID NO: 1367
  misc_feature 1..391: note = chr19:30015572-30015963
  misc_feature 1..391: note = hyper
  source 1..391: mol_type = genomic DNA

SEQ ID NO: 4620 - DNA, 724 bp, Homo sapiens; identical to SEQ ID NO: 1368
  misc_feature 1..724: note = chr19:30016024-30016748
  misc_feature 1..724: note = hyper
  source 1..724: mol_type = genomic DNA

SEQ ID NO: 4621 - DNA, 59 bp, Homo sapiens; identical to SEQ ID NO: 1369
  misc_feature 1..59: note = chr19:30017451-30017510
  misc_feature 1..59: note = hyper
  source 1..59: mol_type = genomic DNA

SEQ ID NO: 4622 - DNA, 145 bp, Homo sapiens; identical to SEQ ID NO: 1370
  misc_feature 1..145: note = chr19:30017577-30017722
  misc_feature 1..145: note = hyper
  source 1..145: mol_type = genomic DNA

SEQ ID NO: 4623 - DNA, 967 bp, Homo sapiens; identical to SEQ ID NO: 1371
  misc_feature 1..967: note = chr19:30017765-30018732
  misc_feature 1..967: note = hyper
  source 1..967: mol_type = genomic DNA

SEQ ID NO: 4624 - DNA, 416 bp, Homo sapiens; identical to SEQ ID NO: 1372
  misc_feature 1..416: note = chr19:30019113-30019529
  misc_feature 1..416: note = hyper
  source 1..416: mol_type = genomic DNA

SEQ ID NO: 4625 - DNA, 81 bp, Homo sapiens; identical to SEQ ID NO: 1373
  misc_feature 1..81: note = chr19:30019530-30019611
  misc_feature 1..81: note = hyper
  source 1..81: mol_type = genomic DNA

SEQ ID NO: 4626 - DNA, 252 bp, Homo sapiens; identical to SEQ ID NO: 1374
  misc_feature 1..252: note = chr19:30019660-30019912
  misc_feature 1..252: note = hyper
  source 1..252: mol_type = genomic DNA

SEQ ID NO: 4627 - DNA, 153 bp, Homo sapiens
  misc_feature 1..153: note = chr19:30020190-30020343
  misc_feature 1..153: note = hyper
  source 1..153: mol_type = genomic DNA
gttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaag

SEQ ID NO: 4628 - DNA, 135 bp, Homo sapiens
  misc_feature 1..135: note = chr19:30713458-30713593
  misc_feature 1..135: note = hyper
  source 1..135: mol_type = genomic DNA
gaggcatgcagagggcgtcggcgccgacagggggagccggagagccccctgcccggccgtctgcggggctcaggcggggcttggcctccgatgagcgcgctgtctctgcccggtgggtcccaccccgcccggcca

SEQ ID NO: 4629 - DNA, 123 bp, Homo sapiens
  misc_feature 1..123: note = chr19:30713685-30713808
  misc_feature 1..123: note = hyper
  source 1..123: mol_type = genomic DNA
cgaggccgcagaagccttgggcctccaggcctggaaggggctcccctggcctggaggccatgggcccggcccagaccggccagacaccgccagggacccccagaacgacgccaggacgcgcgc

SEQ ID NO: 4630 - DNA, 476 bp, Homo sapiens
  misc_feature 1..476: note = chr19:30715393-30715869
  misc_feature 1..476: note = hyper
  source 1..476: mol_type = genomic DNA
agagaacctgcgtgacgtttttctcgaagtttaattaccgtatgctaatttccttgcctactacgtgattaattaaaatcatattttcataatcatttggcactagtattgttttagaattatcatgatctcctaaatagtgtctgtaaataaagtcgcctctaatggcaggcgcgggaggcgaggctgaggacctctccgcgtttgtatcgcggcgattggcaacataactgccttatttacattaaatacgccacaaggttacagcgcggatcaacgtcatttgatcgctgatgactcccttaaacgcccgggctgtgactgattcttcgcgtcccgctgtccaccgagattcacccgggagtttttttttttttttttttttttcctcccagaaaagaaacagactttaaatagtttcaggagcaggtaagaattacgctttttcctcgccccttctccgtctctctctcctc

SEQ ID NO: 4631 - DNA, 457 bp, Homo sapiens; identical to SEQ ID NO: 1375
  misc_feature 1..457: note = chr19:30716313-30716770
  misc_feature 1..457: note = hyper
  source 1..457: mol_type = genomic DNA

SEQ ID NO: 4632 - DNA, 779 bp, Homo sapiens; identical to SEQ ID NO: 1376
  misc_feature 1..779: note = chr19:30716952-30717731
  misc_feature 1..779: note = hyper
  source 1..779: mol_type = genomic DNA

SEQ ID NO: 4633 - DNA, 756 bp, Homo sapiens; identical to SEQ ID NO: 1377
  misc_feature 1..756: note = chr19:30719283-30720039
  misc_feature 1..756: note = hyper
  source 1..756: mol_type = genomic DNA

SEQ ID NO: 4634 - DNA, 330 bp, Homo sapiens
  misc_feature 1..330: note = chr19:30865695-30866025
  misc_feature 1..330: note = hyper
  source 1..330: mol_type = genomic DNA
gaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccc

SEQ ID NO: 4635 - DNA, 146 bp, Homo sapiens
  misc_feature 1..146: note = chr19:32715595-32715741
  misc_feature 1..146: note = hyper
  source 1..146: mol_type = genomic DNA
taaatatgttcattccgctcttgcgatcggtgataaaccggaggcggccgaggccgacagaggtcagcaggccgctcgccacgggtctgcgagcggacactgccaccctccggccgcgcgcgggactgcaccggccccaccgcccg

SEQ ID NO: 4636 - DNA, 360 bp, Homo sapiens
  misc_feature 1..360: note = chr19:33166988-33167348
  misc_feature 1..360: note = hyper
  source 1..360: mol_type = genomic DNA
cgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgc

SEQ ID NO: 4637 - DNA, 507 bp, Homo sapiens
  misc_feature 1..507: note = chr19:36048580-36049087
  misc_feature 1..507: note = hyper
  source 1..507: mol_type = genomic DNA
ccaggctgaggtaggcggtctggaaggcctcgcgccactgctcgtccagcggcagctcctggcccttgataaggatggagctgcagcgctccagcacgcgctcgggggcgcccttcatcaccagcaagtgtcgcgggtcccgcgggtcctccagcgtatggatggacagctgtgggcgggggggagaggcgaggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtg

SEQ ID NO: 4638 - DNA, 174 bp, Homo sapiens
  misc_feature 1..174: note = chr19:36450122-36450296
  misc_feature 1..174: note = hyper
  source 1..174: mol_type = genomic DNA
gcgctgtgcaagcagcgacgtcgcggcccgaggaagtggaggcggtgaacgcgcgtgggcgcgcctcccgggacacggcgctggctctgcggcgctacctgctgggcactccctaatcgatggtgacgccgtcgctgccgcccggcgaccggcacaaggagtttgcggtggtgg

SEQ ID NO: 4639 - DNA, 15 bp, Homo sapiens
  misc_feature 1..15: note = chr19:36450544-36450559
  misc_feature 1..15: note = hyper
  source 1..15: mol_type = genomic DNA
cgccccagggtcgct

SEQ ID NO: 4640 - DNA, 73 bp, Homo sapiens
  misc_feature 1..73: note = chr19:36523333-36523406
  misc_feature 1..73: note = hyper
  source 1..73: mol_type = genomic DNA
gctggagagggtgcccggcaggctccagggtccaagcccctaggagcttccagggccccgggtggcctccgcg

SEQ ID NO: 4641 - DNA, 84 bp, Homo sapiens
  misc_feature 1..84: note = chr19:36736319-36736403
  misc_feature 1..84: note = hyper
  source 1..84: mol_type = genomic DNA
cccacccagaaaatccggatcacatttcccgtggtccaccgcgcatctaggaggttacctgcgtccaggcggtgacttgcgagg

SEQ ID NO: 4642 - DNA, 225 bp, Homo sapiens
  misc_feature 1..225: note = chr19:36822242-36822467
  misc_feature 1..225: note = hyper
  source 1..225: mol_type = genomic DNA
ataaacctcaacctgcgggtcactccctcccaggcgtgcaacaaaacacctgcctagaaatcaaaaggcgttttacccgagtgggctgaaaaagccccgtttttacctttaatctggagacaatacgggtcagaggtcaggaaactacatcagcgccagtgcgagcgcccacgagtccggtggacggatgagaaacggccggggggcagcctgagtcccagttcc

SEQ ID NO: 4643 - DNA, 146 bp, Homo sapiens
  misc_feature 1..146: note = chr19:36822557-36822703
  misc_feature 1..146: note = hyper
  source 1..146: mol_type = genomic DNA
cgtggccgaatagcccaagactgaggactcacacttcccactttgcacctggaggccacctgcagaccaaccttgcgccaggcttccggaaatgggagggcgggcttccggaaacggcggccaatgggaaacgtgatcagatgtta

SEQ ID NO: 4644 - DNA, 280 bp, Homo sapiens; identical to SEQ ID NO: 1378
  misc_feature 1..280: note = chr19:36909069-36909349
  misc_feature 1..280: note = hyper
  source 1..280: mol_type = genomic DNA

SEQ ID NO: 4645 - DNA, 244 bp, Homo sapiens; identical to SEQ ID NO: 1379
  misc_feature 1..244: note = chr19:36909623-36909867
  misc_feature 1..244: note = hyper
  source 1..244: mol_type = genomic DNA

SEQ ID NO: 4646 - DNA, 33 bp, Homo sapiens
  misc_feature 1..33: note = chr19:37096487-37096520
  misc_feature 1..33: note = hyper
  source 1..33: mol_type = genomic DNA
gcgaagggggattttgcccgttctgatcccgcg

SEQ ID NO: 4647 - DNA, 171 bp, Homo sapiens; identical to SEQ ID NO: 1380
  misc_feature 1..171: note = chr19:37264222-37264393
  misc_feature 1..171: note = hyper
  source 1..171: mol_type = genomic DNA

SEQ ID NO: 4648 - DNA, 25 bp, Homo sapiens
  misc_feature 1..25: note = chr19:37287936-37287961
  misc_feature 1..25: note = hyper
  source 1..25: mol_type = genomic DNA
tttgttttttgaaaccgagtttcgc

SEQ ID NO: 4649 - DNA, 224 bp, Homo sapiens; identical to SEQ ID NO: 1382
  misc_feature 1..224: note = chr19:37288201-37288425
  misc_feature 1..224: note = hyper
  source 1..224: mol_type = genomic DNA

SEQ ID NO: 4650 - DNA, 99 bp, Homo sapiens; identical to SEQ ID NO: 1383
  misc_feature 1..99: note = chr19:37288606-37288705
  misc_feature 1..99: note = hyper
  source 1..99: mol_type = genomic DNA

SEQ ID NO: 4651 - DNA, 59 bp, Homo sapiens; identical to SEQ ID NO: 1384
  misc_feature 1..59: note = chr19:37288706-37288765
  misc_feature 1..59: note = hyper
  source 1..59: mol_type = genomic DNA

SEQ ID NO: 4652 - DNA, 108 bp, Homo sapiens
  misc_feature 1..108: note = chr19:37406765-37406873
  misc_feature 1..108: note = hyper
  source 1..108: mol_type = genomic DNA
ctccacctttcaggccgctccgcccgcaggggcccaaggcgccagctccccatcggtcttcggtatcctcacctaagccctttccagtcatcccggatgggaacttgc

SEQ ID NO: 4653 - DNA, 71 bp, Homo sapiens; identical to SEQ ID NO: 1385
  misc_feature 1..71: note = chr19:37407081-37407152
  misc_feature 1..71: note = hyper
  source 1..71: mol_type = genomic DNA

SEQ ID NO: 4654 - DNA, 221 bp, Homo sapiens; identical to SEQ ID NO: 1386
  misc_feature 1..221: note = chr19:37407153-37407374
  misc_feature 1..221: note = hyper
  source 1..221: mol_type = genomic DNA

SEQ ID NO: 4655 - DNA, 68 bp, Homo sapiens; identical to SEQ ID NO: 1387
  misc_feature 1..68: note = chr19:37407375-37407443
  misc_feature 1..68: note = hyper
  source 1..68: mol_type = genomic DNA

SEQ ID NO: 4656 - DNA, 153 bp, Homo sapiens
  misc_feature 1..153: note = chr19:37997838-37997991
  misc_feature 1..153: note = hyper
  source 1..153: mol_type = genomic DNA
ccattcaggatgggacgaccttataccgcggtgaggcggcgtggcaggacgaccaatttcagattcagggcgcggatgcagcataaatgggaaggcacggtttgagaaacggtcaaacctgggactagtggaggatagtgagctgccgactac

SEQ ID NO: 4657 - DNA, 117 bp, Homo sapiens
  misc_feature 1..117: note = chr19:37997992-37998109
  misc_feature 1..117: note = hyper
  source 1..117: mol_type = genomic DNA
gtggccgactgggtcagctatgggtgcccgtgagggtcaatgacaagggaactgaagggttaagagattcggcgtctgagcctcgcggggcctcagtggtggcggacagaggtttgc

SEQ ID NO: 4658 - DNA, 201 bp, Homo sapiens
  misc_feature 1..201: note = chr19:38042365-38042566
  misc_feature 1..201: note = hyper
  source 1..201: mol_type = genomic DNA
tggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcga

SEQ ID NO: 4659 - DNA, 34 bp, Homo sapiens
  misc_feature 1..34: note = chr19:38183440-38183474
  misc_feature 1..34: note = hyper
  source 1..34: mol_type = genomic DNA
cttttaaatacaccccgaacgtctatctctttta

SEQ ID NO: 4660 - DNA, 347 bp, Homo sapiens; identical to SEQ ID NO: 1388
  misc_feature 1..347: note = chr19:39754886-39755233
  misc_feature 1..347: note = hyper
  source 1..347: mol_type = genomic DNA

SEQ ID NO: 4661 - DNA, 156 bp, Homo sapiens; identical to SEQ ID NO: 1389
  misc_feature 1..156: note = chr19:39755264-39755420
  misc_feature 1..156: note = hyper
  source 1..156: mol_type = genomic DNA

SEQ ID NO: 4662 - DNA, 223 bp, Homo sapiens
  misc_feature 1..223: note = chr19:39993434-39993657
  misc_feature 1..223: note = hyper
  source 1..223: mol_type = genomic DNA
tcctttgcctgtcctcgcagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactg

SEQ ID NO: 4663 - DNA, 32 bp, Homo sapiens
  misc_feature 1..32: note = chr19:39997701-39997733
  misc_feature 1..32: note = hyper
  source 1..32: mol_type = genomic DNA
cacgccctgcgctgccgctgccgcgccggctt

SEQ ID NO: 4664 - DNA, 238 bp, Homo sapiens
  misc_feature 1..238: note = chr19:39997748-39997986
  misc_feature 1..238: note = hyper
  source 1..238: mol_type = genomic DNA
cgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttccca

SEQ ID NO: 4665 - DNA, 279 bp, Homo sapiens
  misc_feature 1..279: note = chr19:40724000-40724279
  misc_feature 1..279: note = hyper
  source 1..279: mol_type = genomic DNA
cttcagctgcagcagcgctcggtggtacttgccgatggcctcccggaacttcttctctcgatagcagcgctggccctctgccttgaacgccacggcggcacgcaggctgctgtcgagcgccgcgcccaggctccccgacggctctggggtaggaccgggacgagccgagccatggcgggagcccgagcctgggcccgagcccggtggggagagggcgggaggcgggcgcggcggaggctccggggcagcgctgagcatcagcaccggggacagcgcgcc

SEQ ID NO: 4666 - DNA, 111 bp, Homo sapiens
  misc_feature 1..111: note = chr19:41073569-41073680
  misc_feature 1..111: note = hyper
  source 1..111: mol_type = genomic DNA
tcgagaaaatcaaagcggaacagagcaagcagccgcctaccccactgctggggcgcaagttctttggggaccccacggaactggcggccaaggcggcgcccctgctgcggc

SEQ ID NO: 4667 - DNA, 616 bp, Homo sapiens; identical to SEQ ID NO: 1390
  misc_feature 1..616: note = chr19:45655778-45656394
  misc_feature 1..616: note = hyper
  source 1..616: mol_type = genomic DNA

SEQ ID NO: 4668 - DNA, 61 bp, Homo sapiens
  misc_feature 1..61: note = chr19:45656682-45656743
  misc_feature 1..61: note = hyper
  source 1..61: mol_type = genomic DNA
gccgacaatgccactcgctctggcagcagtcctgcctggtggccggcttgttgcccagcac

SEQ ID NO: 4669 - DNA, 166 bp, Homo sapiens
  misc_feature 1..166: note = chr19:45656790-45656956
  misc_feature 1..166: note = hyper
  source 1..166: mol_type = genomic DNA
cgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagcc

SEQ ID NO: 4670 - DNA, 361 bp, Homo sapiens; identical to SEQ ID NO: 1391
  misc_feature 1..361: note = chr19:45888864-45889225
  misc_feature 1..361: note = hyper
  source 1..361: mol_type = genomic DNA

SEQ ID NO: 4671 - DNA, 82 bp, Homo sapiens; identical to SEQ ID NO: 1392
  misc_feature 1..82: note = chr19:45889315-45889397
  misc_feature 1..82: note = hyper
  source 1..82: mol_type = genomic DNA

SEQ ID NO: 4672 - DNA, 197 bp, Homo sapiens
  misc_feature 1..197: note = chr19:46916791-46916988
  misc_feature 1..197: note = hyper
  source 1..197: mol_type = genomic DNA
gcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccc

SEQ ID NO: 4673 - DNA, 78 bp, Homo sapiens; identical to SEQ ID NO: 1393
  misc_feature 1..78: note = chr19:48918201-48918279
  misc_feature 1..78: note = hyper
  source 1..78: mol_type = genomic DNA

SEQ ID NO: 4674 - DNA, 186 bp, Homo sapiens
  misc_feature 1..186: note = chr19:49925774-49925960
  misc_feature 1..186: note = hyper
  source 1..186: mol_type = genomic DNA
ggcggcgctcgagggcggccagcaaccgcgcgcgctcccggaaggccgcgtcgtccgccagcgccaggctcctccgcggcctgggggtggcgggatccgcccaggcccgtcctggggggcggaggctgtggagagacgcggtgaccgcgcgtccagactcgctcttgccgccgcctgtcctccccg

SEQ ID NO: 4675 - DNA, 290 bp, Homo sapiens
  misc_feature 1..290: note = chr19:50554012-50554302
  misc_feature 1..290: note = hyper
  source 1..290: mol_type = genomic DNA
cggatcggcctcccacgcgaagcttgctccccaccagcatccccacgttggtggcgacgctgccccggccccacggatacttccgcgcctgtcagactccctgatgaactacccttcccagagtaccgcgggagctcgggctcctgagggcgacggtcctctgatggcagatgcgggagaaactctggcgtcaggcggccctcgcgtggagcacacgaagtcgtggcttattctggcttcagtatgtggggtggagaaggcgatccacgcagctgcgtctatttcctgtg

SEQ ID NO: 4676 - DNA, 26 bp, Homo sapiens
  misc_feature 1..26: note = chr19:51162427-51162453
  misc_feature 1..26: note = hyper
  source 1..26: mol_type = genomic DNA
gcaccgccccgcgggctggggccacc

SEQ ID NO: 4677 - DNA, 206 bp, Homo sapiens
  misc_feature 1..206: note = chr19:51227602-51227808
  misc_feature 1..206: note = hyper
  source 1..206: mol_type = genomic DNA
ggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagc

SEQ ID NO: 4678 - DNA, 21 bp, Homo sapiens
  misc_feature 1..21: note = chr19:51228248-51228269
  misc_feature 1..21: note = hyper
  source 1..21: mol_type = genomic DNA
gcctccttctctacccggccc

SEQ ID NO: 4679 - DNA, 271 bp, Homo sapiens
  misc_feature 1..271: note = chr19:51228368-51228639
  misc_feature 1..271: note = hyper
  source 1..271: mol_type = genomic DNA
cgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactg

SEQ ID NO: 4680 - DNA, 91 bp, Homo sapiens
  misc_feature 1..91: note = chr19:51228702-51228793
  misc_feature 1..91: note = hyper
  source 1..91: mol_type = genomic DNA
cgtctgcgagttccccttctagcggggccggtaccccgcctccctgcccatcccaccacccggcctttccctgcgccgtgcccaccctcct

SEQ ID NO: 4681 - DNA, 114 bp, Homo sapiens; identical to SEQ ID NO: 1394
  misc_feature 1..114: note = chr19:51830889-51831003
  misc_feature 1..114: note = hyper
  source 1..114: mol_type = genomic DNA

SEQ ID NO: 4682 - DNA, 270 bp, Homo sapiens; identical to SEQ ID NO: 1395
  misc_feature 1..270: note = chr19:51831120-51831390
  misc_feature 1..270: note = hyper
  source 1..270: mol_type = genomic DNA

SEQ ID NO: 4683 - DNA, 333 bp, Homo sapiens
  misc_feature 1..333: note = chr19:53073440-53073773
  misc_feature 1..333: note = hyper
  source 1..333: mol_type = genomic DNA
ctccgcctggggccccgcctctacctcgatcaggccccgcccaccttctcgttggctccacccaggcctggctttagtcctgtgcgcacacatccgcgcagaccaggaagcggatcccgtggagtgaaggtcgcaccgcggcggtgagttttgctctgtgttgtattaagtctgcactccccatatccccggcacttccgtacctgggacgtggggtcaccacagacctgtaaattctcgcccatcttccttcaaccagagcaaatgcagacgttcccctgggaatccggaagtcgcttccttttgtgtttaaagtcgccctgaggctgttcc

SEQ ID NO: 4684 - DNA, 46 bp, Homo sapiens
  misc_feature 1..46: note = chr19:53073819-53073865
  misc_feature 1..46: note = hyper
  source 1..46: mol_type = genomic DNA
cgtagtttctgtgctcaaaaccgttttttaactcctccctccccgc

SEQ ID NO: 4685 - DNA, 172 bp, Homo sapiens
  misc_feature 1..172: note = chr19:53073866-53074038
  misc_feature 1..172: note = hyper
  source 1..172: mol_type = genomic DNA
cttttcaaagtcctcacccgagatgtgtatttccgcctgggcgcctcccagtctcaacctttaggcgcctgaagcgcaaacgtcgcgatcccagtctcagggaggccgagttctctgcctggtgctgggatcttgtggaccccaccgaaggcgtcgtcgcaccccacctccc

SEQ ID NO: 4686 - DNA, 482 bp, Homo sapiens
  misc_feature 1..482: note = chr19:53696167-53696649
  misc_feature 1..482: note = hyper
  source 1..482: mol_type = genomic DNA
aggaccaggcagaggcgcggcctccccgggactggggctgcggcgctaacgctccagtagctgactagggcgaggttaggggacggtaaaatcctgcacccacttcgcagatgaggacttcacagggcgcaggtcagtaaagggttttaagcaggaaacggcgcaggaaaggaggtgtctgcatggtctgaaggccgaaagaccgcgggcaggaccagcctgtgtgattttaacccaaagcgatgcgacccccagagtctcgcggcaaagtctgaatttacatggaatggagggagccgtgcggggactttaagggctatacgaacccccggacatcgggtacggaggagcaggggactccgaaacgcaggtttaatctagatagagggaaactcacgcggcgactaacagccttcactccaagagatctgcttccgggtttgcaagaaactgcccgcgcagtaggcaaaggggcgggttgc

SEQ ID NO: 4687 - DNA, 13 bp, Homo sapiens
  misc_feature 1..13: note = chr19:53696650-53696663
  misc_feature 1..13: note = hyper
  source 1..13: mol_type = genomic DNA
gtggggaaaggcc

SEQ ID NO: 4688 - DNA, 142 bp, Homo sapiens
  misc_feature 1..142: note = chr19:53970501-53970643
  misc_feature 1..142: note = hyper
  source 1..142: mol_type = genomic DNA
gcatccctcccaccccggcgccccatccagcaggtggtcacctcactcctccctggcctgagcactccgtcccgcatccatggcggtggctttagggaaatctctgaagttgagcacggggtggacttgccctcctgagtga

SEQ ID NO: 4689 - DNA, 261 bp, Homo sapiens
  misc_feature 1..261: note = chr19:53970763-53971024
  misc_feature 1..261: note = hyper
  source 1..261: mol_type = genomic DNA
aattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggcctggcttctgtcctgcgcgcagattcgcgaaaacccggaagcggatcgcgtggagt

SEQ ID NO: 4690 - DNA, 153 bp, Homo sapiens
  misc_feature 1..153: note = chr19:54412839-54412992
  misc_feature 1..153: note = hyper
  source 1..153: mol_type = genomic DNA
gggcaacaagggacccgagtggctccaggggtggtgagatcctggcggtcgggacgcccgaattcgagcggctatgggggatgcagggacacctgggcctggcgatcccggaggacggggtccgagggtcccggagtgggaaactgcactcct

SEQ ID NO: 4691 - DNA, 197 bp, Homo sapiens; identical to SEQ ID NO: 1396
  misc_feature 1..197: note = chr19:54481771-54481968
  misc_feature 1..197: note = hyper
  source 1..197: mol_type = genomic DNA

SEQ ID NO: 4692 - DNA, 77 bp, Homo sapiens; identical to SEQ ID NO: 1397
  misc_feature 1..77: note = chr19:54483391-54483468
  misc_feature 1..77: note = hyper
  source 1..77: mol_type = genomic DNA

SEQ ID NO: 4693 - DNA, 94 bp, Homo sapiens
  misc_feature 1..94: note = chr19:54485553-54485647
  misc_feature 1..94: note = hyper
  source 1..94: mol_type = genomic DNA
caaggccggcgggggcgcgggcggcagtggcgggagcggcccctcggccatcctccgtctgcccagttaccgcttccgctaccgccgccgctcc

SEQ ID NO: 4694 - DNA, 325 bp, Homo sapiens
  misc_feature 1..325: note = chr19:54485672-54485997
  misc_feature 1..325: note = hyper
  source 1..325: mol_type = genomic DNA
cgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcc

SEQ ID NO: 4695 - DNA, 131 bp, Homo sapiens
  misc_feature 1..131: note = chr19:56728658-56728789
  misc_feature 1..131: note = hyper
  source 1..131: mol_type = genomic DNA
cgatgatgactccagctttctccttctaggcattccggttgggcatgaccggtcctgtcagccgagcggccagtttcagttcttcagcagaactgtctcccttctcggaggccgagggcttcccggggaag

SEQ ID NO: 4696 - DNA, 53 bp, Homo sapiens; identical to SEQ ID NO: 1398
  misc_feature 1..53: note = chr19:56879501-56879554
  misc_feature 1..53: note = hyper
  source 1..53: mol_type = genomic DNA

SEQ ID NO: 4697 - DNA, 90 bp, Homo sapiens; identical to SEQ ID NO: 1399
  misc_feature 1..90: note = chr19:56879555-56879645
  misc_feature 1..90: note = hyper
  source 1..90: mol_type = genomic DNA

SEQ ID NO: 4698 - DNA, 322 bp, Homo sapiens; identical to SEQ ID NO: 1400
  misc_feature 1..322: note = chr19:56879646-56879968
  misc_feature 1..322: note = hyper
  source 1..322: mol_type = genomic DNA

SEQ ID NO: 4699 - DNA, 193 bp, Homo sapiens; identical to SEQ ID NO: 1401
  misc_feature 1..193: note = chr19:56904511-56904704
  misc_feature 1..193: note = hyper
  source 1..193: mol_type = genomic DNA

SEQ ID NO: 4700 - DNA, 274 bp, Homo sapiens; identical to SEQ ID NO: 1402
  misc_feature 1..274: note = chr19:56904723-56904997
  misc_feature 1..274: note = hyper
  source 1..274: mol_type = genomic DNA

SEQ ID NO: 4701 - DNA, 50 bp, Homo sapiens; identical to SEQ ID NO: 1403
  misc_feature 1..50: note = chr19:56904998-56905048
  misc_feature 1..50: note = hyper
  source 1..50: mol_type = genomic DNA

SEQ ID NO: 4702 - DNA, 107 bp, Homo sapiens
  misc_feature 1..107: note = chr19:56988557-56988664
  misc_feature 1..107: note = hyper
  source 1..107: mol_type = genomic DNA
gcgccttggcaggaacgtccacgcagtggcgggcgcgccgcccacgccctcagacacacccacactctcgccagcccccttacctcggtcttcccgggctcagaccc

SEQ ID NO: 4703 - DNA, 183 bp, Homo sapiens; identical to SEQ ID NO: 1404
  misc_feature 1..183: note = chr19:57182944-57183127
  misc_feature 1..183: note = hyper
  source 1..183: mol_type = genomic DNA

SEQ ID NO: 4704 - DNA, 227 bp, Homo sapiens
  misc_feature 1..227: note = chr19:57617489-57617716
  misc_feature 1..227: note = hyper
  source 1..227: mol_type = genomic DNA
ccctgcatcccggagcgcactggggatgaggactcacccaggagagcccgagacacctgagcggccggcacaaaggccctagggaagtgtgggggtacccttggtctcaaagcgctgatccgcctgtgccccctgacctgccagggccggcccccgcttgggtcttggagggcgctgcgcaagcctgcgccccgcactcgcccgggaagggaagggcagggaagggg

SEQ ID NO: 4705 - DNA, 200 bp, Homo sapiens
  misc_feature 1..200: note = chr19:58038923-58039123
  misc_feature 1..200: note = hyper
  source 1..200: mol_type = genomic DNA
cgccccgcctaaagtcccatggccgaggcagcgctagtgattacgccgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaa

SEQ ID NO: 4706 - DNA, 480 bp, Homo sapiens; identical to SEQ ID NO: 1405
  misc_feature 1..480: note = chr19:58094988-58095468
  misc_feature 1..480: note = hyper
  source 1..480: mol_type = genomic DNA

SEQ ID NO: 4707 - DNA, 308 bp, Homo sapiens; identical to SEQ ID NO: 1406
  misc_feature 1..308: note = chr19:58095469-58095777
  misc_feature 1..308: note = hyper
  source 1..308: mol_type = genomic DNA

SEQ ID NO: 4708 - DNA, 467 bp, Homo sapiens; identical to SEQ ID NO: 1407
  misc_feature 1..467: note = chr19:58219926-58220393
  misc_feature 1..467: note = hyper
  source 1..467: mol_type = genomic DNA

SEQ ID NO: 4709 - DNA, 217 bp, Homo sapiens; identical to SEQ ID NO: 1408
  misc_feature 1..217: note = chr19:58220515-58220732
  misc_feature 1..217: note = hyper
  source 1..217: mol_type = genomic DNA

SEQ ID NO: 4710 - DNA, 413 bp, Homo sapiens; identical to SEQ ID NO: 1409
  misc_feature 1..413: note = chr19:58238326-58238739
  misc_feature 1..413: note = hyper
  source 1..413: mol_type = genomic DNA

SEQ ID NO: 4711 - DNA, 25 bp, Homo sapiens
  misc_feature 1..25: note = chr19:58238987-58239012
  misc_feature 1..25: note = hyper
  source 1..25: mol_type = genomic DNA
gctacaaggaggagccggaagtccc

SEQ ID NO: 4712 - DNA, 188 bp, Homo sapiens; identical to SEQ ID NO: 1411
  misc_feature 1..188: note = chr19:58239013-58239201
  misc_feature 1..188: note = hyper
  source 1..188: mol_type = genomic DNA

SEQ ID NO: 4713 - DNA, 112 bp, Homo sapiens; identical to SEQ ID NO: 1412
  misc_feature 1..112: note = chr19:58400406-58400518
  misc_feature 1..112: note = hyper
  source 1..112: mol_type = genomic DNA

SEQ ID NO: 4714 - DNA, 28 bp, Homo sapiens
  misc_feature 1..28: note = chr19:58609498-58609526
  misc_feature 1..28: note = hyper
  source 1..28: mol_type = genomic DNA
tcgctctctgacccccgcgctgcatccc

SEQ ID NO: 4715 - DNA, 32 bp, Homo sapiens
  misc_feature 1..32: note = chr19:58609712-58609744
  misc_feature 1..32: note = hyper
  source 1..32: mol_type = genomic DNA
gcatggccaatcagacgcgagtgtggcctccc

SEQ ID NO: 4716 - DNA, 62 bp, Homo sapiens
  misc_feature 1..62: note = chr19:58609745-58609807
  misc_feature 1..62: note = hyper
  source 1..62: mol_type = genomic DNA
gcgtcccgcccactccggcgcctgcgtcattttgggcaccatggcaacgaagtaaacaagcg

SEQ ID NO: 4717 - DNA, 74 bp, Homo sapiens; identical to SEQ ID NO: 1413
  misc_feature 1..74: note = chr19:58951525-58951599
  misc_feature 1..74: note = hyper
  source 1..74: mol_type = genomic DNA

SEQ ID NO: 4718 - DNA, 178 bp, Homo sapiens; identical to SEQ ID NO: 1414
  misc_feature 1..178: note = chr19:58951600-58951778
  misc_feature 1..178: note = hyper
  source 1..178: mol_type = genomic DNA

SEQ ID NO: 4719 - DNA, 279 bp, Homo sapiens; identical to SEQ ID NO: 1415
  misc_feature 1..279: note = chr19:58951779-58952058
  misc_feature 1..279: note = hyper
  source 1..279: mol_type = genomic DNA

SEQ ID NO: 4720 - DNA, 28 bp, Homo sapiens
  misc_feature 1..28: note = chr20:291135-291163
  misc_feature 1..28: note = hyper
  source 1..28: mol_type = genomic DNA
cgttgccatagaaaccggccgcacaggc

SEQ ID NO: 4721 - DNA, 153 bp, Homo sapiens; identical to SEQ ID NO: 1417
  misc_feature 1..153: note = chr20:291220-291373
  misc_feature 1..153: note = hyper
  source 1..153: mol_type = genomic DNA

SEQ ID NO: 4722 - DNA, 274 bp, Homo sapiens; identical to SEQ ID NO: 1418
  misc_feature 1..274: note = chr20:644552-644826
  misc_feature 1..274: note = hyper
  source 1..274: mol_type = genomic DNA

SEQ ID NO: 4723 - DNA, 320 bp, Homo sapiens; identical to SEQ ID NO: 1419
  misc_feature 1..320: note = chr20:644985-645305
  misc_feature 1..320: note = hyper
  source 1..320: mol_type = genomic DNA

SEQ ID NO: 4724 - DNA, 72 bp, Homo sapiens
  misc_feature 1..72: note = chr20:982727-982799
  misc_feature 1..72: note = hyper
  source 1..72: mol_type = genomic DNA
ccttgcttcttccttcggttcagggcgagcatgtccacggcgtgggcgacgagcaggagcaggcagagtggc

SEQ ID NO: 4725 - DNA, 253 bp, Homo sapiens
  misc_feature 1..253: note = chr20:982891-983144
  misc_feature 1..253: note = hyper
  source 1..253: mol_type = genomic DNA
gggggctgctgtgggcgcgccgggcgcatccgccaggcgcgggtcggtccggccgccaggtctagtgagggcgttggcggagccggggcactgccctggcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgc

SEQ ID NO: 4726 - DNA, 698 bp, Homo sapiens
  misc_feature 1..698: note = chr20:1783608-1784306
  misc_feature 1..698: note = hyper
  source 1..698: mol_type = genomic DNA
gccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaagggctgctgggaaaaaggcggatttcaaaggagaagcagctaaggaaaagctctggaaagggccaacggagcggatattcccggagcccctctgcgagccacgcgcccctctgggaagcccgcttccccctgcagacaggcgctgtgacacgcttgcgccccggtcgaacaggcgaagaggccgaggcccagagcggcgcagggcgagcctggaggctgcgccccagacctggaccagccacggacgccgctcccgccgctccctccgctccgctgcgctccgcacgctggcgccggctccccgaggccccgggcgccccggccgcacgcctgggtaaaaggtcccgaggagtccgcagaagcgcgcccacgcccgagacggccgtttccgccggcctgggaaaggggcggagaagggggtcgcccgggccgcagcgtgccggtccccgccggccgagccgtgtttggggccagtccccgcaccccgcttcttccccacctggggagcggggcgccgcggtaggggcactggagcgcacgatgcaccc

SEQ ID NO: 4727 - DNA, 219 bp, Homo sapiens; identical to SEQ ID NO: 1420
  misc_feature 1..219: note = chr20:2780903-2781122
  misc_feature 1..219: note = hyper
  source 1..219: mol_type = genomic DNA

SEQ ID NO: 4728 - DNA, 589 bp, Homo sapiens; identical to SEQ ID NO: 1421
  misc_feature 1..589: note = chr20:2781123-2781712
  misc_feature 1..589: note = hyper
  source 1..589: mol_type = genomic DNA

SEQ ID NO: 4729 - DNA, 152 bp, Homo sapiens; identical to SEQ ID NO: 1422
  misc_feature 1..152: note = chr20:3052540-3052692
  misc_feature 1..152: note = hyper
  source 1..152: mol_type = genomic DNA

SEQ ID NO: 4730 - DNA, 380 bp, Homo sapiens; identical to SEQ ID NO: 1423
  misc_feature 1..380: note = chr20:3052693-3053073
  misc_feature 1..380: note = hyper
  source 1..380: mol_type = genomic DNA

SEQ ID NO: 4731 - DNA, 107 bp, Homo sapiens
  misc_feature 1..107: note = chr20:3073285-3073392
  misc_feature 1..107: note = hyper
  source 1..107: mol_type = genomic DNA
cggggacaatgactgcggccctggggtcccacagacgttccctttgctagacttaaggaagagctaggcctgtccgcgctcccagcccccacgcagccagacacccg

SEQ ID NO: 4732 - DNA, 295 bp, Homo sapiens
  misc_feature 1..295: note = chr20:3073560-3073855
  misc_feature 1..295: note = hyper
  source 1..295: mol_type = genomic DNA
cgcagactgctaagagcagcatgagcacggctccggcggcccccagggccccgcgggtcggcgccaccccggagcgcggtgcccggaatcacttagcgccatcagccgggcggctgggagggggaagcggccgatccgggcggctgggagggggaagcggccgatccaggcggcagcggagggggctgcagcggaggcggccccggcttgcacgctcgcccttccgcctgcccggcagggccccgtctgagccccaggccccaggcccagcggcgccgctcgccggtgaaggaaa

SEQ ID NO: 4733 - DNA, 164 bp, Homo sapiens
  misc_feature 1..164: note = chr20:3641773-3641937
  misc_feature 1..164: note = hyper
  source 1..164: mol_type = genomic DNA
cggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccc

SEQ ID NO: 4734 - DNA, 198 bp, Homo sapiens
  misc_feature 1..198: note = chr20:5296850-5297048
  misc_feature 1..198: note = hyper
  source 1..198: mol_type = genomic DNA
ctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcc

SEQ ID NO: 4735 - DNA, 194 bp, Homo sapiens
  misc_feature 1..194: note = chr20:5297225-5297419
  misc_feature 1..194: note = hyper
  source 1..194: mol_type = genomic DNA
cggttttcacctcgaggacccggacttgcacttgcagagccgctgcgtgggggatgtccctcttttttcctcgccccggcgggctcctccggcgtgtcagggtctctgggttccagctggagttggcgctccggccccacagctctttccagcgtctcggacctgtgcgccccgccccgcgctggactccgccc

SEQ ID NO: 4736 - DNA, 277 bp, Homo sapiens
  misc_feature 1..277: note = chr20:8112335-8112612
  misc_feature 1..277: note = hyper
  source 1..277: mol_type = genomic DNA
atgggctttctgtctcgaaagcacaacgtaaccgtttgcccgggtttcaagatcagcgcgctgcaaactctcaggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagccca

SEQ ID NO: 4737 - DNA, 205 bp, Homo sapiens; identical to SEQ ID NO: 1424
  misc_feature 1..205: note = chr20:9489503-9489708
  misc_feature 1..205: note = hyper
  source 1..205: mol_type = genomic DNA

SEQ ID NO: 4738 - DNA, 96 bp, Homo sapiens
  misc_feature 1..96: note = chr20:17206513-17206609
  misc_feature 1..96: note = hyper
  source 1..96: mol_type = genomic DNA
tagctttgaaacagtcgtcctcatttcgttacatacagaacgttcgtgcttcctccctctcaggcaagaagcggagtccgtcgtcagcagttagca

SEQ ID NO: 4739 - DNA, 10 bp, Homo sapiens
  misc_feature 1..10: note = chr20:20346166-20346176
  misc_feature 1..10: note = hyper
  source 1..10: mol_type = genomic DNA
gggtggtgaa

SEQ ID NO: 4740 - DNA, 377 bp, Homo sapiens; identical to SEQ ID NO: 1426
  misc_feature 1..377: note = chr20:20347333-20347710
  misc_feature 1..377: note = hyper
  source 1..377: mol_type = genomic DNA

SEQ ID NO: 4741 - DNA, 486 bp, Homo sapiens; identical to SEQ ID NO: 1427
  misc_feature 1..486: note = chr20:20347736-20348222
  misc_feature 1..486: note = hyper
  source 1..486: mol_type = genomic DNA

SEQ ID NO: 4742 - DNA, 26 bp, Homo sapiens
  misc_feature 1..26: note = chr20:20348257-20348283
  misc_feature 1..26: note = hyper
  source 1..26: mol_type = genomic DNA
cggctccggctcgcggattgaaccct

SEQ ID NO: 4743 - DNA, 281 bp, Homo sapiens; identical to SEQ ID NO: 1429
  misc_feature 1..281: note = chr20:21080676-21080957
  misc_feature 1..281: note = hyper
  source 1..281: mol_type = genomic DNA

SEQ ID NO: 4744 - DNA, 817 bp, Homo sapiens; identical to SEQ ID NO: 1430
  misc_feature 1..817: note = chr20:21081028-21081845
  misc_feature 1..817: note = hyper
  source 1..817: mol_type = genomic DNA

SEQ ID NO: 4745 - DNA, 30 bp, Homo sapiens; identical to SEQ ID NO: 1431
  misc_feature 1..30: note = chr20:21082094-21082124
  misc_feature 1..30: note = hyper
  source 1..30: mol_type = genomic DNA

SEQ ID NO: 4746 - DNA, 741 bp, Homo sapiens; identical to SEQ ID NO: 1432
  misc_feature 1..741: note = chr20:21082215-21082956
  misc_feature 1..741: note = hyper
  source 1..741: mol_type = genomic DNA

SEQ ID NO: 4747 - DNA, 416 bp, Homo sapiens
  misc_feature 1..416: note = chr20:21083498-21083914
  misc_feature 1..416: note = hyper
  source 1..416: mol_type = genomic DNA
cagcgaaccccagctcgccggtggccgctcaccccgctcgcctctctctccctctggactcggtgctgaagccccagtgcagctcgctcctccttctgtcagcagctggacccggaagccctgactcccggcttggcgcctgtgctgagagcggagaaggacgtcgcgaccggcaggcctggagggcgcattggtgtgcagagtgtagcggctggtctggccctgggaaccccagacccgcgaagctggagggcgcactccccggcctcagagccccaaaccggaggcgctgtccaaacgcgccaacgctgcaagcaatgtggcagggcacaccgaaatgcgtgtctcgcacacctgcccatctttccctgctcaacacgaaagcgccttgtggctctaagcgcttccttggggtg

SEQ ID NO: 4748 - DNA, 70 bp, Homo sapiens
  misc_feature 1..70: note = chr20:21084291-21084361
  misc_feature 1..70: note = hyper
  source 1..70: mol_type = genomic DNA
gtttcccattatacccgatcttggcctaaatggtgttcggcagcggggcggagagcgaggggtgaaatca

SEQ ID NO: 4749 - DNA, 365 bp, Homo sapiens
  misc_feature 1..365: note = chr20:21085787-21086152
  misc_feature 1..365: note = hyper
  source 1..365: mol_type = genomic DNA
caccgggtcccctttcgaatgccatttcccagctgaaaatccagccagcacagcctggacgccgagccctctggagccctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggc

SEQ ID NO: 4750 - DNA, 257 bp, Homo sapiens
  misc_feature 1..257: note = chr20:21086194-21086451
  misc_feature 1..257: note = hyper
  source 1..257: mol_type = genomic DNA
cgccggccccctcacccggcgagggccctgcgctcacacttcttccaggggaaggagtggccacgcctgagcccccctaaacgacctcttcaggagaaaagagtgccggccaggagtccctccagtaacctcagtttagatcgggttttcgcgcctcccctaggaatccggctggaaaccccggagactctgcgcctagagttttgcgggcgtctctctgcctccccgcagcttccggctctcgcaggcttcatcca

SEQ ID NO: 4751 - DNA, 170 bp, Homo sapiens; identical to SEQ ID NO: 1433
  misc_feature 1..170: note = chr20:21086917-21087087
  misc_feature 1..170: note = hyper
  source 1..170: mol_type = genomic DNA

SEQ ID NO: 4752 - DNA, 15 bp, Homo sapiens
  misc_feature 1..15: note = chr20:21372178-21372193
  misc_feature 1..15: note = hyper
  source 1..15: mol_type = genomic DNA
gatggtggcggcgcc

SEQ ID NO: 4753 - DNA, 200 bp, Homo sapiens; identical to SEQ ID NO: 1435
  misc_feature 1..200: note = chr20:21372294-21372494
  misc_feature 1..200: note = hyper
  source 1..200: mol_type = genomic DNA

SEQ ID NO: 4754 - DNA, 130 bp, Homo sapiens; identical to SEQ ID NO: 1436
  misc_feature 1..130: note = chr20:21376207-21376337
  misc_feature 1..130: note = hyper
  source 1..130: mol_type = genomic DNA

SEQ ID NO: 4755 - DNA, 32 bp, Homo sapiens; identical to SEQ ID NO: 1437
  misc_feature 1..32: note = chr20:21376702-21376734
  misc_feature 1..32: note = hyper
  source 1..32: mol_type = genomic DNA

SEQ ID NO: 4756 - DNA, 253 bp, Homo sapiens; identical to SEQ ID NO: 1438
  misc_feature 1..253: note = chr20:21376876-21377129
  misc_feature 1..253: note = hyper
  source 1..253: mol_type = genomic DNA

SEQ ID NO: 4757 - DNA, 168 bp, Homo sapiens; identical to SEQ ID NO: 1439
  misc_feature 1..168: note = chr20:21377473-21377641
  misc_feature 1..168: note = hyper
  source 1..168: mol_type = genomic DNA

SEQ ID NO: 4758 - DNA, 837 bp, Homo sapiens; identical to SEQ ID NO: 1440
  misc_feature 1..837: note = chr20:21377737-21378574
  misc_feature 1..837: note = hyper
  source 1..837: mol_type = genomic DNA

SEQ ID NO: 4759 - DNA, 701 bp, Homo sapiens
  misc_feature 1..701: note = chr20:21485959-21486660
  misc_feature 1..701: note = hyper
  source 1..701: mol_type = genomic DNA
gtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccct

SEQ ID NO: 4760 - DNA, 132 bp, Homo sapiens
  misc_feature 1..132: note = chr20:21486785-21486917
  misc_feature 1..132: note = hyper
  source 1..132: mol_type = genomic DNA
cggctgtggtctgtgcccaaacacgatggaaaccggggctgggacgggcggtggtacgcacgtggaggagaagaggcatggcgggaaaaccacagccgaacacaggtcgactcgcacctcccaggcacccgc

SEQ ID NO: 4761 - DNA, 627 bp, Homo sapiens
  misc_feature 1..627: note = chr20:21486954-21487581
  misc_feature 1..627: note = hyper
  source 1..627: mol_type = genomic DNA
cgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcgtacgcgggatccgcgcgcgggcctgggctgctggcccacatttccccgcttgctcggatggcggcgctgaggcctattcgcctctttattaataacgatgcctcgggagggaaaaaatagagcctttaaaaatcagagtgcgagagaggagtgtgtgtgtgtgtgtgtgtgtgtgtgtgtgtgtgtgtctcggggcgttggtgaaagcaataaaactcagatcgcttccttggcgagatagcggcggctataatgcgccggggggatcaggggtttatttgcagatcctggataaaagatgatatatcgacacggtttagagtgtcactgcgcttggcctctcagggagccacaagtacatatttcctgaaataccgcccagcacagtatctaatccgcccgccacttaacaccgggaggggaacttc

SEQ ID NO: 4762 - DNA, 146 bp, Homo sapiens; identical to SEQ ID NO: 1441
  misc_feature 1..146: note = chr20:21489301-21489447
  misc_feature 1..146: note = hyper
  source 1..146: mol_type = genomic DNA

SEQ ID NO: 4763 - DNA, 80 bp, Homo sapiens; identical to SEQ ID NO: 1442
  misc_feature 1..80: note = chr20:21489621-21489701
  misc_feature 1..80: note = hyper
  source 1..80: mol_type = genomic DNA

SEQ ID NO: 4764 - DNA, 523 bp, Homo sapiens; identical to SEQ ID NO: 1443
  misc_feature 1..523: note = chr20:21490175-21490698
  misc_feature 1..523: note = hyper
  source 1..523: mol_type = genomic DNA

SEQ ID NO: 4765 - DNA, 88 bp, Homo sapiens; identical to SEQ ID NO: 1444
  misc_feature 1..88: note = chr20:21491258-21491346
  misc_feature 1..88: note = hyper
  source 1..88: mol_type = genomic DNA

SEQ ID NO: 4766 - DNA, 319 bp, Homo sapiens; identical to SEQ ID NO: 1445
  misc_feature 1..319: note = chr20:21492507-21492826
  misc_feature 1..319: note = hyper
  source 1..319: mol_type = genomic DNA

SEQ ID NO: 4767 - DNA, 764 bp, Homo sapiens; identical to SEQ ID NO: 1446
  misc_feature 1..764: note = chr20:21493230-21493994
  misc_feature 1..764: note = hyper
  source 1..764: mol_type = genomic DNA

SEQ ID NO: 4768 - DNA, 205 bp, Homo sapiens
  misc_feature 1..205: note = chr20:21494557-21494762
  misc_feature 1..205: note = hyper
  source 1..205: mol_type = genomic DNA
acgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggc

SEQ ID NO: 4769 - DNA, 453 bp, Homo sapiens
  misc_feature 1..453: note = chr20:21496683-21497136
  misc_feature 1..453: note = hyper
  source 1..453: mol_type = genomic DNA
cgctcccgttggaagcctttgtcccggctcggtttttgcatttatttcagtggcgaaataatacatgattgacgctctctttcaatgtgtcctaactgtttggaataaatctaaggttgttcctagttgtcatggcattcaacccttttcaatggactatctcttcattcatttctgaatccgtccacaatattaaggaaaccccttcatgtcgacgctccccgattcctctttctcctcctactttttcttttctcctttctccccctccttccccccttttttcccctggaagaattagaaacttgtttgaatcgtcttcctcgaacccattacttttcgtgctttttttttttttttgctcgctttccgtctctgtctttctcagcgccccccctcctccgccctttcacgtgggagctcgtcgctctgccccgtcggaggagggaagtt

SEQ ID NO: 4770 - DNA, 312 bp, Homo sapiens
  misc_feature 1..312: note = chr20:21497802-21498114
  misc_feature 1..312: note = hyper
  source 1..312: mol_type = genomic DNA
gcctcaatgaccagccgaatccttctgggtctcagcttgcggtgtcctcttgtcggagcacctgaggcgcccacttcccctgccctcgcaggacgcctcctggactccggcccctcctacactttcaccccagcgagtcttccagtttttatttcccctggcctgggggcagctgggcagggagggagagaattggagagagcttcggccttgcctcctccgcgatcggtgcttccgggtccacagcactcagcctctcccgggacctcgagactcatttccccatcacttctcgtccgtgtggttcccgcg

SEQ ID NO: 4771 - DNA, 370 bp, Homo sapiens
  misc_feature 1..370: note = chr20:21498479-21498849
  misc_feature 1..370: note = hyper
  source 1..370: mol_type = genomic DNA
ggttctctgcgatcccgcacacccgcaggctgagaggccctgccccgctcccttccccctccggagggttcttcagtaagggcccaccactcccaccctgtcagcgtctgcctgcaccagtttcagctcctggtctcccccactcggcattctttagtaaattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgct

SEQ ID NO: 4772 - DNA, 303 bp, Homo sapiens; identical to SEQ ID NO: 1447
  misc_feature 1..303: note = chr20:21501450-21501753
  misc_feature 1..303: note = hyper
  source 1..303: mol_type = genomic DNA

SEQ ID NO: 4773 - DNA, 58 bp, Homo sapiens; identical to SEQ ID NO: 1448
  misc_feature 1..58: note = chr20:21502087-21502145
  misc_feature 1..58: note = hyper
  source 1..58: mol_type = genomic DNA

SEQ ID NO: 4774 - DNA, 257 bp, Homo sapiens; identical to SEQ ID NO: 1449
  misc_feature 1..257: note = chr20:21502443-21502700
  misc_feature 1..257: note = hyper
  source 1..257: mol_type = genomic DNA

SEQ ID NO: 4775 - DNA, 281 bp, Homo sapiens
  misc_feature 1..281: note = chr20:21503617-21503898
  misc_feature 1..281: note = hyper
  source 1..281: mol_type = genomic DNA
ccccctgcccccaaacgcgcgggtagattccctccctcctgcgcccctctgagcaggagatctgggaccccaggtttctcctgaccctcgcccctcctccgtccccagcagtgccttggactccgcagctcctggcgagcccggactgctggttaacaaggtcgccatctataaattgctcggtcgctaagacgccataaaaccaaagggccagatgtggcacgttatttatgtgtgaaaccgcgtttacactagatacgcggatccaaggccgatagcac

SEQ ID NO: 4776 - DNA, 21 bp, Homo sapiens
  misc_feature 1..21: note = chr20:21503899-21503920
  misc_feature 1..21: note = hyper
  source 1..21: mol_type = genomic DNA
acttcgcgggaggtcacagac

SEQ ID NO: 4777 - DNA, 57 bp, Homo sapiens; identical to SEQ ID NO: 1450
  misc_feature 1..57: note = chr20:21682399-21682456
  misc_feature 1..57: note = hyper
  source 1..57: mol_type = genomic DNA

SEQ ID NO: 4778 - DNA, 455 bp, Homo sapiens
  misc_feature 1..455: note = chr20:21683317-21683772
  misc_feature 1..455: note = hyper
  source 1..455: mol_type = genomic DNA
tttgactcccgctttcggcaaagagtttacctctctttcttttcctgccttgggaaaactgggcgagggcccgaagcctctggggtaccctcagatccatcctctgccctgctaggagtccagccccaggcggaggagttttgccccaggtttctgagtgcgccctcagctaacaggctcccgcgaccctggaagcggaactttgttgcactccgcttccagaggacgctgaaatacggtgccaaacccagccaagcaaaaacgcagaatccgcgagctctttacctctgtgcgctcagcgctgactagtagctgtccccgggccatggagagggctaagctgcctccttgggaggtgggagagacgtttcttttccttctgcaatctcatcttagggccatctctcaccaagcctagcctgcagctcgggaacccgcgatacccggccggggga

SEQ ID NO: 4779 - DNA, 17 bp, Homo sapiens
  misc_feature 1..17: note = chr20:21683899-21683916
  misc_feature 1..17: note = hyper
  source 1..17: mol_type = genomic DNA
cgcggactctgctaccg

SEQ ID NO: 4780 - DNA, 109 bp, Homo sapiens
  misc_feature 1..109: note = chr20:21686184-21686293
  misc_feature 1..109: note = hyper
  source 1..109: mol_type = genomic DNA
ggtagagtttcagggcggggaggggggcgctggggcgcagtgacgggaaccaatgagctgccaactcgcgcgtctccggcgtgactgccgagattgacgtggaggacac

SEQ ID NO: 4781 - DNA, 369 bp, Homo sapiens
  misc_feature 1..369: note = chr20:21686294-21686663
  misc_feature 1..369: note = hyper
  source 1..369: mol_type = genomic DNA
tcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctc

SEQ ID NO: 4782 - DNA, 61 bp, Homo sapiens
  misc_feature 1..61: note = chr20:21694499-21694560
  misc_feature 1..61: note = hyper
  source 1..61: mol_type = genomic DNA
cacaacgtagtctgccgctcacttaaagcgcaactgcctcctacgtcggaggaatccaggc

SEQ ID NO: 4783 - DNA, 804 bp, Homo sapiens
  misc_feature 1..804: note = chr20:24449900-24450704
  misc_feature 1..804: note = hyper
  source 1..804: mol_type = genomic DNA
gttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggtaagtccagacctcccggccgcgggggcgggcggaggggcccgcagtgggcggggtcgcggcaggggccgcgagctggcggcgggagctggaggctgccctgcgctggcgggtgtcctagtcctggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggaga

SEQ ID NO: 4784 - DNA, 200 bp, Homo sapiens
  misc_feature 1..200: note = chr20:24450819-24451019
  misc_feature 1..200: note = hyper
  source 1..200: mol_type = genomic DNA
cgggttcgggctgcccctcggagtgacccgaaggagaccagccagggctggtgagccgggcggccacggagctggggacctaggtctgtttgggagtaggaagggaaacagactaattctccgagcggagcggcaggcaaggtgcaagcgcgcttgggatggggaatcccgacgggcgaccgtggcggaagcagagactc

SEQ ID NO: 4785 - DNA, 43 bp, Homo sapiens; identical to SEQ ID NO: 1451
  misc_feature 1..43: note = chr20:25061746-25061789
  misc_feature 1..43: note = hyper
  source 1..43: mol_type = genomic DNA

SEQ ID NO: 4786 - DNA, 334 bp, Homo sapiens; identical to SEQ ID NO: 1452
  misc_feature 1..334: note = chr20:25061978-25062312
  misc_feature 1..334: note = hyper
  source 1..334: mol_type = genomic DNA

SEQ ID NO: 4787 - DNA, 136 bp, Homo sapiens; identical to SEQ ID NO: 1453
  misc_feature 1..136: note = chr20:25062510-25062646
  misc_feature 1..136: note = hyper
  source 1..136: mol_type = genomic DNA

SEQ ID NO: 4788 - DNA, 111 bp, Homo sapiens; identical to SEQ ID NO: 1454
  misc_feature 1..111: note = chr20:25062707-25062818
  misc_feature 1..111: note = hyper
  source 1..111: mol_type = genomic DNA

SEQ ID NO: 4789 - DNA, 71 bp, Homo sapiens; identical to SEQ ID NO: 1455
  misc_feature 1..71: note = chr20:25062870-25062941
  misc_feature 1..71: note = hyper
  source 1..71: mol_type = genomic DNA

SEQ ID NO: 4790 - DNA, 180 bp, Homo sapiens; identical to SEQ ID NO: 1456
  misc_feature 1..180: note = chr20:25063727-25063907
  misc_feature 1..180: note = hyper
  source 1..180: mol_type = genomic DNA

SEQ ID NO: 4791 - DNA, 518 bp, Homo sapiens; identical to SEQ ID NO: 1457
  misc_feature 1..518: note = chr20:25063993-25064511
  misc_feature 1..518: note = hyper
  source 1..518: mol_type = genomic DNA

SEQ ID NO: 4792 - DNA, 28 bp, Homo sapiens
  misc_feature 1..28: note = chr20:25065179-25065207
  misc_feature 1..28: note = hyper
  source 1..28: mol_type = genomic DNA
ccacccagagcccagcgtcaagttatac

SEQ ID NO: 4793 - DNA, 187 bp, Homo sapiens; identical to SEQ ID NO: 1459
  misc_feature 1..187: note = chr20:25065208-25065395
  misc_feature 1..187: note = hyper
  source 1..187: mol_type = genomic DNA

SEQ ID NO: 4794 - DNA, 24 bp, Homo sapiens
  misc_feature 1..24: note = chr20:34188608-34188632
  misc_feature 1..24: note = hyper
  source 1..24: mol_type = genomic DNA
ttctttttcttctttcgggtgagc

SEQ ID NO: 4795 - DNA, 342 bp, Homo sapiens; identical to SEQ ID NO: 1461
  misc_feature 1..342: note = chr20:34188747-34189089
  misc_feature 1..342: note = hyper
  source 1..342: mol_type = genomic DNA

SEQ ID NO: 4796 - DNA, 326 bp, Homo sapiens; identical to SEQ ID NO: 1462
  misc_feature 1..326: note = chr20:34189166-34189492
  misc_feature 1..326: note = hyper
  source 1..326: mol_type = genomic DNA

SEQ ID NO: 4797 - DNA, 375 bp, Homo sapiens; identical to SEQ ID NO: 1463
  misc_feature 1..375: note = chr20:34189679-34190054
  misc_feature 1..375: note = hyper
  source 1..375: mol_type = genomic DNA

SEQ ID NO: 4798 - DNA, 796 bp, Homo sapiens; identical to SEQ ID NO: 1464
  misc_feature 1..796: note = chr20:37302580-37303376
  misc_feature 1..796: note = hyper
  source 1..796: mol_type = genomic DNA

SEQ ID NO: 4799 - DNA, 401 bp, Homo sapiens; identical to SEQ ID NO: 1465
  misc_feature 1..401: note = chr20:37352115-37352516
  misc_feature 1..401: note = hyper
  source 1..401: mol_type = genomic DNA

SEQ ID NO: 4800 - DNA, 20 bp, Homo sapiens
  misc_feature 1..20: note = chr20:37352606-37352626
  misc_feature 1..20: note = hyper
  source 1..20: mol_type = genomic DNA
cggggcgcccagaccagtcc

SEQ ID NO: 4801 - DNA, 284 bp, Homo sapiens; identical to SEQ ID NO: 1467
  misc_feature 1..284: note = chr20:37353435-37353719
  misc_feature 1..284: note = hyper
  source 1..284: mol_type = genomic DNA

SEQ ID NO: 4802 - DNA, 1026 bp, Homo sapiens; identical to SEQ ID NO: 1468
  misc_feature 1..1026: note = chr20:37353806-37354832
  misc_feature 1..1026: note = hyper
  source 1..1026: mol_type = genomic DNA

SEQ ID NO: 4803 - DNA, 239 bp, Homo sapiens; identical to SEQ ID NO: 1469
  misc_feature 1..239: note = chr20:37354993-37355232
  misc_feature 1..239: note = hyper
  source 1..239: mol_type = genomic DNA

SEQ ID NO: 4804 - DNA, 541 bp, Homo sapiens; identical to SEQ ID NO: 1470
  misc_feature 1..541: note = chr20:37355502-37356043
  misc_feature 1..541: note = hyper
  source 1..541: mol_type = genomic DNA

SEQ ID NO: 4805 - DNA, 297 bp, Homo sapiens; identical to SEQ ID NO: 1471
  misc_feature 1..297: note = chr20:37356168-37356465
  misc_feature 1..297: note = hyper
  source 1..297: mol_type = genomic DNA

SEQ ID NO: 4806 - DNA, 365 bp, Homo sapiens; identical to SEQ ID NO: 1472
  misc_feature 1..365: note = chr20:37357825-37358190
  misc_feature 1..365: note = hyper
  source 1..365: mol_type = genomic DNA

SEQ ID NO: 4807 - DNA, 224 bp, Homo sapiens; identical to SEQ ID NO: 1473
  misc_feature 1..224: note = chr20:37434129-37434353
  misc_feature 1..224: note = hyper
  source 1..224: mol_type = genomic DNA

SEQ ID NO: 4808 - DNA, 234 bp, Homo sapiens; identical to SEQ ID NO: 1474
  misc_feature 1..234: note = chr20:37434488-37434722
  misc_feature 1..234: note = hyper
  source 1..234: mol_type = genomic DNA

SEQ ID NO: 4809 - DNA, 158 bp, Homo sapiens; identical to SEQ ID NO: 1475
  misc_feature 1..158: note = chr20:37434736-37434894
  misc_feature 1..158: note = hyper
  source 1..158: mol_type = genomic DNA

SEQ ID NO: 4810 - DNA, 440 bp, Homo sapiens; identical to SEQ ID NO: 1476
  misc_feature 1..440: note = chr20:37434930-37435370
  misc_feature 1..440: note = hyper
  source 1..440: mol_type = genomic DNA

SEQ ID NO: 4811 - DNA, 229 bp, Homo sapiens; identical to SEQ ID NO: 1477
  misc_feature 1..229: note = chr20:37435487-37435716
  misc_feature 1..229: note = hyper
  source 1..229: mol_type = genomic DNA

SEQ ID NO: 4812 - DNA, 132 bp, Homo sapiens; identical to SEQ ID NO: 1478
  misc_feature 1..132: note = chr20:37435717-37435849
  misc_feature 1..132: note = hyper
  source 1..132: mol_type = genomic DNA

SEQ ID NO: 4813 - DNA, 146 bp, Homo sapiens
  misc_feature 1..146: note = chr20:39319058-39319204
  misc_feature 1..146: note = hyper
  source 1..146: mol_type = genomic DNA
gccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccc

SEQ ID NO: 4814 - DNA, 512 bp, Homo sapiens
  misc_feature 1..512: note = chr20:39995034-39995546
  misc_feature 1..512: note = hyper
  source 1..512: mol_type = genomic DNA
gcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctc

SEQ ID NO: 4815 - DNA, 67 bp, Homo sapiens
  misc_feature 1..67: note = chr20:39995547-39995614
  misc_feature 1..67: note = hyper
  source 1..67: mol_type = genomic DNA
ccgccgccagcccctcgccccagctccgagcggacggccgaggagccgcctgcgaacaggaggttcc

SEQ ID NO: 4816 - DNA, 236 bp, Homo sapiens; identical to SEQ ID NO: 1479
  misc_feature 1..236: note = chr20:41818513-41818749
  misc_feature 1..236: note = hyper
  source 1..236: mol_type = genomic DNA

SEQ ID NO: 4817 - DNA, 211 bp, Homo sapiens; identical to SEQ ID NO: 1480
  misc_feature 1..211: note = chr20:41818804-41819015
  misc_feature 1..211: note = hyper
  source 1..211: mol_type = genomic DNA

SEQ ID NO: 4818 - DNA, 836 bp, Homo sapiens; identical to SEQ ID NO: 1481
  misc_feature 1..836: note = chr20:42543698-42544534
  misc_feature 1..836: note = hyper
  source 1..836: mol_type = genomic DNA

SEQ ID NO: 4819 - DNA, 257 bp, Homo sapiens; identical to SEQ ID NO: 1482
  misc_feature 1..257: note = chr20:42544727-42544984
  misc_feature 1..257: note = hyper
  source 1..257: mol_type = genomic DNA

SEQ ID NO: 4820 - DNA, 128 bp, Homo sapiens; identical to SEQ ID NO: 1483
  misc_feature 1..128: note = chr20:45279854-45279982
  misc_feature 1..128: note = hyper
  source 1..128: mol_type = genomic DNA

SEQ ID NO: 4821 - DNA, 218 bp, Homo sapiens; identical to SEQ ID NO: 1484
  misc_feature 1..218: note = chr20:45280039-45280257
  misc_feature 1..218: note = hyper
  source 1..218: mol_type = genomic DNA

SEQ ID NO: 4822 - DNA, 218 bp, Homo sapiens
  misc_feature 1..218: note = chr20:47443719-47443937
  misc_feature 1..218: note = hyper
  source 1..218: mol_type = genomic DNA
atcctactccatcaacgcgcagggacgttgggctctggggctcctacggtatgtcctagatgagtggtgcaccgggcgcgtagttattcctgggaaaaagacgcaggagcgccagctcccggcgccgccggggtccccaagcccctgcatcgcggatgtaactaattttaaaactatttgaaaggcggggacggggaagaaaagacaaaagggcagcg

SEQ ID NO: 4823 - DNA, 297 bp, Homo sapiens
  misc_feature 1..297: note = chr20:47443944-47444241
  misc_feature 1..297: note = hyper
  source 1..297: mol_type = genomic DNA
cggggaagtggagtgcgggagagccccggtcggagcaggaccgtgcgccggccagggagggaggcgacgcgacagctctggaggagctcggatcccccccgctttccgcgcgccctgcggggcgcccccgaggcaattctccacccacggggaccacggccacaggttgtggggaccgcagcggggcgagcggctggagggaaagctgtccccaagctcccgagcgacactcaccgactgcaagaagcgcaaggtgcccacgtagtccctctcggtgcccaagatctcgttgaggac

SEQ ID NO: 4824 - DNA, 186 bp, Homo sapiens
  misc_feature 1..186: note = chr20:47444242-47444428
  misc_feature 1..186: note = hyper
  source 1..186: mol_type = genomic DNA
cagaggcggaggcgcagctggcgctcggactcccgggcggccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttc

SEQ ID NO: 4825 - DNA, 129 bp, Homo sapiens
  misc_feature 1..129: note = chr20:47444452-47444581
  misc_feature 1..129: note = hyper
  source 1..129: mol_type = genomic DNA
cgtccaggcgccccatcccggacggggcgcgccggcgggccgggctcagcggcgggccgggctcccggcgcggcgggcgggactgggggccgggcggctgggccgggggcggaggcagcgcgcgggggc

SEQ ID NO: 4826 - DNA, 184 bp, Homo sapiens
  misc_feature 1..184: note = chr20:47444609-47444793
  misc_feature 1..184: note = hyper
  source 1..184: mol_type = genomic DNA
cggggctcccagacggctggccccccgcccccgcgccagggaccgtctgccaagtgccacgccgcgctcggccgcagaggcgctctgcgcgtgcacggggcccctggggacgcggcgcggcgctcggcgcctccgtcggaagctcgggggtcgggcgggagcctccggaagggccccgcggagc

SEQ ID NO: 4827 - DNA, 295 bp, Homo sapiens
  misc_feature 1..295: note = chr20:47444920-47445215
  misc_feature 1..295: note = hyper
  source 1..295: mol_type = genomic DNA
cgcgcaggctcctgcttgcaggtccggccgctgctcgggccaagtaaacaccgggctgggaaagctcgctgcggagccgctcgggggcaagccagccccgccacgcgcgcctccgcggccccgggaagtcaggggcgaccgctgcctgggcagtgacggcccctctctgggcagtgacggcccctcccgggaacgccgggccctcgcggtgccctcggtgctaccacgaccttgggaaggaacatgcgtggcgcgcgctcgctctcacttttctctttcccgtttcctttcccat

SEQ ID NO: 4828 - DNA, 134 bp, Homo sapiens
  misc_feature 1..134: note = chr20:47934853-47934987
  misc_feature 1..134: note = hyper
  source 1..134: mol_type = genomic DNA
tacctagcttgagcccgaccatgggcatgcgtggcgtggcgcgaatcctgtccctgtcgctcgtcctggccgcggtggccacgggggcctgggagcgggggccgctgggcgtgctcttgccctggcagggctcc

SEQ ID NO: 4829 - DNA, 606 bp, Homo sapiens
  misc_feature 1..606: note = chr20:47934988-47935594
  misc_feature 1..606: note = hyper
  source 1..606: mol_type = genomic DNA
ccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaagga

SEQ ID NO: 4830 - DNA, 809 bp, Homo sapiens; identical to SEQ ID NO: 1485
  misc_feature 1..809: note = chr20:50720392-50721201
  misc_feature 1..809: note = hyper
  source 1..809: mol_type = genomic DNA

SEQ ID NO: 4831 - DNA, 437 bp, Homo sapiens; identical to SEQ ID NO: 1486
  misc_feature 1..437: note = chr20:50721234-50721671
  misc_feature 1..437: note = hyper
  source 1..437: mol_type = genomic DNA

SEQ ID NO: 4832 - DNA, 218 bp, Homo sapiens
  misc_feature 1..218: note = chr20:54578507-54578725
  misc_feature 1..218: note = hyper
  source 1..218: mol_type = genomic DNA
acatttatcctgttccgcaaaggtacccagggagcagcctcagcggcacccgcagaggagtctgagcaagggcaccaagatctggccaagagataacgacgtccagggaccaggtgcccttcggctcccgccgacctgttgctcgaaacttgccctgagctctcgctgccgggctctgggctcccaagcctctcccccgccgccgcagcagcctcttt

SEQ ID NO: 4833 - DNA, 413 bp, Homo sapiens; identical to SEQ ID NO: 1487
  misc_feature 1..413: note = chr20:55199898-55200311
  misc_feature 1..413: note = hyper
  source 1..413: mol_type = genomic DNA

SEQ ID NO: 4834 - DNA, 98 bp, Homo sapiens; identical to SEQ ID NO: 1488
  misc_feature 1..98: note = chr20:55200615-55200713
  misc_feature 1..98: note = hyper
  source 1..98: mol_type = genomic DNA

SEQ ID NO: 4835 - DNA, 320 bp, Homo sapiens
  misc_feature 1..320: note = chr20:55201037-55201357
  misc_feature 1..320: note = hyper
  source 1..320: mol_type = genomic DNA
taaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccc

SEQ ID NO: 4836 - skipped

SEQ ID NO: 4837 - DNA, 305 bp, Homo sapiens
  misc_feature 1..305: note = chr20:55201764-55202069
  misc_feature 1..305: note = hyper
  source 1..305: mol_type = genomic DNA
aggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtg

SEQ ID NO: 4838 - DNA, 268 bp, Homo sapiens
  misc_feature 1..268: note = chr20:55202358-55202626
  misc_feature 1..268: note = hyper
  source 1..268: mol_type = genomic DNA
gggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggaccca

SEQ ID NO: 4839 - DNA, 754 bp, Homo sapiens
  misc_feature 1..754: note = chr20:56803371-56804125
  misc_feature 1..754: note = hyper
  source 1..754: mol_type = genomic DNA
cggcagtttgccactcggaacatctcccccgtctcctccagccgcacccgcaggacgaagacgtcaggggccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgaggcccctccctgcctgccgcccgagcctccagggagaccgatgggcgggcggccccccaaggtcccgcagtcctttcccgctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagct

SEQ ID NO: 4840 - DNA, 264 bp, Homo sapiens; identical to SEQ ID NO: 1489
  misc_feature 1..264: note = chr20:57224816-57225080
  misc_feature 1..264: note = hyper
  source 1..264: mol_type = genomic DNA

SEQ ID NO: 4841 - DNA, 177 bp, Homo sapiens; identical to SEQ ID NO: 1490
  misc_feature 1..177: note = chr20:57225218-57225395
  misc_feature 1..177: note = hyper
  source 1..177: mol_type = genomic DNA

SEQ ID NO: 4842 - DNA, 16 bp, Homo sapiens
  misc_feature 1..16: note = chr20:59826962-59826978
  misc_feature 1..16: note = hyper
  source 1..16: mol_type = genomic DNA
agtgcacactcccacc

SEQ ID NO: 4843 - DNA, 68 bp, Homo sapiens
  misc_feature 1..68: note = chr20:59828340-59828408
  misc_feature 1..68: note = hyper
  source 1..68: mol_type = genomic DNA
cgggagggcgagcgggtctcccgctgcctctgcagagccccgcgggccggattgccagctttgctctg

SEQ ID NO: 4844 - DNA, 374 bp, Homo sapiens
  misc_feature 1..374: note = chr20:61340304-61340678
  misc_feature 1..374: note = hyper
  source 1..374: mol_type = genomic DNA
cagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcggg

SEQ ID NO: 4845 - DNA, 226 bp, Homo sapiens
  misc_feature 1..226: note = chr20:61560696-61560922
  misc_feature 1..226: note = hyper
  source 1..226: mol_type = genomic DNA
ggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccaggg

SEQ ID NO: 4846 - DNA, 29 bp, Homo sapiens
  misc_feature 1..29: note = chr20:61637928-61637957
  misc_feature 1..29: note = hyper
  source 1..29: mol_type = genomic DNA
ggggaggtcgccgcccgggcccggagtgc

SEQ ID NO: 4847 - DNA, 250 bp, Homo sapiens; identical to SEQ ID NO: 1492
  misc_feature 1..250: note = chr20:61638220-61638470
  misc_feature 1..250: note = hyper
  source 1..250: mol_type = genomic DNA

SEQ ID NO: 4848 - DNA, 118 bp, Homo sapiens; identical to SEQ ID NO: 1493
  misc_feature 1..118: note = chr20:61638534-61638652
  misc_feature 1..118: note = hyper
  source 1..118: mol_type = genomic DNA

SEQ ID NO: 4849 - DNA, 53 bp, Homo sapiens; identical to SEQ ID NO: 1494
  misc_feature 1..53: note = chr20:61703709-61703762
  misc_feature 1..53: note = hyper
  source 1..53: mol_type = genomic DNA

SEQ ID NO: 4850 - DNA, 190 bp, Homo sapiens; identical to SEQ ID NO: 1495
  misc_feature 1..190: note = chr20:61703845-61704035
  misc_feature 1..190: note = hyper
  source 1..190: mol_type = genomic DNA

SEQ ID NO: 4851 - DNA, 200 bp, Homo sapiens; identical to SEQ ID NO: 1496
  misc_feature 1..200: note = chr20:61808181-61808381
  misc_feature 1..200: note = hyper
  source 1..200: mol_type = genomic DNA

SEQ ID NO: 4852 - DNA, 222 bp, Homo sapiens; identical to SEQ ID NO: 1497
  misc_feature 1..222: note = chr20:61808666-61808888
  misc_feature 1..222: note = hyper
  source 1..222: mol_type = genomic DNA

SEQ ID NO: 4853 - DNA, 117 bp, Homo sapiens; identical to SEQ ID NO: 1498
  misc_feature 1..117: note = chr20:61808889-61809006
  misc_feature 1..117: note = hyper
  source 1..117: mol_type = genomic DNA

SEQ ID NO: 4854 - DNA, 339 bp, Homo sapiens; identical to SEQ ID NO: 1499
  misc_feature 1..339: note = chr20:61809218-61809557
  misc_feature 1..339: note = hyper
  source 1..339: mol_type = genomic DNA

SEQ ID NO: 4855 - DNA, 74 bp, Homo sapiens; identical to SEQ ID NO: 1500
  misc_feature 1..74: note = chr20:61809558-61809632
  misc_feature 1..74: note = hyper
  source 1..74: mol_type = genomic DNA

SEQ ID NO: 4856 - DNA, 295 bp, Homo sapiens; identical to SEQ ID NO: 1501
  misc_feature 1..295: note = chr20:61809840-61810135
  misc_feature 1..295: note = hyper
  source 1..295: mol_type = genomic DNA

SEQ ID NO: 4857 - DNA, 265 bp, Homo sapiens
  misc_feature 1..265: note = chr20:61884691-61884956
  misc_feature 1..265: note = hyper
  source 1..265: mol_type = genomic DNA
cctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagct

SEQ ID NO: 4858 - DNA, 362 bp, Homo sapiens
  misc_feature 1..362: note = chr21:27012346-27012708
  misc_feature 1..362: note = hyper
  source 1..362: mol_type = genomic DNA
gaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaa

SEQ ID NO: 4859 - DNA, 15 bp, Homo sapiens
  misc_feature 1..15: note = chr21:28340034-28340049
  misc_feature 1..15: note = hyper
  source 1..15: mol_type = genomic DNA
ctcttgatgctttga

SEQ ID NO: 4860 - DNA, 286 bp, Homo sapiens
  misc_feature 1..286: note = chr21:28340062-28340348
  misc_feature 1..286: note = hyper
  source 1..286: mol_type = genomic DNA
cgggctccgggtgactaacttctcccggccaccagcagagcggctggacagccagagagcccagggcgcttcctggcgcgctgcggtaccccggggcgagaacgcccgccgcttgggaactccgcagctttgtgtgcgaacggcgggctcccagctttctccagcacgcctttcgtcagggtccacaatctgtcccttactcccagcccactggaacttcctttgctctaaaaaggcagagcgagaaagagttaactcttagagggaattccgctcattttttttc

SEQ ID NO: 4861 - DNA, 221 bp, Homo sapiens
  misc_feature 1..221: note = chr21:31311413-31311634
  misc_feature 1..221: note = hyper
  source 1..221: mol_type = genomic DNA
gggtgccggtccctgcgaacctggatccccgcactctagcccgcgttcctggagcccagattgaaaaacccgccaactgtacctcccggggaaggccggcaccctccaggagggaagcagtgacgcggctcccccttttttgtgtagcctcccatgagcactgacctccaccttccccagctccggctcctgcgccgccgcgcgctgcctcgcccgggacc

SEQ ID NO: 4862 - DNA, 102 bp, Homo sapiens
  misc_feature 1..102: note = chr21:31312079-31312181
  misc_feature 1..102: note = hyper
  source 1..102: mol_type = genomic DNA
cggaggatcagcgctctctggctcccggagcccagagaccagctgaggaaagttgctgccccgatctgcaggaacgtctccctcattcgtcctttggtcaga

SEQ ID NO: 4863 - DNA, 638 bp, Homo sapiens; identical to SEQ ID NO: 1502
  misc_feature 1..638: note = chr21:34392436-34393074
  misc_feature 1..638: note = hyper
  source 1..638: mol_type = genomic DNA

SEQ ID NO: 4864 - DNA, 337 bp, Homo sapiens
  misc_feature 1..337: note = chr21:34395421-34395758
  misc_feature 1..337: note = hyper
  source 1..337: mol_type = genomic DNA
gaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccaggg

SEQ ID NO: 4865 - DNA, 696 bp, Homo sapiens; identical to SEQ ID NO: 1503
  misc_feature 1..696: note = chr21:34396045-34396741
  misc_feature 1..696: note = hyper
  source 1..696: mol_type = genomic DNA

SEQ ID NO: 4866 - DNA, 93 bp, Homo sapiens; identical to SEQ ID NO: 1504
  misc_feature 1..93: note = chr21:34399166-34399259
  misc_feature 1..93: note = hyper
  source 1..93: mol_type = genomic DNA

SEQ ID NO: 4867 - DNA, 664 bp, Homo sapiens; identical to SEQ ID NO: 1505
  misc_feature 1..664: note = chr21:34399441-34400105
  misc_feature 1..664: note = hyper
  source 1..664: mol_type = genomic DNA

SEQ ID NO: 4868 - DNA, 27 bp, Homo sapiens
  misc_feature 1..27: note = chr21:34400231-34400258
  misc_feature 1..27: note = hyper
  source 1..27: mol_type = genomic DNA
cgcgaggaggggcgcaggaccatggac

SEQ ID NO: 4869 - DNA, 225 bp, Homo sapiens
  misc_feature 1..225: note = chr21:34401167-34401392
  misc_feature 1..225: note = hyper
  source 1..225: mol_type = genomic DNA
taagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatc

SEQ ID NO: 4870 - DNA, 382 bp, Homo sapiens; identical to SEQ ID NO: 1507
  misc_feature 1..382: note = chr21:34443981-34444363
  misc_feature 1..382: note = hyper
  source 1..382: mol_type = genomic DNA

SEQ ID NO: 4871 - DNA, 154 bp, Homo sapiens; identical to SEQ ID NO: 1508
  misc_feature 1..154: note = chr21:34444444-34444598
  misc_feature 1..154: note = hyper
  source 1..154: mol_type = genomic DNA

SEQ ID NO: 4872 - DNA, 96 bp, Homo sapiens; identical to SEQ ID NO: 1509
  misc_feature 1..96: note = chr21:36041933-36042029
  misc_feature 1..96: note = hyper
  source 1..96: mol_type = genomic DNA

SEQ ID NO: 4873 - DNA, 79 bp, Homo sapiens; identical to SEQ ID NO: 1510
  misc_feature 1..79: note = chr21:36042091-36042170
  misc_feature 1..79: note = hyper
  source 1..79: mol_type = genomic DNA

SEQ ID NO: 4874 - DNA, 144 bp, Homo sapiens; identical to SEQ ID NO: 1511
  misc_feature 1..144: note = chr21:36042171-36042315
  misc_feature 1..144: note = hyper
  source 1..144: mol_type = genomic DNA

SEQ ID NO: 4875 - DNA, 522 bp, Homo sapiens
  misc_feature 1..522: note = chr21:36042632-36043154
  misc_feature 1..522: note = hyper
  source 1..522: mol_type = genomic DNA
ggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaaccc

SEQ ID NO: 4876 - DNA, 519 bp, Homo sapiens
  misc_feature 1..519: note = chr21:38065004-38065523
  misc_feature 1..519: note = hyper
  source 1..519: mol_type = genomic DNA
accttcttccgcaatcgggaccactccaggtctccccggagaaggctgagtctccagcgcgtggattcagatcaggactctgtctaagtaggcgagagctggggataccgctgggggctttggcgaagctaagaaagcactggcttcttattctcaccagacatctcaacacccacgtgcgctgggtcccgcagtctctcgcccgccccacgcgggtcccagccctggtccttactccccgcgcgggaagaatctggggagggtgggggcggagaggcggctgatcggagagtgggagggaggatgggagatgggcagaggctgcccgcatcagggccaggacagacgtccgcgcggccccaggcactcacttgagtgtcacgcaagtcaccccaacaccgcacaagacagtggcggggtgcgcaccgaggcccctacctggggggtgtgcgcgcactgaacgaccccttctccaggtgcgcgagccgctccggcggccgtgcacactgcgcccccttc

SEQ ID NO: 4877 - DNA, 262 bp, Homo sapiens
  misc_feature 1..262: note = chr21:38065799-38066061
  misc_feature 1..262: note = hyper
  source 1..262: mol_type = genomic DNA
cggggagagttggcgacccgggcccatcaccgccccagtgccaccgccccagtgcctgaccagatggggtgcggtccctacgcccggcgtggccccgccgccgctcagatctgaagtccggctttcgctcgccctgcgcggcggaacctctgacccggagcagctctaggccgtgggcttcgtctcctcctcctggaaggaatgaatgggctccccgacacacacctctcagaaaactcacctttcacgctgaccttcaaaa

SEQ ID NO: 4878 - DNA, 131 bp, Homo sapiens
  misc_feature 1..131: note = chr21:38079932-38080063
  misc_feature 1..131: note = hyper
  source 1..131: mol_type = genomic DNA
aagggtttgcgaagccgctgccctgggccgaggtgcattttacgcttccagaggtcgaggcctccagagaccgcgatgcccagggcgttcccggggaggctgagagacccagggtgctctgggtgactgca

SEQ ID NO: 4879 - DNA, 213 bp, Homo sapiens
  misc_feature 1..213: note = chr21:38080174-38080387
  misc_feature 1..213: note = hyper
  source 1..213: mol_type = genomic DNA
cgcgctgcccgggggctcctgcctttggttcagtgctcgcggcaccaccgcactcaggacggcagtggggggctggggctggggctgggcctggcccagcgtgggttggggcgggggacgcgccagcagcgcccgcagctcgctccgcaggggtcgcagccaggggtcgggagctaggctcgtgggccgggagacgccgggcgcgttgtcctc

SEQ ID NO: 4880 - DNA, 134 bp, Homo sapiens
  misc_feature 1..134: note = chr21:38080550-38080684
  misc_feature 1..134: note = hyper
  source 1..134: mol_type = genomic DNA
ggctttcctgcttcctcggactgtgcaggggaagcctggggtctcgcggggcgcagcagtcaggtcgagggtgcagcaggaggggagtcctgacgggcaggtccctctttcccctggtgcgcaacactggttgg

SEQ ID NO: 4881 - DNA, 160 bp, Homo sapiens
  misc_feature 1..160: note = chr21:39286695-39286855
  misc_feature 1..160: note = hyper
  source 1..160: mol_type = genomic DNA
gaggaaccaccacctcggcggcccccaggcaactttcgggaggtttcaggggcacccggccagctctgggcgccctctcgagcgtcgccgtcagggagttgggcacaaccgatgccctgggacccgccacagggcacgcggctggcgtattcctttgcct

SEQ ID NO: 4882 - DNA, 38 bp, Homo sapiens; identical to SEQ ID NO: 1512
  misc_feature 1..38: note = chr21:44494740-44494778
  misc_feature 1..38: note = hyper
  source 1..38: mol_type = genomic DNA

SEQ ID NO: 4883 - DNA, 57 bp, Homo sapiens; identical to SEQ ID NO: 1513
  misc_feature 1..57: note = chr21:44494940-44494997
  misc_feature 1..57: note = hyper
  source 1..57: mol_type = genomic DNA

SEQ ID NO: 4884 - DNA, 122 bp, Homo sapiens; identical to SEQ ID NO: 1514
  misc_feature 1..122: note = chr21:44494998-44495120
  misc_feature 1..122: note = hyper
  source 1..122: mol_type = genomic DNA

SEQ ID NO: 4885 - DNA, 48 bp, Homo sapiens
  misc_feature 1..48: note = chr21:46126380-46126428
  misc_feature 1..48: note = hyper
  source 1..48: mol_type = genomic DNA
cacacacccacgcgtacacacccacgcgcacacaccgctgtccccagc

SEQ ID NO: 4886 - DNA, 132 bp, Homo sapiens
  misc_feature 1..132: note = chr21:46126566-46126698
  misc_feature 1..132: note = hyper
  source 1..132: mol_type = genomic DNA
cgagcagctccgggcctcaggggtcgccccgccaccgttttcctttcccagatgctgggacgggggcagggaggggctccccaggctgaacccgactaggtcaccctagaagcgaggcgagcttctcttctg

SEQ ID NO: 4887 - DNA, 107 bp, Homo sapiens
  misc_feature 1..107: note = chr21:46128961-46129068
  misc_feature 1..107: note = hyper
  source 1..107: mol_type = genomic DNA
ggaaagagacgtggccgccctcgcatcctgcagctcccgcactcccagcctcccagcctcccacccagccccccagagcccaccagtgaccccgcccactgggtcct

SEQ ID NO: 4888 - DNA, 73 bp, Homo sapiens; identical to SEQ ID NO: 1515
  misc_feature 1..73: note = chr21:47010408-47010481
  misc_feature 1..73: note = hyper
  source 1..73: mol_type = genomic DNA

SEQ ID NO: 4889 - DNA, 73 bp, Homo sapiens
  misc_feature 1..73: note = chr21:47062752-47062825
  misc_feature 1..73: note = hyper
  source 1..73: mol_type = genomic DNA
gggcgctgcggccccagcctccgggccggggccaggcccacagagaacgggaagcgggcgctgcagggggacc

SEQ ID NO: 4890 - DNA, 839 bp, Homo sapiens
  misc_feature 1..839: note = chr21:47063538-47064377
  misc_feature 1..839: note = hyper
  source 1..839: mol_type = genomic DNA
gccggcggcggcgcgcggcgctagattggttagcggcgcagaggggcgggcccgcgccgcgcgcagcgctcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggtgagtgagcggtggcgggcggggtcggggtcgggcgcccttgcgggttacggggacccagtccccgacggaggccgagtgacggggcgaccccgggccgcggcaaacttcgcccgagccggggcgggcgggggtcccgggctgggtcgcgccgtccccgaccgccgccggcgcctgcggcggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagagcgcggcctcacccctcggtgaccctgcggagagccgcgcgcgggcggtggggcgcgcgcaggtctctcttgttgctcgctgtgttttattttaattttgggggtggttagaacgtgtttcttattgt

SEQ ID NO: 4891 - DNA, 167 bp, Homo sapiens
  misc_feature 1..167: note = chr22:17600967-17601134
  misc_feature 1..167: note = hyper
  source 1..167: mol_type = genomic DNA
cgtggtgccgaagggcgcgcgtagctcgatgaggtctaggatggacgtgcccaggatcagcaccaccttgggagtgaaggcgatggagtagataagccaggccaggtaggcgaaggcgaactcgcccgctgccgcggccgcccccaggccgccccccgcgccgccgg

SEQ ID NO: 4892 - DNA, 143 bp, Homo sapiens
  misc_feature 1..143: note = chr22:17601259-17601402
  misc_feature 1..143: note = hyper
  source 1..143: mol_type = genomic DNA
cgacggccccggctgttcttggcgaagaagatggcccagcccaccaccaccaccaggtcagtggcgatccaggagcaccagtacaggtcggtgacggcgatgaggtacaggtccagcaggccgccctgcgccagcagcagcac

SEQ ID NO: 4893 - DNA, 303 bp, Homo sapiens
  misc_feature 1..303: note = chr22:17850318-17850621
  misc_feature 1..303: note = hyper
  source 1..303: mol_type = genomic DNA
ggggagggctagccccgctctggcgggcgggcgcgtggcaggggctcccggaggccccgagctcccgggaggcgctccggccaacttcgggccggtggggaccgggcctgggcgcggggctctgaaggtgtggaaggaaagtttgggactccgttattcttccacagcgtccttcctcccgtaatatccagcctctttatcgcggggctcgggagcccttggagttgatctcgccaccattatccccccgggcgagcgcggaggacgggctggccattctggccaggccggaggtgttttcca

SEQ ID NO: 4894 - DNA, 53 bp, Homo sapiens
  misc_feature 1..53: note = chr22:17850978-17851031
  misc_feature 1..53: note = hyper
  source 1..53: mol_type = genomic DNA
gcctccccagccccacggatcttactttgtgccattttcgggttgattttaac

SEQ ID NO: 4895 - DNA, 15 bp, Homo sapiens
  misc_feature 1..15: note = chr22:19510932-19510947
  misc_feature 1..15: note = hyper
  source 1..15: mol_type = genomic DNA
ggagaaggtcagctg

SEQ ID NO: 4896 - DNA, 315 bp, Homo sapiens; identical to SEQ ID NO: 1517
  misc_feature 1..315: note = chr22:19511141-19511456
  misc_feature 1..315: note = hyper
  source 1..315: mol_type = genomic DNA

SEQ ID NO: 4897 - DNA, 335 bp, Homo sapiens; identical to SEQ ID NO: 1518
  misc_feature 1..335: note = chr22:19511541-19511876
  misc_feature 1..335: note = hyper
  source 1..335: mol_type = genomic DNA

SEQ ID NO: 4898 - DNA, 67 bp, Homo sapiens; identical to SEQ ID NO: 1519
  misc_feature 1..67: note = chr22:19512252-19512319
  misc_feature 1..67: note = hyper
  source 1..67: mol_type = genomic DNA

SEQ ID NO: 4899 - DNA, 15 bp, Homo sapiens
  misc_feature 1..15: note = chr22:19512376-19512391
  misc_feature 1..15: note = hyper
  source 1..15: mol_type = genomic DNA
cgtagaggccctcgt

SEQ ID NO: 4900 - DNA, 127 bp, Homo sapiens
  misc_feature 1..127: note = chr22:19706238-19706365
  misc_feature 1..127: note = hyper
  source 1..127: mol_type = genomic DNA
cgggcctgggggggtcgccgcgatggactcgctggcagcgccccaggaccgcctggtggagcagctgctgtcgccgcggacccaggcccagaggcggctcaaggtgcgtgtgtggagagggcggaac

SEQ ID NO: 4901 - DNA, 204 bp, Homo sapiens
  misc_feature 1..204: note = chr22:19706366-19706570
  misc_feature 1..204: note = hyper
  source 1..204: mol_type = genomic DNA
tgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctcca

SEQ ID NO: 4902 - DNA, 166 bp, Homo sapiens
  misc_feature 1..166: note = chr22:22862697-22862863
  misc_feature 1..166: note = hyper
  source 1..166: mol_type = genomic DNA
ggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctc

SEQ ID NO: 4903 - DNA, 88 bp, Homo sapiens
  misc_feature 1..88: note = chr22:22863219-22863307
  misc_feature 1..88: note = hyper
  source 1..88: mol_type = genomic DNA
ggggttaaattgagaaggaggagggcagcagcaatacccctgaggccttgaaaggatcttgggttccggatcacggttccaggcagtc

SEQ ID NO: 4904 - DNA, 258 bp, Homo sapiens
  misc_feature 1..258: note = chr22:25678357-25678615
  misc_feature 1..258: note = hyper
  source 1..258: mol_type = genomic DNA
tagcagaggcctccccgatgccccttgagtagtgggcacggggcccagggcttctctggatgagctgggcgggcatgagaacgcatggagctgggggcaggaggtcggagcagcgaacgaggaggagaaggagtaggcggaggccgaaggagaggtgggggaggaagaagaggaggaggaggagtcccttgtggccaccccgaagggagggagggctaccgtagagacttggtcgagaggcgcgggacaagcctggcc

SEQ ID NO: 4905 - DNA, 253 bp, Homo sapiens
  misc_feature 1..253: note = chr22:25678616-25678869
  misc_feature 1..253: note = hyper
  source 1..253: mol_type = genomic DNA
ctgggactgtgcgctgaggtgcaccgaccgtcgggccgcgagctccccgcagaccctcgcggaatgagctggggggcggcgcgcgaggcggcggagcggaaggcgcactgcgaccccggcgggctacagcctgcggcgcttgcagggcgctggtggggcgcgccgagcaggggctgccctggggctgccccagtcccaccaggtcggggctcagctggcggcggcggcggcggtggcggcagcgcgtcccatc

SEQ ID NO: 4906 - DNA, 208 bp, Homo sapiens
  misc_feature 1..208: note = chr22:25679042-25679250
  misc_feature 1..208: note = hyper
  source 1..208: mol_type = genomic DNA
cgctggtccccacgccgccgtccccaagcggccgtcagcgacctcctgcgtccgggagggtcgggcattgagtcgtcgctgtcctgggtgcgggtgacaccgcggaactggcgatgcggggccggcctccccgttccagtctctgaaatggggcatcggatggccggtgggggggactccgggagagagcgctccaaagtgcccagcg

SEQ ID NO: 4907 - DNA, 198 bp, Homo sapiens
  misc_feature 1..198: note = chr22:25679267-25679465
  misc_feature 1..198: note = hyper
  source 1..198: mol_type = genomic DNA
cgagcgccccagggaggggctggttatgacttggctggaccagctccatccctgtcgccccctccccccggccctgtcctgtcctgtcccatccccgtggttcttcctgttgcattggtgtggtccctgtgggctcgttgcctgtcactcctttgcgctccttcttggtcgctgcttcttccccggctctgtggtccc

SEQ ID NO: 4908 - DNA, 198 bp, Homo sapiens; identical to SEQ ID NO: 1521
  misc_feature 1..198: note = chr22:33453877-33454075
  misc_feature 1..198: note = hyper
  source 1..198: mol_type = genomic DNA

SEQ ID NO: 4909 - DNA, 66 bp, Homo sapiens; identical to SEQ ID NO: 1522
  misc_feature 1..66: note = chr22:33454193-33454259
  misc_feature 1..66: note = hyper
  source 1..66: mol_type = genomic DNA

SEQ ID NO: 4910 - DNA, 90 bp, Homo sapiens; identical to SEQ ID NO: 1523
  misc_feature 1..90: note = chr22:33454345-33454435
  misc_feature 1..90: note = hyper
  source 1..90: mol_type = genomic DNA

SEQ ID NO: 4911 - DNA, 324 bp, Homo sapiens
  misc_feature 1..324: note = chr22:38220648-38220972
  misc_feature 1..324: note = hyper
  source 1..324: mol_type = genomic DNA
cgcagggcccgggcgcgggacgtggcgcgggcccctgcgggagggcacctgcccgccccgctgaccaggcgccctccgcaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgag

SEQ ID NO: 4912 - DNA, 33 bp, Homo sapiens
  misc_feature 1..33: note = chr22:38477099-38477132
  misc_feature 1..33: note = hyper
  source 1..33: mol_type = genomic DNA
cagacgcgccaggcccgccagggcgccgcacgc

SEQ ID NO: 4913 - DNA, 498 bp, Homo sapiens
  misc_feature 1..498: note = chr22:38477296-38477794
  misc_feature 1..498: note = hyper
  source 1..498: mol_type = genomic DNA
cggtgcacactgccaagtccagcaggcgccggcggggccggaccctgggggatgcctcgcgcagctgcagccccgcaccgtcagcctccgcctcgcccggagcgtccccggcgcggtcgccggcgctgtccctgcgcggtcgcgggcccggcccgggcggcggcctcatgacagccccgcaggcgcagcagtgcagcaggagcccgccgagcagcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccga

SEQ ID NO: 4914 - DNA, 409 bp, Homo sapiens
  misc_feature 1..409: note = chr22:42310042-42310451
  misc_feature 1..409: note = hyper
  source 1..409: mol_type = genomic DNA
tgctgggagaaccagcgcttcgagagcggcgggaaggatcagcgggcagggagagcagtccgaggagcaggcgggggtccctgggcggcgcgtgctcacctggtcactgtgcgccgcgcgcgcgggctgtgcgccctctccagtcccaggcgcgccccgatgccggccagcaccagcagcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttga

SEQ ID NO: 4915 - DNA, 369 bp, Homo sapiens
  misc_feature 1..369: note = chr22:42353611-42353980
  misc_feature 1..369: note = hyper
  source 1..369: mol_type = genomic DNA
ctccctctgggtgggcgggacagggagcacctctgctggccctcaccacgctgtgtctccgcagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaagg

SEQ ID NO: 4916 - DNA, 234 bp, Homo sapiens
  misc_feature 1..234: note = chr22:44258285-44258519
  misc_feature 1..234: note = hyper
  source 1..234: mol_type = genomic DNA
cgccgcctcccggctcgcagcccgcacgcgcccgcgcccgcgcccgcgcccgcgccccgcacacgctcgcgccccaccggcgcgcggcggcagctccgcaggcgtgacgtcatggcgccgccgacgcgcggcggaggctccgcgggtatgacgtcatggcgccgcccggcacgcggccgcggcgctgcacgggcgtgacgtcatggcgccgcggagccgcgtcctccccgcccc

SEQ ID NO: 4917 - DNA, 442 bp, Homo sapiens
  misc_feature 1..442: note = chr22:46262610-46263052
  misc_feature 1..442: note = hyper
  source 1..442: mol_type = genomic DNA
gccacagcccgggagcgaggagcgcgggaggaccggcctgcctgtgcccggcaaagggggcccttccgaggcgggctcccttccccgccgctcccgtaagcgcgggagccagaggaccccagacccgccgcggcccaccccaagccccgatcaagtcctgcagcgcgggagggacccctgcaggcgcggggccagacgggcgacaaagcggcggactgcgagggccctgaggaagccggcggcgcggggtcaggagcaacctgctattcgtagggtcaggagcccacgcgtccccactgcggagggcggggtcgcagccaggcctccccgtttctagctgtgcggcctggggcgaggtgcttgacctctcggggcctcagtttccttctctatgaagcggagctgatcggccgcgtcccggggctgctgtgacagtccaagg

SEQ ID NO: 4918 - DNA, 309 bp, Homo sapiens
  misc_feature 1..309: note = chr22:48885529-48885838
  misc_feature 1..309: note = hyper
  source 1..309: mol_type = genomic DNA
ggccccggccccggcacggccctctgggccccggaccccctcctccggccccggcaggcgccccgcgggcctcccggagtcggcgcggagttacgagcgccgggcgcatggtcccccgagtcccggccggtccaacgctgcgctgggcgggcgagagggtccacccgggttccgggcgctcgagcacttcggggtcggacgccccggcccgagcctcccttccctgactccccggcagggcccgggctccaggccccgggtggcgcggcccgtccctgcccggcggtcggagcccagccagcggcttcc

SEQ ID NO: 4919 - DNA, 148 bp, Homo sapiens; identical to SEQ ID NO: 1524
  misc_feature 1..148: note = chr22:48971532-48971680
  misc_feature 1..148: note = hyper
  source 1..148: mol_type = genomic DNA

SEQ ID NO: 4920 - DNA, 201 bp, Homo sapiens; identical to SEQ ID NO: 1525
  misc_feature 1..201: note = chr22:48971758-48971959
  misc_feature 1..201: note = hyper
  source 1..201: mol_type = genomic DNA

SEQ ID NO: 4921 - DNA, 176 bp, Homo sapiens; identical to SEQ ID NO: 1526
  misc_feature 1..176: note = chr22:48971960-48972136
  misc_feature 1..176: note = hyper
  source 1..176: mol_type = genomic DNA

SEQ ID NO: 4922 - DNA, 212 bp, Homo sapiens
  misc_feature 1..212: note = chr22:50496971-50497183
  misc_feature 1..212: note = hyper
  source 1..212: mol_type = genomic DNA
cgcccccctgtggaggtcacactccatcccccaccaggtcacaaagacccgcgggtcacatcctgcccctccccctcgggccccccaggcccgccaggccttctcgccctccccggggccctcatgccgccctctgtccctgggcccttccccgacgcgaggctggagcggcggggtgaggaggccgcgggcgctgggctcctcccgggctg

SEQ ID NO: 4923 - DNA, 74 bp, Homo sapiens
  misc_feature 1..74: note = chr22:50497213-50497287
  misc_feature 1..74: note = hyper
  source 1..74: mol_type = genomic DNA
cggggtgaccgtatcagcgccccccgtcctgcggcggaacttgggagggccttggtatccgcagaaccactcgt

SEQ ID NO: 4924 - DNA, 59 bp, Homo sapiens
  misc_feature 1..59: note = chr22:50623656-50623715
  misc_feature 1..59: note = hyper
  source 1..59: mol_type = genomic DNA
ctgagcgtccgggtccgtgaggccgggggtcggcccgccctaagactcccacctggtcc

SEQ ID NO: 4925 - DNA, 120 bp, Homo sapiens
  misc_feature 1..120: note = chr22:50623741-50623861
  misc_feature 1..120: note = hyper
  source 1..120: mol_type = genomic DNA
cggggcccctggggcccgaccttcccggggtgccccaacctgcggcaaggccgaggtcccgctgaggcatgagtcccgggtcggggaccgctctgggccgacccccggaggacggactag

SEQ ID NO: 4926 - DNA, 88 bp, Homo sapiens; identical to SEQ ID NO: 1527
  misc_feature 1..88: note = chr22:51042317-51042405
  misc_feature 1..88: note = hyper
  source 1..88: mol_type = genomic DNA

SEQ ID NO: 4927 - DNA, 109 bp, Homo sapiens; identical to SEQ ID NO: 1528
  misc_feature 1..109: note = chr22:51042457-51042566
  misc_feature 1..109: note = hyper
  source 1..109: mol_type = genomic DNA

SEQ ID NO: 4928 - DNA, 420 bp, Homo sapiens; identical to SEQ ID NO: 1529
  misc_feature 1..420: note = AC241851.2_88-34049:15130-15550
  misc_feature 1..420: note = hyper
  source 1..420: mol_type = genomic DNA

SEQ ID NO: 4929 - DNA, 36 bp, Homo sapiens
  misc_feature 1..36: note = JH636052.4:1362180-1362216
  misc_feature 1..36: note = hyper
  source 1..36: mol_type = genomic DNA
acgccctatcggtgatgtcaccgacagtgcctttcc

SEQ ID NO: 4930 - DNA, 146 bp, Homo sapiens; identical to SEQ ID NO: 1530
  misc_feature 1..146: note = chr1:1235932-1236078
  misc_feature 1..146: note = hypo
  source 1..146: mol_type = genomic DNA

SEQ ID NO: 4931 - DNA, 692 bp, Homo sapiens; identical to SEQ ID NO: 1531
  misc_feature 1..692: note = chr1:1267466-1268158
  misc_feature 1..692: note = hypo
  source 1..692: mol_type = genomic DNA

SEQ ID NO: 4932 - DNA, 224 bp, Homo sapiens
  misc_feature 1..224: note = chr1:2267466-2267690
  misc_feature 1..224: note = hypo
  source 1..224: mol_type = genomic DNA
gtgtccccgcctgcacgtgccgcggtgtgcacctggtcccactcctgtcctccagctcacagagtcccctcaagccactgccctgaaccctggccaccagccgtcttcctctgagaggccccgcacccctcctgcctctctgcttctgcatgcccacagcctggtccgcccggcgggtctgggagttgtggtgatcgaagcagatggaccggctccagctccac

SEQ ID NO: 4933 - DNA, 128 bp, Homo sapiens; identical to SEQ ID NO: 1532
  misc_feature 1..128: note = chr1:6166321-6166449
  misc_feature 1..128: note = hypo
  source 1..128: mol_type = genomic DNA

SEQ ID NO: 4934 - DNA, 103 bp, Homo sapiens
  misc_feature 1..103: note = chr1:27190175-27190278
  misc_feature 1..103: note = hypo
  source 1..103: mol_type = genomic DNA
gcaagaaggagatgccgcccaccaaccccatccgcctgggcctggccctgaacttttccgtcttccactacgagatcgccaacagccccgaggaggccatctc

SEQ ID NO: 4935 - DNA, 22 bp, Homo sapiens
  misc_feature 1..22: note = chr1:35664724-35664746
  misc_feature 1..22: note = hypo
  source 1..22: mol_type = genomic DNA
ccaccggcgctagctattctta

SEQ ID NO: 4936 - DNA, 81 bp, Homo sapiens
  misc_feature 1..81: note = chr1:38398328-38398409
  misc_feature 1..81: note = hypo
  source 1..81: mol_type = genomic DNA
acccccggcctattatccccattttatatacaaggcaaccaagttcagagaggttaagtctgaggtcgcagagtgactagc

SEQ ID NO: 4937 - DNA, 156 bp, Homo sapiens; identical to SEQ ID NO: 1533
  misc_feature 1..156: note = chr1:39416821-39416977
  misc_feature 1..156: note = hypo
  source 1..156: mol_type = genomic DNA

SEQ ID NO: 4938 - DNA, 145 bp, Homo sapiens
  misc_feature 1..145: note = chr1:41991640-41991785
  misc_feature 1..145: note = hypo
  source 1..145: mol_type = genomic DNA
gggcgcaccttccaacgccagccagagttgccctcacatactcacgccgcaccacctgcccctgcctggttccagcacagaggggcaggaggtggctgggaggaggtgagcaagggacagcgtgtcggggcgggggggctccacc

SEQ ID NO: 4939 - DNA, 37 bp, Homo sapiens; identical to SEQ ID NO: 1534
  misc_feature 1..37: note = chr1:45645619-45645656
  misc_feature 1..37: note = hypo
  source 1..37: mol_type = genomic DNA

SEQ ID NO: 4940 - DNA, 90 bp, Homo sapiens
  misc_feature 1..90: note = chr1:70672837-70672927
  misc_feature 1..90: note = hypo
  source 1..90: mol_type = genomic DNA
gtgctgggattacaggtgtcagtcgccgtgcccagcctgagttttaaaggaaaacgaccgtagcagcttttgcaacgttattaatgaggt

SEQ ID NO: 4941 - DNA, 98 bp, Homo sapiens; identical to SEQ ID NO: 1535
  misc_feature 1..98: note = chr1:86860851-86860949
  misc_feature 1..98: note = hypo
  source 1..98: mol_type = genomic DNA

SEQ ID NO: 4942 - DNA, 28 bp, Homo sapiens
  misc_feature 1..28: note = chr1:94343568-94343596
  misc_feature 1..28: note = hypo
  source 1..28: mol_type = genomic DNA
aaatcaaaatttggccgggcgcggtggc

SEQ ID NO: 4943 - DNA, 86 bp, Homo sapiens
  misc_feature 1..86: note = chr1:100437183-100437269
  misc_feature 1..86: note = hypo
  source 1..86: mol_type = genomic DNA
ttccttttattaaacaagtattacttttttccacatatcctattttttagccaaactagtcgttaattagacgtccagtttctgaa

SEQ ID NO: 4944 - DNA, 41 bp, Homo sapiens
  misc_feature 1..41: note = chr1:109585463-109585504
  misc_feature 1..41: note = hypo
  source 1..41: mol_type = genomic DNA
taagaacatcattctcggccaggcgcggtggctcacgcctg

SEQ ID NO: 4945 - DNA, 79 bp, Homo sapiens; identical to SEQ ID NO: 1537
  misc_feature 1..79: note = chr1:151170062-151170141
  misc_feature 1..79: note = hypo
  source 1..79: mol_type = genomic DNA

SEQ ID NO: 4946 - DNA, 102 bp, Homo sapiens; identical to SEQ ID NO: 1538
  misc_feature 1..102: note = chr1:151252684-151252786
  misc_feature 1..102: note = hypo
  source 1..102: mol_type = genomic DNA

SEQ ID NO: 4947 - DNA, 45 bp, Homo sapiens; identical to SEQ ID NO: 1539
  misc_feature 1..45: note = chr1:153937124-153937169
  misc_feature 1..45: note = hypo
  source 1..45: mol_type = genomic DNA

SEQ ID NO: 4948 - DNA, 26 bp, Homo sapiens
  misc_feature 1..26: note = chr1:155578901-155578927
  misc_feature 1..26: note = hypo
  source 1..26: mol_type = genomic DNA
actaccgcacccggcccttgccttgt

SEQ ID NO: 4949 - DNA, 40 bp, Homo sapiens; identical to SEQ ID NO: 1540
  misc_feature 1..40: note = chr1:156030121-156030161
  misc_feature 1..40: note = hypo
  source 1..40: mol_type = genomic DNA

SEQ ID NO: 4950 - DNA, 16 bp, Homo sapiens
  misc_feature 1..16: note = chr1:158591676-158591692
  misc_feature 1..16: note = hypo
  source 1..16: mol_type = genomic DNA
ggagtcttgctctgtc

SEQ ID NO: 4951 - DNA, 15 bp, Homo sapiens
  misc_feature 1..15: note = chr1:158591932-158591947
  misc_feature 1..15: note = hypo
  source 1..15: mol_type = genomic DNA
cgtgagccactgcac

SEQ ID NO: 4952 - DNA, 26 bp, Homo sapiens
  misc_feature 1..26: note = chr1:160451209-160451235
  misc_feature 1..26: note = hypo
  source 1..26: mol_type = genomic DNA
ctgttcctattcggccatcttggctg

SEQ ID NO: 4953 - DNA, 38 bp, Homo sapiens
  misc_feature 1..38: note = chr1:160693915-160693953
  misc_feature 1..38: note = hypo
  source 1..38: mol_type = genomic DNA
ctgtcctcctgaaaacgggtcaggactggccaggcgca

SEQ ID NO: 4954 - DNA, 28 bp, Homo sapiens
  misc_feature 1..28: note = chr1:161367768-161367796
  misc_feature 1..28: note = hypo
  source 1..28: mol_type = genomic DNA
gcgtgaaacaccgcgcctggccaaaaaa

SEQ ID NO: 4955 - DNA, 199 bp, Homo sapiens; identical to SEQ ID NO: 1543
  misc_feature 1..199: note = chr1:195732322-195732521
  misc_feature 1..199: note = hypo
  source 1..199: mol_type = genomic DNA

SEQ ID NO: 4956 - DNA, 36 bp, Homo sapiens
  misc_feature 1..36: note = chr1:202081768-202081804
  misc_feature 1..36: note = hypo
  source 1..36: mol_type = genomic DNA
ccgagcgaaagagcgaaactccgtctcaaaaaaaaa

SEQ ID NO: 4957 - DNA, 31 bp, Homo sapiens
  misc_feature 1..31: note = chr1:212963970-212964001
  misc_feature 1..31: note = hypo
  source 1..31: mol_type = genomic DNA
taaaggttaataggccgggcgaggtggctca

SEQ ID NO: 4958 - DNA, 84 bp, Homo sapiens
  misc_feature 1..84: note = chr1:213189757-213189841
  misc_feature 1..84: note = hypo
  source 1..84: mol_type = genomic DNA
ttgcaattaatgttgcggaagcacagccatagctctcactttaaaatgtacgtgtatgggccgggcgcggtggctcacgcctgt

SEQ ID NO: 4959 - DNA, 143 bp, Homo sapiens
  misc_feature 1..143: note = chr1:245135719-245135862
  misc_feature 1..143: note = hypo
  source 1..143: mol_type = genomic DNA
tgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgc

SEQ ID NO: 4960 - DNA, 30 bp, Homo sapiens
  misc_feature 1..30: note = chr2:9134404-9134434
  misc_feature 1..30: note = hypo
  source 1..30: mol_type = genomic DNA
agaatacagtgaaagcggggcatgatggga

SEQ ID NO: 4961 - DNA, 420 bp, Homo sapiens
  misc_feature 1..420: note = chr2:10153023-10153443
  misc_feature 1..420: note = hypo
  source 1..420: mol_type = genomic DNA
atggtcgggtcatgtgggcaggcgtgcttatgggcaggtcaggtgggcaggtgtgcatgtgggagagtcaggtggacaggattgaatatgggcgggtcaggtgcgcagacatgcgtatggccgggtcacgtgggcaggcgtgcgtttgggcgggtcaggtgggcaggggtgcatatgggcgggtcaggtggacaggcgcacgtatgggtgagtaagatggacaggcatgtgtgtgggagagtcaggtgaacaggattgcttatgggctagtcaggtggacaggtgtgcgtatgggtgtgcctatgggagagtcaggtggacaggattgcgtatagccggatcaggtgggcaggcatgcgtatgagcgagtcaggtgggcagacatgcgtatgggcgggtcaggtggacaggcgtgtgtat

SEQ ID NO: 4962 - DNA, 240 bp, Homo sapiens
  misc_feature 1..240: note = chr2:10153898-10154138
  misc_feature 1..240: note = hypo
  source 1..240: mol_type = genomic DNA
gacacgcgtgcgtatgggcaagtcaggtgggcaggcatgcgtatgggagagtcaggtggacagccctgcgtatgagcgagtcaggtggacaggattgcgtatgggcaagtcaggtggacaggcgtgcgtatgagtgagtcaggtggacaggattgcgtatgggagagtcaggtggacagccctgcgtatgagcgagtcaggtggacaggattgcttatgggcaagtcaggtggacaggcg

SEQ ID NO: 4963 - DNA, 120 bp, Homo sapiens
  misc_feature 1..120: note = chr2:10154318-10154438
  misc_feature 1..120: note = hypo
  source 1..120: mol_type = genomic DNA
caggcgtgcatacgggcgggtcaggtgggcaggcgtttgtgtgggccggtcaggtgggcaggtgttcttatggtcgggtcaggtggacaggcatgtgtatgggtgtgcgtatggacgagt

SEQ ID NO: 4964 - DNA, 120 bp, Homo sapiens
  misc_feature 1..120: note = chr2:10154918-10155038
  misc_feature 1..120: note = hypo
  source 1..120: mol_type = genomic DNA
ggtcaggtgtgcaggtgtttgtatgggcgggtcaggtgggcaggcgttcgtatggtcaggtcaggtgggcaggtgttcctatggtcaggtcaggtggacaggcgtgcgtatgggtgtgca

SEQ ID NO: 4965 - DNA, 80 bp, Homo sapiens; identical to SEQ ID NO: 1544
  misc_feature 1..80: note = chr2:10156306-10156386
  misc_feature 1..80: note = hypo
  source 1..80: mol_type = genomic DNA

SEQ ID NO: 4966 - DNA, 39 bp, Homo sapiens; identical to SEQ ID NO: 1545
  misc_feature 1..39: note = chr2:20642609-20642648
  misc_feature 1..39: note = hypo
  source 1..39: mol_type = genomic DNA

SEQ ID NO: 4967 - DNA, 189 bp, Homo sapiens
  misc_feature 1..189: note = chr2:43408168-43408357
  misc_feature 1..189: note = hypo
  source 1..189: mol_type = genomic DNA
ctgtgcctgacattacgctgggtgccgcaggtacaatggtgaacgacacagacccaatccctgccctgggagagtgaatcatctagcaacggagacaaatattcaatacacacccaacgcatagttagtgagtattgcagagagtgaagggtgcgatgggatcagatttcccagcgggcccaagagagg

SEQ ID NO: 4968 - DNA, 240 bp, Homo sapiens; identical to SEQ ID NO: 1546
  misc_feature 1..240: note = chr2:47598278-47598518
  misc_feature 1..240: note = hypo
  source 1..240: mol_type = genomic DNA

SEQ ID NO: 4969 - DNA, 42 bp, Homo sapiens; identical to SEQ ID NO: 1547
  misc_feature 1..42: note = chr2:47598578-47598620
  misc_feature 1..42: note = hypo
  source 1..42: mol_type = genomic DNA

SEQ ID NO: 4970 - DNA, 86 bp, Homo sapiens
  misc_feature 1..86: note = chr2:62589799-62589885
  misc_feature 1..86: note = hypo
  source 1..86: mol_type = genomic DNA
cagagggctgcctgacgagggccagagggcagtgctgcagcacacctgagaggaatctttaccgggaactgcgggtggagctgggc

SEQ ID NO: 4971 - DNA, 24 bp, Homo sapiens
  misc_feature 1..24: note = chr2:67625740-67625764
  misc_feature 1..24: note = hypo
  source 1..24: mol_type = genomic DNA
tacagccaccgcgcccggccacct

SEQ ID NO: 4972 - DNA, 160 bp, Homo sapiens; identical to SEQ ID NO: 1549
  misc_feature 1..160: note = chr2:74454159-74454319
  misc_feature 1..160: note = hypo
  source 1..160: mol_type = genomic DNA

SEQ ID NO: 4973 - DNA, 43 bp, Homo sapiens
  misc_feature 1..43: note = chr2:86423726-86423769
  misc_feature 1..43: note = hypo
  source 1..43: mol_type = genomic DNA
ccattgattctgtaatcaaaataaaacacgttaaatattaagc

SEQ ID NO: 4974 - DNA, 140 bp, Homo sapiens
  misc_feature 1..140: note = chr2:88990189-88990329
  misc_feature 1..140: note = hypo
  source 1..140: mol_type = genomic DNA
agattcaagagctcacggcctcagagggcaaagcatagttaagaaaatctaggtgataaccggcagttaacagtggcccataccagtgacttgcgctcacggaagagttctgaaggcctggaatgcgtttgaagatgagt

SEQ ID NO: 4975 - DNA, 92 bp, Homo sapiens; identical to SEQ ID NO: 1550
  misc_feature 1..92: note = chr2:97427763-97427855
  misc_feature 1..92: note = hypo
  source 1..92: mol_type = genomic DNA

SEQ ID NO: 4976 - DNA, 100 bp, Homo sapiens; identical to SEQ ID NO: 1551
  misc_feature 1..100: note = chr2:99798646-99798746
  misc_feature 1..100: note = hypo
  source 1..100: mol_type = genomic DNA

SEQ ID NO: 4977 - DNA, 28 bp, Homo sapiens
  misc_feature 1..28: note = chr2:101835069-101835097
  misc_feature 1..28: note = hypo
  source 1..28: mol_type = genomic DNA
gcatgagccaccgcgcccagcctagtca

SEQ ID NO: 4978 - DNA, 223 bp, Homo sapiens
  misc_feature 1..223: note = chr2:122495312-122495535
  misc_feature 1..223: note = hypo
  source 1..223: mol_type = genomic DNA
aggcgtgagccaccgcgcccggccctaatttggttattctttcactcacttgtgtgtgagctctcctgtgtggccccgtccgtccgcggcccttggagaacttacagcctgagggcagcatggctgctttaagagaccaaagaggcttgtgggggagaggcacactgggtggcgccggagggtcccccttaggaggtggcgttagcaccgaggcctgaaggct

SEQ ID NO: 4979 - DNA, 59 bp, Homo sapiens
  misc_feature 1..59: note = chr2:127428985-127429044
  misc_feature 1..59: note = hypo
  source 1..59: mol_type = genomic DNA
gctttatcacaggcacgagcacaggggagcaacctctccacgcacggggccaggtgtca

SEQ ID NO: 4980 - DNA, 21 bp, Homo sapiens
  misc_feature 1..21: note = chr2:128616617-128616638
  misc_feature 1..21: note = hypo
  source 1..21: mol_type = genomic DNA
aaaaatgaattgtgccgggca

SEQ ID NO: 4981 - DNA, 39 bp, Homo sapiens; identical to SEQ ID NO: 1553
  misc_feature 1..39: note = chr2:128847684-128847723
  misc_feature 1..39: note = hypo
  source 1..39: mol_type = genomic DNA

SEQ ID NO: 4982 - DNA, 41 bp, Homo sapiens
  misc_feature 1..41: note = chr2:170551801-170551842
  misc_feature 1..41: note = hypo
  source 1..41: mol_type = genomic DNA
tttgtgcacatacagcgctggtaggtttttggaactatacc

SEQ ID NO: 4983 - DNA, 27 bp, Homo sapiens
  misc_feature 1..27: note = chr2:170681885-170681912
  misc_feature 1..27: note = hypo
  source 1..27: mol_type = genomic DNA
agaggcagggcgcggcggctcacgcct

SEQ ID NO: 4984 - DNA, 27 bp, Homo sapiens
  misc_feature 1..27: note = chr2:170682152-170682179
  misc_feature 1..27: note = hypo
  source 1..27: mol_type = genomic DNA
agagcgagactccgtctcaaaaaaaaa

SEQ ID NO: 4985 - DNA, 38 bp, Homo sapiens
  misc_feature 1..38: note = chr2:179317019-179317057
  misc_feature 1..38: note = hypo
  source 1..38: mol_type = genomic DNA
aaaaaaaaaaaaaaaaaaaaaagcgatttgttgttttg

SEQ ID NO: 4986 - DNA, 298 bp, Homo sapiens
  misc_feature 1..298: note = chr2:240168811-240169109
  misc_feature 1..298: note = hypo
  source 1..298: mol_type = genomic DNA
tggagactagctctgcggtctgctcgtggataaccgcgctccctcgctgccgggccacccgcacagccgggcaaaccaaaaggcccactttttcatgctgtacccaccacttctgtttccccgcaggcatcctactttctaaactaacaccttttcactcccgagaattctaacaaatattatacaattcctacccgcatctaccctccacctggacgtagaacccgtgtgggaggcagtcctgcagggtttggggtggaatatcccccctgtcgagtggagacgaggctgacatgag

SEQ ID NO: 4987 - DNA, 53 bp, Homo sapiens
  misc_feature 1..53: note = chr2:242524008-242524061
  misc_feature 1..53: note = hypo
  source 1..53: mol_type = genomic DNA
gaagctctaggtttacggggtcaccttcttgtaggtgacgtgaagatgctgag

SEQ ID NO: 4988 - DNA, 120 bp, Homo sapiens
  misc_feature 1..120: note = chr2:242636861-242636981
  misc_feature 1..120: note = hypo
  source 1..120: mol_type = genomic DNA
aaaaaaagtacatgggtaaactgtggaacatccggacgttggaatatttttcaaattaaacatgaactagctattaagccacggaaaggcacgctgggaccttaaatgcatattgctgag

SEQ ID NO: 4989 - DNA, 91 bp, Homo sapiens
  misc_feature 1..91: note = chr2:242637041-242637132
  misc_feature 1..91: note = hypo
  source 1..91: mol_type = genomic DNA
aaaagcaaactggaaacagtaaaatgatcagtggttgccaggggcctcgggagggggagagggatgaatcgggaagcgcaggggattttta

SEQ ID NO: 4990 - DNA, 145 bp, Homo sapiens
  misc_feature 1..145: note = chr2:242925496-242925641
  misc_feature 1..145: note = hypo
  source 1..145: mol_type = genomic DNA
tctcaaaagatacttcgagcaaaaacaccggacagaagcgtccgtgccagccccgcaggctgcctgtgtgccaggctatcccgtgccatctgatccgggagaagcaggactttcttgcacaggtactcagcgctgtggctgtggg

SEQ ID NO: 4991 - DNA, 45 bp, Homo sapiens
  misc_feature 1..45: note = chr3:42640855-42640900
  misc_feature 1..45: note = hypo
  source 1..45: mol_type = genomic DNA
tatatggtcacaaggcgaaggtaattcaatgtataagagtctttt

SEQ ID NO: 4992 - DNA, 33 bp, Homo sapiens
  misc_feature 1..33: note = chr3:48236539-48236572
  misc_feature 1..33: note = hypo
  source 1..33: mol_type = genomic DNA
gggcgcggtggctcacgcctgtaatcccagcac

SEQ ID NO: 4993 - DNA, 91 bp, Homo sapiens
  misc_feature 1..91: note = chr3:73045514-73045605
  misc_feature 1..91: note = hypo
  source 1..91: mol_type = genomic DNA
ccctcccaaagtgttgggatcaccggcctgagccccctgcccggcctcgctctacgttttttaggcgcattctgaacgtgaagtgtataca

SEQ ID NO: 4994 - DNA, 143 bp, Homo sapiens; identical to SEQ ID NO: 1556
  misc_feature 1..143: note = chr3:101230961-101231104
  misc_feature 1..143: note = hypo
  source 1..143: mol_type = genomic DNA

SEQ ID NO: 4995 - DNA, 105 bp, Homo sapiens
  misc_feature 1..105: note = chr3:101397240-101397345
  misc_feature 1..105: note = hypo
  source 1..105: mol_type = genomic DNA
caaatgcaccctctgcgaacccaggaggctggtctacgtgtcaggccaaccccactctcctgtcatactgtctttaaatattttggccgggcgcggtgactcacg

SEQ ID NO: 4996 - DNA, 22 bp, Homo sapiens
  misc_feature 1..22: note = chr3:113557437-113557459
  misc_feature 1..22: note = hypo
  source 1..22: mol_type = genomic DNA
aagtttccgagcaattcacctt

SEQ ID NO: 4997 - DNA, 19 bp, Homo sapiens
  misc_feature 1..19: note = chr3:122234242-122234261
  misc_feature 1..19: note = hypo
  source 1..19: mol_type = genomic DNA
aaaataattaagggccggg

SEQ ID NO: 4998 - DNA, 79 bp, Homo sapiens
  misc_feature 1..79: note = chr3:122234561-122234640
  misc_feature 1..79: note = hypo
  source 1..79: mol_type = genomic DNA
ataataataataataatgaaactacatgaaacacatactcgttttactctcaactgctctcaaacgaaaacttggagca

SEQ ID NO: 4999 - DNA, 28 bp, Homo sapiens
  misc_feature 1..28: note = chr3:130519901-130519929
  misc_feature 1..28: note = hypo
  source 1..28: mol_type = genomic DNA
tgtaaattggccaggcgtcgtggctcat

SEQ ID NO: 5000 - DNA, 133 bp, Homo sapiens
  misc_feature 1..133: note = chr3:141174349-141174482
  misc_feature 1..133: note = hypo
  source 1..133: mol_type = genomic DNA
tgctcctgctgaacacgacgacattccagccaccgggaactgctcgggactcagtatcattctcagacctaggcaggagcgttccgtgcttgccctcctccacaggtgccccgccgcacggggcaaagagtct

SEQ ID NO: 5001 - DNA, 35 bp, Homo sapiens
  misc_feature 1..35: note = chr3:142913215-142913250
  misc_feature 1..35: note = hypo
  source 1..35: mol_type = genomic DNA
aaagtctcactttgtcgagcaggctagcatggagt

SEQ ID NO: 5002 - DNA, 126 bp, Homo sapiens
  misc_feature 1..126: note = chr3:169540047-169540173
  misc_feature 1..126: note = hypo
  source 1..126: mol_type = genomic DNA
tgtcagcttcctccacgccctgcgcgagctccggctctaccagaccgacctgaaggaaattcccgtcgtcatctttaaaaacctccaccatctcgagctgctcggactgaccggaaaccacctgaa

SEQ ID NO: 5003 - DNA, 235 bp, Homo sapiens; identical to SEQ ID NO: 1557
  misc_feature 1..235: note = chr3:169540374-169540609
  misc_feature 1..235: note = hypo
  source 1..235: mol_type = genomic DNA

SEQ ID NO: 5004 - DNA, 18 bp, Homo sapiens
  misc_feature 1..18: note = chr3:182816009-182816027
  misc_feature 1..18: note = hypo
  source 1..18: mol_type = genomic DNA
ccccgccaacttccaaca

SEQ ID NO: 5005 - DNA, 30 bp, Homo sapiens
  misc_feature 1..30: note = chr3:183965921-183965951
  misc_feature 1..30: note = hypo
  source 1..30: mol_type = genomic DNA
gtgagccaccgcgcccggcagaaatgcatc

SEQ ID NO: 5006 - DNA, 21 bp, Homo sapiens
  misc_feature 1..21: note = chr3:185001914-185001935
  misc_feature 1..21: note = hypo
  source 1..21: mol_type = genomic DNA
tacgcgcggccactttccttt

SEQ ID NO: 5007 - DNA, 90 bp, Homo sapiens; identical to SEQ ID NO: 1558
  misc_feature 1..90: note = chr3:185271296-185271386
  misc_feature 1..90: note = hypo
  source 1..90: mol_type = genomic DNA

SEQ ID NO: 5008 - DNA, 80 bp, Homo sapiens
  misc_feature 1..80: note = chr3:193312128-193312208
  misc_feature 1..80: note = hypo
  source 1..80: mol_type = genomic DNA
gtatagataatttatcgtgtttataaggaatggaatgcattcgttagtttgtttttgttttgttttgagacggagtcttg

SEQ ID NO: 5009 - DNA, 174 bp, Homo sapiens
  misc_feature 1..174: note = chr3:193548530-193548704
  misc_feature 1..174: note = hypo
  source 1..174: mol_type = genomic DNA
caaccacctatttatcgttgcccaggctcctaggcctggatctgtcagccagggcctgcccatggccctgggaggtgatgggagtggtggtagtttcagtctctgatgaaagctgctgaaaccggcacggagcacacatgaaaaggacgaaagagaaggcgcaaggctgactgc

SEQ ID NO: 5010 - DNA, 136 bp, Homo sapiens
  misc_feature 1..136: note = chr3:196069836-196069972
  misc_feature 1..136: note = hypo
  source 1..136: mol_type = genomic DNA
gggattacaggcgtgagccgccgcgcccggctgaacaagacacttctttaagaaatcatgtacttgagataaacgggtctcgtaaggctagcgttgggactatctcttcatttccatgtggcgagcctcctagggc

SEQ ID NO: 5011 - DNA, 60 bp, Homo sapiens
  misc_feature 1..60: note = chr3:196388383-196388443
  misc_feature 1..60: note = hypo
  source 1..60: mol_type = genomic DNA
tcctccaagatcatccgcgtgacggagctgcccggaggtgtgcctcgggactgcaagtgg

SEQ ID NO: 5012 - DNA, 38 bp, Homo sapiens
  misc_feature 1..38: note = chr3:197327004-197327042
  misc_feature 1..38: note = hypo
  source 1..38: mol_type = genomic DNA
ttacaggcgtgagccaccgcgcccggcccaattcaaca

SEQ ID NO: 5013 - DNA, 30 bp, Homo sapiens
  misc_feature 1..30: note = chr4:1299450-1299480
  misc_feature 1..30: note = hypo
  source 1..30: mol_type = genomic DNA
tgttcttctgggtgccggggttctccagag

SEQ ID NO: 5014 - DNA, 151 bp, Homo sapiens
  misc_feature 1..151: note = chr4:2066114-2066265
  misc_feature 1..151: note = hypo
  source 1..151: mol_type = genomic DNA
ggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtgg

SEQ ID NO: 5015 - DNA, 236 bp, Homo sapiens
  misc_feature 1..236: note = chr4:2305682-2305918
  misc_feature 1..236: note = hypo
  source 1..236: mol_type = genomic DNA
aggggcgggatgggccggggctgcggcaggtgagctgagggcttggcactgcgcccatgtcacctgacaggcacccggaacatcagaaacagggaagcgggcccgctggcgcacattttctggtgcatgacgccccacagggcaggtgcctctgcagccagctcctgcccctgcccctcctcacacacagaccccacactcggccagggcccagcacctgccggtggccaagatgg

SEQ ID NO: 5016 - DNA, 158 bp, Homo sapiens
  misc_feature 1..158: note = chr4:3447821-3447979
  misc_feature 1..158: note = hypo
  source 1..158: mol_type = genomic DNA
ccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtcca

SEQ ID NO: 5017 - DNA, 98 bp, Homo sapiens
  misc_feature 1..98: note = chr4:39816677-39816775
  misc_feature 1..98: note = hypo
  source 1..98: mol_type = genomic DNA
ctgggcaagaaaagacgagaaagttttcctgtcgatgtggcctcttggaggctgaactgtgtggcaatgtaactagaaactggagactttatttattt

SEQ ID NO: 5018 - DNA, 38 bp, Homo sapiens
  misc_feature 1..38: note = chr4:39817075-39817113
  misc_feature 1..38: note = hypo
  source 1..38: mol_type = genomic DNA
ggcgtgagccaccgcgcccagcccgaaactggagactt

SEQ ID NO: 5019 - DNA, 150 bp, Homo sapiens
  misc_feature 1..150: note = chr4:75241329-75241479
  misc_feature 1..150: note = hypo
  source 1..150: mol_type = genomic DNA
gccaccgcgcccggcctgaccagcgattcttaaggttaacaggatagtggatgtaatatttctctggagatagattttttattcattggatcgcattcactcttctaccctagtttgcaagtgtttgggagcagacgcatattgcaggaa

SEQ ID NO: 5020 - DNA, 86 bp, Homo sapiens; identical to SEQ ID NO: 1559
  misc_feature 1..86: note = chr4:95127609-95127695
  misc_feature 1..86: note = hypo
  source 1..86: mol_type = genomic DNA

SEQ ID NO: 5021 - DNA, 18 bp, Homo sapiens
  misc_feature 1..18: note = chr4:95762911-95762929
  misc_feature 1..18: note = hypo
  source 1..18: mol_type = genomic DNA
attcggccatcttggctc

SEQ ID NO: 5022 - DNA, 420 bp, Homo sapiens
  misc_feature 1..420: note = chr5:491335-491755
  misc_feature 1..420: note = hypo
  source 1..420: mol_type = genomic DNA
gcatcagggctgcaccgcacctggcatgttgagaggcgccagccacgcgtggtctgggtccggggcgggaggcagtgcccgagagatgaagcatccaagaccaaaaccgcgcagcagttctggctccggctgtggctgcagcggtggccgagcggctccggcacacaggctgggagggacggtgcccgatacaccaggctctgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagcca

SEQ ID NO: 5023 - DNA, 617 bp, Homo sapiens
  misc_feature 1..617: note = chr5:554299-554916
  misc_feature 1..617: note = hypo
  source 1..617: mol_type = genomic DNA
ggcaaggaaaataaacgagccgttacctttcaccaaatcgcactgtattttattcatttagggtgtacacacctatctgctcttcaaaggaattttgggcagattgtaaaattacgctcaacatacagcaaggcgactataaatacaaaagcagcactgaggtgctggtgctgcgggtgggtcacgggataaaccaggcgtggggtctgggtcacgggatgacccgagggtgggtcacgggataaaccaggggtggggtctgggtcacaggatgacccgggggtgggtcacgggataaaccaggggtggggggctgggtcacgggatgaacggggggcgggtcacaggatgaaccgtgggcgggtcatgggataaaccagggtggggtctgggtcacaggatgacccgggggtgggtcacgggataaaccaggggtggggggtgggtcacgggatgaacggggggcgggtcacaggatgaaccgtgggtgggtcatgggataaaccagggtggggtctgggtcacgggatgaacggggttgggggctgggtcacgggatgaaccggggggtgggtcacgggatgaacggggggggggtgggtcacgggctaaaccgg

SEQ ID NO: 5024 - DNA, 17 bp, Homo sapiens
  misc_feature 1..17: note = chr5:555156-555173
  misc_feature 1..17: note = hypo
  source 1..17: mol_type = genomic DNA
aacgggggggtgggtca

SEQ ID NO: 5025 - DNA, 140 bp, Homo sapiens
  misc_feature 1..140: note = chr5:677883-678023
  misc_feature 1..140: note = hypo
  source 1..140: mol_type = genomic DNA
tgtccacgtcagtgacggtcacgttcctgccgtcgatcacctggcagtccttgcacagcttcgaccagttcttgccgtgcatctccctcccggtggccctggcgtccccgtgcacggcaaagcgccggaaggcctcctcc

SEQ ID NO: 5026 - DNA, 125 bp, Homo sapiens
  misc_feature 1..125: note = chr5:1174263-1174388
  misc_feature 1..125: note = hypo
  source 1..125: mol_type = genomic DNA
ggtgacactggaactcgttctgcttgttaaaaatttcaaaccggaacgagactttggagcttattttgtccaagccttttatttttcaaaggaggcaactgcactgagagcgttagactcaaggt

SEQ ID NO: 5027 - DNA, 836 bp, Homo sapiens; identical to SEQ ID NO: 409
  misc_feature 1..836: note = chr5:1294607-1295443
  misc_feature 1..836: note = hypo
  source 1..836: mol_type = genomic DNA

SEQ ID NO: 5028 - DNA, 275 bp, Homo sapiens
  misc_feature 1..275: note = chr5:3324844-3325119
  misc_feature 1..275: note = hypo
  source 1..275: mol_type = genomic DNA
caagagcaaagccaccgctccacgcctgcccggggaattggtggccgagcttatctgggaccactggtccacgcgatgccccgtgacgggccaggaagggttcaggcttggaaatgtcggacggggacgactctgggccttgctggttggtggagctgggagcagcttcattctcctctgactgtgtggacacagccctcaaggggagagggccgcatccctgttccccgccttcctcgccatgactggacgcagcggggcgccctgtccctgcc

SEQ ID NO: 5029 - DNA, 104 bp, Homo sapiens
  misc_feature 1..104: note = chr5:17203073-17203177
  misc_feature 1..104: note = hypo
  source 1..104: mol_type = genomic DNA
gtgatgacaggactgtgaagcagtgggaattggagggctcaggctatggagaaggggaagtccttttgcatatggtattaagaaggcggcggacactgggactg

SEQ ID NO: 5030 - DNA, 33 bp, Homo sapiens; identical to SEQ ID NO: 1561
  misc_feature 1..33: note = chr5:43402630-43402663
  misc_feature 1..33: note = hypo
  source 1..33: mol_type = genomic DNA

SEQ ID NO: 5031 - DNA, 22 bp, Homo sapiens
  misc_feature 1..22: note = chr5:68391002-68391024
  misc_feature 1..22: note = hypo
  source 1..22: mol_type = genomic DNA
gtaatagcattataacgtaact

SEQ ID NO: 5032 - DNA, 31 bp, Homo sapiens
  misc_feature 1..31: note = chr5:79783240-79783271
  misc_feature 1..31: note = hypo
  source 1..31: mol_type = genomic DNA
acagtctagctctatcgcacagaccggagcg

SEQ ID NO: 5033 - DNA, 90 bp, Homo sapiens
  misc_feature 1..90: note = chr5:79947584-79947674
  misc_feature 1..90: note = hypo
  source 1..90: mol_type = genomic DNA
ctaaaacactctttacgccggtttctattgacttgggttaatcgtgtgaccgcggtggctggcacgaacttgacgaaccctagggttagt

SEQ ID NO: 5034 - DNA, 30 bp, Homo sapiens
  misc_feature 1..30: note = chr5:79947734-79947764
  misc_feature 1..30: note = hypo
  source 1..30: mol_type = genomic DNA
tgtggctaggctaagcgttttgagctgcgt

SEQ ID NO: 5035 - DNA, 86 bp, Homo sapiens
  misc_feature 1..86: note = chr5:94982139-94982225
  misc_feature 1..86: note = hypo
  source 1..86: mol_type = genomic DNA
ttatacatgggttaccagcatcgcgacgaccttctgcaaatatttttatagggtaaataactgaatgaagtcgctgggcgcatcta

SEQ ID NO: 5036 - DNA, 30 bp, Homo sapiens; identical to SEQ ID NO: 1562
  misc_feature 1..30: note = chr5:154209957-154209987
  misc_feature 1..30: note = hypo
  source 1..30: mol_type = genomic DNA

SEQ ID NO: 5037 - DNA, 19 bp, Homo sapiens
  misc_feature 1..19: note = chr5:154318148-154318167
  misc_feature 1..19: note = hypo
  source 1..19: mol_type = genomic DNA
atatgcacaagaggccggg

SEQ ID NO: 5038 - DNA, 71 bp, Homo sapiens
  misc_feature 1..71: note = chr5:169532927-169532998
  misc_feature 1..71: note = hypo
  source 1..71: mol_type = genomic DNA
ccaggcaggtggctccggccagcccagccccagcatgagctccttcgacctgccggcgccctccccacctc

SEQ ID NO: 5039 - DNA, 20 bp, Homo sapiens
  misc_feature 1..20: note = chr5:177019993-177020013
  misc_feature 1..20: note = hypo
  source 1..20: mol_type = genomic DNA
ccttctgtcacttttcgtta

SEQ ID NO: 5040 - DNA, 332 bp, Homo sapiens
  misc_feature 1..332: note = chr6:3285157-3285489
  misc_feature 1..332: note = hypo
  source 1..332: mol_type = genomic DNA
atagtgtccaacctacggccaacttcagctgcagttcttggagggcaacggggagaaagagaaaatggaaaccacaggtccgtgagtcttcgagaaaacacccatttagatgtaatatgagacgaggaagcacagcccacgcgcttgggactcacctgagtctgggtgctggctgtactttccaatcactggacccgcagacatgatcgcacccacacggacaagggccaagcaagcgagaagagagaagagagcacattaggtgtggagttagcctagcgtgttcccatgcgacttggttcaagcaaactcccttccgtgtctgggatggc

SEQ ID NO: 5041 - DNA, 30 bp, Homo sapiens; identical to SEQ ID NO: 1564
  misc_feature 1..30: note = chr6:4951289-4951319
  misc_feature 1..30: note = hypo
  source 1..30: mol_type = genomic DNA

SEQ ID NO: 5042 - DNA, 186 bp, Homo sapiens; identical to SEQ ID NO: 1565
  misc_feature 1..186: note = chr6:12288517-12288703
  misc_feature 1..186: note = hypo
  source 1..186: mol_type = genomic DNA

SEQ ID NO: 5043 - DNA, 120 bp, Homo sapiens
  misc_feature 1..120: note = chr6:34170868-34170988
  misc_feature 1..120: note = hypo
  source 1..120: mol_type = genomic DNA
cttctgtcggctccatggagccggaggcccgggtctgcctccgtttggtttgggtggccatggtttgggtggctgcagcggcaccccagggcgctcctgcccccaactcagaaggggcgg

SEQ ID NO: 5044 - DNA, 31 bp, Homo sapiens
  misc_feature 1..31: note = chr6:34171048-34171079
  misc_feature 1..31: note = hypo
  source 1..31: mol_type = genomic DNA
tgatggcagcagccaccgccaggagtgtggg

SEQ ID NO: 5045 - DNA, 66 bp, Homo sapiens
  misc_feature 1..66: note = chr6:35150041-35150107
  misc_feature 1..66: note = hypo
  source 1..66: mol_type = genomic DNA
gagaatcagggcccacgtggcgggcgagggatctgcgacgcagccaccgggcgcccagctggggtc

SEQ ID NO: 5046 - DNA, 251 bp, Homo sapiens
  misc_feature 1..251: note = chr6:37024382-37024633
  misc_feature 1..251: note = hypo
  source 1..251: mol_type = genomic DNA
ggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcagggacctgtcccactgcccgctggaaccagctcagcaggcaccctctgaggggcagagacctcgttccctcagctcc

SEQ ID NO: 5047 - DNA, 36 bp, Homo sapiens
  misc_feature 1..36: note = chr6:42062066-42062102
  misc_feature 1..36: note = hypo
  source 1..36: mol_type = genomic DNA
gcctgagcaacacagcgacaccccatcttttttttt

SEQ ID NO: 5048 - DNA, 180 bp, Homo sapiens
  misc_feature 1..180: note = chr6:52928863-52929043
  misc_feature 1..180: note = hypo
  source 1..180: mol_type = genomic DNA
gggctacagcgagactctgtctcagcaaaacaaaacacggcatttggacttccttattgtagctcgttctctctccccttcactctctcgctctctcccctccctcagcactttcacctccatttctgtgccaaagatgtactacaattttttttttttttgagacggagtctcactctg

SEQ ID NO: 5049 - DNA, 97 bp, Homo sapiens; identical to SEQ ID NO: 1566
  misc_feature 1..97: note = chr6:86302345-86302442
  misc_feature 1..97: note = hypo
  source 1..97: mol_type = genomic DNA

SEQ ID NO: 5050 - DNA, 29 bp, Homo sapiens
  misc_feature 1..29: note = chr6:99396702-99396731
  misc_feature 1..29: note = hypo
  source 1..29: mol_type = genomic DNA
gctgggattacagccgtgagccaccgcgc

SEQ ID NO: 5051 - DNA, 24 bp, Homo sapiens
  misc_feature 1..24: note = chr6:134067447-134067471
  misc_feature 1..24: note = hypo
  source 1..24: mol_type = genomic DNA
gagccaccgcgcccagcctgcctg

SEQ ID NO: 5052 - DNA, 104 bp, Homo sapiens; identical to SEQ ID NO: 1568
  misc_feature 1..104: note = chr6:134589500-134589604
  misc_feature 1..104: note = hypo
  source 1..104: mol_type = genomic DNA

SEQ ID NO: 5053 - DNA, 99 bp, Homo sapiens
  misc_feature 1..99: note = chr6:137144497-137144596
  misc_feature 1..99: note = hypo
  source 1..99: mol_type = genomic DNA
aggaatgcacacattcgcaagtaggtgttacagactccagttaattgtctcccgtcgcgcgcattggctcagcctgtggttaaagctgctcaggaggct

SEQ ID NO: 5054 - DNA, 18 bp, Homo sapiens
  misc_feature 1..18: note = chr6:164114295-164114313
  misc_feature 1..18: note = hypo
  source 1..18: mol_type = genomic DNA
ttatttttttgagaccga

SEQ ID NO: 5055 - DNA, 47 bp, Homo sapiens
  misc_feature 1..47: note = chr7:1030172-1030219
  misc_feature 1..47: note = hypo
  source 1..47: mol_type = genomic DNA
ccaggacgtggtggccgggacacacgggtgcacggcaggcctcacac

SEQ ID NO: 5056 - DNA, 89 bp, Homo sapiens; identical to SEQ ID NO: 1569
  misc_feature 1..89: note = chr7:1641847-1641936
  misc_feature 1..89: note = hypo
  source 1..89: mol_type = genomic DNA

SEQ ID NO: 5057 - DNA, 164 bp, Homo sapiens; identical to SEQ ID NO: 1570
  misc_feature 1..164: note = chr7:1733214-1733378
  misc_feature 1..164: note = hypo
  source 1..164: mol_type = genomic DNA

SEQ ID NO: 5058 - DNA, 190 bp, Homo sapiens
  misc_feature 1..190: note = chr7:3283704-3283894
  misc_feature 1..190: note = hypo
  source 1..190: mol_type = genomic DNA
aagggccaggtaatccgatcatagagtcggcgttcaaaaaaaaaatgaggtattgatatgtttatcctcaccctcataacctgttctattcaaataaattcagtgtgctcagttctgcagggagtgacagagctgccccgaatcagatggtgccacgcacatcccatttctcttgcgggatcattcctgg

SEQ ID NO: 5059 - DNA, 85 bp, Homo sapiens; identical to SEQ ID NO: 1571
  misc_feature 1..85: note = chr7:6124629-6124714
  misc_feature 1..85: note = hypo
  source 1..85: mol_type = genomic DNA

SEQ ID NO: 5060 - DNA, 180 bp, Homo sapiens
  misc_feature 1..180: note = chr7:6524907-6525087
  misc_feature 1..180: note = hypo
  source 1..180: mol_type = genomic DNA
aaacttgaatatttctacgggatggggacgtcacaagaaattgcaaacaaaaaaagctgacaaacaggatctgctacataatttgcgggacggagtgcaaaacaaaaacgcacagttcgcagttcaaaaagcagggcgggggcgaggacctggtgcggtggctcatgcctgtagtcccaa

SEQ ID NO: 5061 - DNA, 273 bp, Homo sapiens; identical to SEQ ID NO: 1572
  misc_feature 1..273: note = chr7:7605157-7605430
  misc_feature 1..273: note = hypo
  source 1..273: mol_type = genomic DNA

SEQ ID NO: 5062 - DNA, 152 bp, Homo sapiens; identical to SEQ ID NO: 1573
  misc_feature 1..152: note = chr7:7605670-7605822
  misc_feature 1..152: note = hypo
  source 1..152: mol_type = genomic DNA

SEQ ID NO: 5063 - DNA, 24 bp, Homo sapiens
  misc_feature 1..24: note = chr7:25132702-25132726
  misc_feature 1..24: note = hypo
  source 1..24: mol_type = genomic DNA
gcgatactccgtctcaaaaaaaaa

SEQ ID NO: 5064 - DNA, 84 bp, Homo sapiens
  misc_feature 1..84: note = chr7:36428640-36428724
  misc_feature 1..84: note = hypo
  source 1..84: mol_type = genomic DNA
gctactgaaggccaacgggctagcagcacctgaaacacaagggctctttgtctggctctgtagcccaggctggaatgcagtggt

SEQ ID NO: 5065 - DNA, 41 bp, Homo sapiens
  misc_feature 1..41: note = chr7:44151615-44151656
  misc_feature 1..41: note = hypo
  source 1..41: mol_type = genomic DNA
gaaccctgatggctacgaggtggcagcgcagatggtgggtt

SEQ ID NO: 5066 - DNA, 264 bp, Homo sapiens; identical to SEQ ID NO: 1574
  misc_feature 1..264: note = chr7:44835120-44835384
  misc_feature 1..264: note = hypo
  source 1..264: mol_type = genomic DNA

SEQ ID NO: 5067 - DNA, 20 bp, Homo sapiens
  misc_feature 1..20: note = chr7:45027140-45027160
  misc_feature 1..20: note = hypo
  source 1..20: mol_type = genomic DNA
cagagcgagactctgtctca

SEQ ID NO: 5068 - DNA, 78 bp, Homo sapiens
  misc_feature 1..78: note = chr7:56018123-56018201
  misc_feature 1..78: note = hypo
  source 1..78: mol_type = genomic DNA
aatcattgatgttgtcggggtagggaccagagttctaactgtggaagaaaggagataaaaatacggaactggtgaagc

SEQ ID NO: 5069 - DNA, 67 bp, Homo sapiens
  misc_feature 1..67: note = chr7:101652623-101652690
  misc_feature 1..67: note = hypo
  source 1..67: mol_type = genomic DNA
acccctcacctaggccgcacagcaccctaatgtacacactgaagaaaggctgcgtggggctgcagag

SEQ ID NO: 5070 - DNA, 30 bp, Homo sapiens; identical to SEQ ID NO: 1575
  misc_feature 1..30: note = chr7:128097589-128097619
  misc_feature 1..30: note = hypo
  source 1..30: mol_type = genomic DNA

SEQ ID NO: 5071 - DNA, 95 bp, Homo sapiens
  misc_feature 1..95: note = chr7:148640241-148640336
  misc_feature 1..95: note = hypo
  source 1..95: mol_type = genomic DNA
agaatcttgttcaatgtgctaaatgtgataggcacttcaatatccacttcaggtgacaaataattagaaatgaggtccaccgtgaaggaaatgga

SEQ ID NO: 5072 - DNA, 223 bp, Homo sapiens; identical to SEQ ID NO: 1576
  misc_feature 1..223: note = chr7:155581330-155581553
  misc_feature 1..223: note = hypo
  source 1..223: mol_type = genomic DNA

SEQ ID NO: 5073 - DNA, 97 bp, Homo sapiens
  misc_feature 1..97: note = chr7:156744702-156744799
  misc_feature 1..97: note = hypo
  source 1..97: mol_type = genomic DNA
tttgatttttatcatataaacttagatattacttttaaacaagtttgaaattgtttttaggacactttccctccaaaattagcggtttgtttaattt

SEQ ID NO: 5074 - DNA, 884 bp, Homo sapiens
  misc_feature 1..884: note = chr7:157262579-157263463
  misc_feature 1..884: note = hypo
  source 1..884: mol_type = genomic DNA
actccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaagacctggctgagtgccgtctgtgcccgtggatgcacgcgcagctctcctggggacactggccctggctccactccctggacagatctgtgcccggcactgggtctgctccctgcacagacccacacctggtgctggcgccactccccggacacacctgcccctggcgctggcctgggttgggtgtgtccgtgtgtccagcgctggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggtgttggcctgtgttgggtgtgtccggcgctggcctgcattgggtgtgtctgtgtgtccggcgctggcctgggttgggtgtgtccgtgtgcccggtgctggcctgcgttgggtgtgtctgtgtgtctggcgctccagcggggag

SEQ ID NO: 5075 - DNA, 39 bp, Homo sapiens
  misc_feature 1..39: note = chr8:37961863-37961902
  misc_feature 1..39: note = hypo
  source 1..39: mol_type = genomic DNA
acaacaagaaaacacaaaattctgcgaccatatgttaaa

SEQ ID NO: 5076 - DNA, 32 bp, Homo sapiens
  misc_feature 1..32: note = chr8:42749968-42750000
  misc_feature 1..32: note = hypo
  source 1..32: mol_type = genomic DNA
ttacaggcgcgagacaccgcgcctggccacgt

SEQ ID NO: 5077 - DNA, 115 bp, Homo sapiens
  misc_feature 1..115: note = chr8:58130301-58130416
  misc_feature 1..115: note = hypo
  source 1..115: mol_type = genomic DNA
ggaagacacatctgacgagatcgaatgttttgcagaagagccatgtgaccagatccctggtttggcagaggagacatgcgagaagacggaacgttttggccgaggagacatctgg

SEQ ID NO: 5078 - DNA, 22 bp, Homo sapiens
  misc_feature 1..22: note = chr8:66560523-66560545
  misc_feature 1..22: note = hypo
  source 1..22: mol_type = genomic DNA
ttacaggcgtgagtcaccatgc

SEQ ID NO: 5079 - DNA, 137 bp, Homo sapiens; identical to SEQ ID NO: 1578
  misc_feature 1..137: note = chr8:90913516-90913653
  misc_feature 1..137: note = hypo
  source 1..137: mol_type = genomic DNA

SEQ ID NO: 5080 - DNA, 99 bp, Homo sapiens
  misc_feature 1..99: note = chr8:92083523-92083622
  misc_feature 1..99: note = hypo
  source 1..99: mol_type = genomic DNA
gaaataaatgtttgtcgttgcctacaccatttgaaaacagctgtccacttctgttaaatgttaaactgcttttttttttttttttgagacggtgtctcg

SEQ ID NO: 5081 - DNA, 16 bp, Homo sapiens
  misc_feature 1..16: note = chr8:103629866-103629882
  misc_feature 1..16: note = hypo
  source 1..16: mol_type = genomic DNA
acgtagacctaacaaa

SEQ ID NO: 5082 - DNA, 91 bp, Homo sapiens; identical to SEQ ID NO: 1580
  misc_feature 1..91: note = chr8:133686745-133686836
  misc_feature 1..91: note = hypo
  source 1..91: mol_type = genomic DNA

SEQ ID NO: 5083 - DNA, 17 bp, Homo sapiens
  misc_feature 1..17: note = chr8:135301235-135301252
  misc_feature 1..17: note = hypo
  source 1..17: mol_type = genomic DNA
gccggccagatcccaca

SEQ ID NO: 5084 - DNA, 119 bp, Homo sapiens
  misc_feature 1..119: note = chr8:140834148-140834267
  misc_feature 1..119: note = hypo
  source 1..119: mol_type = genomic DNA
tcgtagtgccatgctcggctattggctgggcctaaattgttccttactctgagaattcgttaagtggctgagcaataaagaagagagatttgagagttctttctcggcacaatggcttt

SEQ ID NO: 5085 - DNA, 38 bp, Homo sapiens
  misc_feature 1..38: note = chr8:141588102-141588140
  misc_feature 1..38: note = hypo
  source 1..38: mol_type = genomic DNA
gctacaatgcacacccgtggagtcggctggcagacaat

SEQ ID NO: 5086 - DNA, 198 bp, Homo sapiens
  misc_feature 1..198: note = chr8:143993967-143994165
  misc_feature 1..198: note = hypo
  source 1..198: mol_type = genomic DNA
tctgcctctgccaggcgccgcccgaggcactggcgcatgccaaagccaaagggcacgtggtggaagttcctgccggagcccctgatgtctagccagcgctggggattataccgctcaggcctcgggaacaaggcggcattgcgacccagcgagtagaggaaaacctgtaccaatgtctgcggacggtgcagagcaggg

SEQ ID NO: 5087 - DNA, 98 bp, Homo sapiens
  misc_feature 1..98: note = chr8:146079215-146079313
  misc_feature 1..98: note = hypo
  source 1..98: mol_type = genomic DNA
ggtacatgaagccttcggcattgttggctattagagaaatgcgaatggaagccacggggaggtgccatttcataccattagaagggttataataaaaa

SEQ ID NO: 5088 - DNA, 105 bp, Homo sapiens; identical to SEQ ID NO: 1581
  misc_feature 1..105: note = chr9:6756353-6756458
  misc_feature 1..105: note = hypo
  source 1..105: mol_type = genomic DNA

SEQ ID NO: 5089 - DNA, 30 bp, Homo sapiens
  misc_feature 1..30: note = chr9:37467610-37467640
  misc_feature 1..30: note = hypo
  source 1..30: mol_type = genomic DNA
cctatagatacaaaacgaaagtaataaaac

SEQ ID NO: 5090 - DNA, 30 bp, Homo sapiens
  misc_feature 1..30: note = chr9:37467940-37467970
  misc_feature 1..30: note = hypo
  source 1..30: mol_type = genomic DNA
aaaaaaaaaaaagagcgggtctccttaatt

SEQ ID NO: 5091 - DNA, 90 bp, Homo sapiens
  misc_feature 1..90: note = chr9:100397609-100397699
  misc_feature 1..90: note = hypo
  source 1..90: mol_type = genomic DNA
taaataactatgctgcgtgctttgatttctaacacgaggtttcttgtgtaacctctgtacaaggcacagaaaatacaattccctcccttt

SEQ ID NO: 5092 - DNA, 22 bp, Homo sapiens
  misc_feature 1..22: note = chr9:131580093-131580115
  misc_feature 1..22: note = hypo
  source 1..22: mol_type = genomic DNA
tttgccaatctgggccgggcgc

SEQ ID NO: 5093 - DNA, 221 bp, Homo sapiens
  misc_feature 1..221: note = chr9:131854231-131854452
  misc_feature 1..221: note = hypo
  source 1..221: mol_type = genomic DNA
tgtcagaagacatcccggctgcagtgtggagtgggaaagctaccgggagcagcttcaggcgcacccgcccccgctaactcatcgccttcacttcatccacactcacctgcttaccctgaccccgctccaacctgcccaaggtgcggtgctgggcagaagcccaactcttcaagccctcagaagcctctttgaaatatccacttttcgcggctgggcgcggt

SEQ ID NO: 5094 - DNA, 126 bp, Homo sapiens
  misc_feature 1..126: note = chr9:133773766-133773892
  misc_feature 1..126: note = hypo
  source 1..126: mol_type = genomic DNA
tgctgctagggagggcgcagggtggtggcccccatctaagcccgggtcccctgggctgttggcaactgccgctccggttctgctggccgaacccctcctgccctgggaagccgcttcccatgctgt

SEQ ID NO: 5095 - DNA, 202 bp, Homo sapiens
  misc_feature 1..202: note = chr9:135898911-135899113
  misc_feature 1..202: note = hypo
  source 1..202: mol_type = genomic DNA
cccactgcagggaaacggttaaaatgcgctgggcttcgtttttcccggaagccctcattacctggtattaccttaggtgtggattcctttattcgcctgctgtctgtctctgccaatcaaatgtgagctccgtgagggcggaggggggcggtcctctcggcttcatcatccgagcccagcacaggatcgggcacatcgcggg

SEQ ID NO: 5096 - DNA, 68 bp, Homo sapiens
  misc_feature 1..68: note = chr9:138563212-138563280
  misc_feature 1..68: note = hypo
  source 1..68: mol_type = genomic DNA
aaggcacctggctcccgcaccctcgacggggccctgcccagtggacacgaccacgtggaagcctcttc

SEQ ID NO: 5097 - DNA, 165 bp, Homo sapiens
  misc_feature 1..165: note = chr9:138627636-138627801
  misc_feature 1..165: note = hypo
  source 1..165: mol_type = genomic DNA
tgctgaggacaggggcgcatctgacagcctcctgcctctaccgagctggcttcggggcagctgggcctcccggtgccaataccccccggctgttacctgcctgtcacctgggcgagtcacctggagccgcgtctgtgacatggaagggaacggttacaaaagcca

SEQ ID NO: 5098 - DNA, 35 bp, Homo sapiens
  misc_feature 1..35: note = chr9:138650129-138650164
  misc_feature 1..35: note = hypo
  source 1..35: mol_type = genomic DNA
cccgtgggcctcagccgagacgcaggtgtggccgg

SEQ ID NO: 5099 - DNA, 121 bp, Homo sapiens; identical to SEQ ID NO: 1583
  misc_feature 1..121: note = chr9:139012272-139012393
  misc_feature 1..121: note = hypo
  source 1..121: mol_type = genomic DNA

SEQ ID NO: 5100 - DNA, 17 bp, Homo sapiens
  misc_feature 1..17: note = chr9:139703929-139703946
  misc_feature 1..17: note = hypo
  source 1..17: mol_type = genomic DNA
atgaaagttggtgtccg

SEQ ID NO: 5101 - DNA, 136 bp, Homo sapiens; identical to SEQ ID NO: 1585
  misc_feature 1..136: note = chr9:139704066-139704202
  misc_feature 1..136: note = hypo
  source 1..136: mol_type = genomic DNA

SEQ ID NO: 5102 - DNA, 268 bp, Homo sapiens
  misc_feature 1..268: note = chr9:140127812-140128080
  misc_feature 1..268: note = hypo
  source 1..268: mol_type = genomic DNA
tcctcaaggtgctgacgaagccgctcacacacctcatcgtgcaggtgaggacggccaccgcccccgcccagagagcctgagcaggccggatgggaggaggggaggcccgccctgccctgatggagggtcagcggagggtctgggccctgtcctgggacaggggaggagagggcagcagtgggcagggctgggctggaccccgcgggcgccagagccccgggtgagtcctgagagagggtgcagcacaccgtcacgacccctctggccc

SEQ ID NO: 5103 - DNA, 37 bp, Homo sapiens; identical to SEQ ID NO: 1586
  misc_feature 1..37: note = chr10:5875322-5875359
  misc_feature 1..37: note = hypo
  source 1..37: mol_type = genomic DNA

SEQ ID NO: 5104 - DNA, 39 bp, Homo sapiens
  misc_feature 1..39: note = chr10:15140487-15140526
  misc_feature 1..39: note = hypo
  source 1..39: mol_type = genomic DNA
tgggattacaggcgtgagccacctcgccagccaacttat

SEQ ID NO: 5105 - DNA, 226 bp, Homo sapiens; identical to SEQ ID NO: 1587
  misc_feature 1..226: note = chr10:98129781-98130007
  misc_feature 1..226: note = hypo
  source 1..226: mol_type = genomic DNA

SEQ ID NO: 5106 - DNA, 22 bp, Homo sapiens
  misc_feature 1..22: note = chr10:98528164-98528186
  misc_feature 1..22: note = hypo
  source 1..22: mol_type = genomic DNA
cagaccacggactgatacaggt

SEQ ID NO: 5107 - DNA, 44 bp, Homo sapiens
  misc_feature 1..44: note = chr10:105155356-105155400
  misc_feature 1..44: note = hypo
  source 1..44: mol_type = genomic DNA
taactgctcttaaatgtaactaatccttccgtgcctctctccac

SEQ ID NO: 5108 - DNA, 29 bp, Homo sapiens
  misc_feature 1..29: note = chr10:131936597-131936626
  misc_feature 1..29: note = hypo
  source 1..29: mol_type = genomic DNA
caggcttgagcccccgtgacctgccctgt

SEQ ID NO: 5109 - DNA, 421 bp, Homo sapiens; identical to SEQ ID NO: 1589
  misc_feature 1..421: note = chr10:133951502-133951923
  misc_feature 1..421: note = hypo
  source 1..421: mol_type = genomic DNA

SEQ ID NO: 5110 - DNA, 212 bp, Homo sapiens; identical to SEQ ID NO: 1590
  misc_feature 1..212: note = chr10:134095580-134095792
  misc_feature 1..212: note = hypo
  source 1..212: mol_type = genomic DNA

SEQ ID NO: 5111 - DNA, 274 bp, Homo sapiens
  misc_feature 1..274: note = chr10:134607922-134608196
  misc_feature 1..274: note = hypo
  source 1..274: mol_type = genomic DNA
tctgagctctcagggcgttgcttctttgcccatttatcccgggtcttgggtgagttccagtggcggacagagctcagacaagagcagtgctcgcagcagcgccagcagggacagtggcaatacgagggtcacaggtgtgatcggaggccgccagcctgtgctgggtcaccgtgcggtgccagtgaaggtgccctctgcccaggagctgtgggggagccgggggtgccgccaggacgcagtgtgggtcgctgggaagacccgaaagaggggagga

SEQ ID NO: 5112 - DNA, 471 bp, Homo sapiens
  misc_feature 1..471: note = chr10:134733221-134733692
  misc_feature 1..471: note = hypo
  source 1..471: mol_type = genomic DNA
acgggacaggcctcccggggatggtaccgaccgcagggtcggtaccaaaaatcagcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacactggccctcgggctgagcgacccccgggctgagctgtgcgtggcgctctggccttttcctcactcacctctccttgtcgttttcgttgcccaggcgccgcaggtgcccggcagctttgtccacgctgacggtgtggtgccacgccttcgcacagaggtaggtgaaccggcccctgttcttcccggtggagactgagg

SEQ ID NO: 5113 - DNA, 594 bp, Homo sapiens
  misc_feature 1..594: note = chr10:134942531-134943125
  misc_feature 1..594: note = hypo
  source 1..594: mol_type = genomic DNA
cctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagcc

SEQ ID NO: 5114 - DNA, 257 bp, Homo sapiens
  misc_feature 1..257: note = chr11:1464204-1464461
  misc_feature 1..257: note = hypo
  source 1..257: mol_type = genomic DNA
cagggaatgtgggggcgtctggcaccacagccctggaggcctccttgagggccctgcggtgcaccatcaccctggggggagggcctggcagcgcccggagccccgccgctgacctctgcccttgcccgcaggtccccccactacgcctgccccgaggtgatccgggtgagtcagcgccgccgcgtgcagctctgtggggcccagggtggcggggacctgaccctggtgggaccccagcctgccgcacccccaggtgc

SEQ ID NO: 5115 - DNA, 48 bp, Homo sapiens
  misc_feature 1..48: note = chr11:1868130-1868178
  misc_feature 1..48: note = hypo
  source 1..48: mol_type = genomic DNA
tcagtgctgctggggcgaggcatacacctgtgacgggacctcaggacg

SEQ ID NO: 5116 - DNA, 163 bp, Homo sapiens; identical to SEQ ID NO: 1591
  misc_feature 1..163: note = chr11:9405392-9405555
  misc_feature 1..163: note = hypo
  source 1..163: mol_type = genomic DNA

SEQ ID NO: 5117 - DNA, 171 bp, Homo sapiens
  misc_feature 1..171: note = chr11:60941596-60941767
  misc_feature 1..171: note = hypo
  source 1..171: mol_type = genomic DNA
ctgaatagccatccacgcagaaagctgggagaagaaccttctggacagggagaacaggaattgcaaaggcccaaggtaaccaagttcaataaaaggctacttttccatctccagtcttccgtccacacctgaacacaccatcgtcaaccaggccatcgaggccacaagtta

SEQ ID NO: 5118 - DNA, 28 bp, Homo sapiens
  misc_feature 1..28: note = chr11:64578577-64578605
  misc_feature 1..28: note = hypo
  source 1..28: mol_type = genomic DNA
gtttgttttgagacacggtctttctctt

SEQ ID NO: 5119 - DNA, 99 bp, Homo sapiens
  misc_feature 1..99: note = chr11:66511245-66511344
  misc_feature 1..99: note = hypo
  source 1..99: mol_type = genomic DNA
caggtcccacctttgcgggggaagctggtccccctggattaggctgggagatgcttggggctggttgtaaggtaaaagacggggggtcgttttttcttt

SEQ ID NO: 5120 - DNA, 82 bp, Homo sapiens; identical to SEQ ID NO: 1592
  misc_feature 1..82: note = chr11:66513182-66513264
  misc_feature 1..82: note = hypo
  source 1..82: mol_type = genomic DNA

SEQ ID NO: 5121 - DNA, 82 bp, Homo sapiens; identical to SEQ ID NO: 1593
  misc_feature 1..82: note = chr11:66513564-66513646
  misc_feature 1..82: note = hypo
  source 1..82: mol_type = genomic DNA

SEQ ID NO: 5122 - DNA, 157 bp, Homo sapiens; identical to SEQ ID NO: 1594
  misc_feature 1..157: note = chr11:67072239-67072396
  misc_feature 1..157: note = hypo
  source 1..157: mol_type = genomic DNA

SEQ ID NO: 5123 - DNA, 93 bp, Homo sapiens
  misc_feature 1..93: note = chr11:67797202-67797295
  misc_feature 1..93: note = hypo
  source 1..93: mol_type = genomic DNA
cctacctaccctcagcgcagatcctcccaacacacacatgcaggcagcctcggggcctctgcgggtccctctaccacagcattcccggggaaa

SEQ ID NO: 5124 - DNA, 72 bp, Homo sapiens; identical to SEQ ID NO: 1595
  misc_feature 1..72: note = chr11:69280561-69280633
  misc_feature 1..72: note = hypo
  source 1..72: mol_type = genomic DNA

SEQ ID NO: 5125 - DNA, 34 bp, Homo sapiens
  misc_feature 1..34: note = chr11:72475677-72475711
  misc_feature 1..34: note = hypo
  source 1..34: mol_type = genomic DNA
ccatctttgttcctgcgggcggcggtggccacgc

SEQ ID NO: 5126 - DNA, 348 bp, Homo sapiens
  misc_feature 1..348: note = chr11:76371738-76372086
  misc_feature 1..348: note = hypo
  source 1..348: mol_type = genomic DNA
gggctgaccagccctcggaaggtgcgtggatgcccttgctgtcctggggtggccctgtggggagccggatgaggttgttggacaagttcaggtagatgagtctcgggagcgcggccaggtcggggaaatggagcagtttgttctcccgcaggtcaagccaggtgagctggaactcagcctggggctgggaggccgtctgaaaggcctcgatgctgttgcagctcaggtctagcacccgcagctgctggaggctgaagtcggagatgcaggtgagggaattcctggagaggttgagatgggtcaggcggggcagaccctcgaaggcgccatcctcgatgtccatcagca

SEQ ID NO: 5127 - DNA, 45 bp, Homo sapiens; identical to SEQ ID NO: 1596
  misc_feature 1..45: note = chr11:102961347-102961392
  misc_feature 1..45: note = hypo
  source 1..45: mol_type = genomic DNA

SEQ ID NO: 5128 - DNA, 194 bp, Homo sapiens
  misc_feature 1..194: note = chr12:2566053-2566247
  misc_feature 1..194: note = hypo
  source 1..194: mol_type = genomic DNA
gtctggaacagtgcccggcacaccgcaggtgttcttgtttgttggaggagtgaatatgccagctcagacctaaagtggcagggctgaaagccctgtgtctcagttacgtgcacgtgtggttctaccccacttgagaccttcttgtttaaccactcaaccattcattcatttgcgcagcacgcacctcctgagca

SEQ ID NO: 5129 - DNA, 295 bp, Homo sapiens
  misc_feature 1..295: note = chr12:2964499-2964794
  misc_feature 1..295: note = hypo
  source 1..295: mol_type = genomic DNA
tggtggtaggcttgccgggtgaagccagggaactcccaggactcgctggggaggaagaactcacgctgagcccacgtttgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctg

SEQ ID NO: 5130 - DNA, 89 bp, Homo sapiens; identical to SEQ ID NO: 1597
  misc_feature 1..89: note = chr12:12848467-12848556
  misc_feature 1..89: note = hypo
  source 1..89: mol_type = genomic DNA

SEQ ID NO: 5131 - DNA, 147 bp, Homo sapiens; identical to SEQ ID NO: 1598
  misc_feature 1..147: note = chr12:49657607-49657754
  misc_feature 1..147: note = hypo
  source 1..147: mol_type = genomic DNA

SEQ ID NO: 5132 - DNA, 235 bp, Homo sapiens
  misc_feature 1..235: note = chr12:51421351-51421586
  misc_feature 1..235: note = hypo
  source 1..235: mol_type = genomic DNA
gcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaattgagcttctttattcacgtaaaaacagctag

SEQ ID NO: 5133 - DNA, 21 bp, Homo sapiens
  misc_feature 1..21: note = chr12:51565449-51565470
  misc_feature 1..21: note = hypo
  source 1..21: mol_type = genomic DNA
cgcacccggccgaaaggagat

SEQ ID NO: 5134 - DNA, 20 bp, Homo sapiens
  misc_feature 1..20: note = chr12:51930773-51930793
  misc_feature 1..20: note = hypo
  source 1..20: mol_type = genomic DNA
gagcatgaagctgggcgctg

SEQ ID NO: 5135 - DNA, 97 bp, Homo sapiens; identical to SEQ ID NO: 1599
  misc_feature 1..97: note = chr12:54720206-54720303
  misc_feature 1..97: note = hypo
  source 1..97: mol_type = genomic DNA

SEQ ID NO: 5136 - DNA, 212 bp, Homo sapiens
  misc_feature 1..212: note = chr12:57881112-57881324
  misc_feature 1..212: note = hypo
  source 1..212: mol_type = genomic DNA
ctttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctgga

SEQ ID NO: 5137 - DNA, 75 bp, Homo sapiens
  misc_feature 1..75: note = chr12:58241524-58241599
  misc_feature 1..75: note = hypo
  source 1..75: mol_type = genomic DNA
aaggggtgtgtgcgtgtgggcggacctaggactccagagtataagagctggaactgacctcgggactgtgtcccc

SEQ ID NO: 5138 - DNA, 29 bp, Homo sapiens
  misc_feature 1..29: note = chr12:68978592-68978621
  misc_feature 1..29: note = hypo
  source 1..29: mol_type = genomic DNA
aaaagctttttttccgttttcactagaaa

SEQ ID NO: 5139 - DNA, 23 bp, Homo sapiens
  misc_feature 1..23: note = chr12:96881015-96881038
  misc_feature 1..23: note = hypo
  source 1..23: mol_type = genomic DNA
gtgagccacgacacccagccaat

SEQ ID NO: 5140 - DNA, 101 bp, Homo sapiens; identical to SEQ ID NO: 1601
  misc_feature 1..101: note = chr12:122278479-122278580
  misc_feature 1..101: note = hypo
  source 1..101: mol_type = genomic DNA

SEQ ID NO: 5141 - DNA, 301 bp, Homo sapiens
  misc_feature 1..301: note = chr12:130821371-130821672
  misc_feature 1..301: note = hypo
  source 1..301: mol_type = genomic DNA
atcttacaatatttccggttgttttgtggctgttgactttgcctccatgaggaaattaactcctatggagggcacctagctcggcgtagacccggtcgctaccacctgcgatgccttggaaatgcagccggcggggcccacctgtggagcctgcagaccggaatctctggtctgtgtcctaaccagccctgcaggtgatcccccgcaggtgaaggctgagaacccctgcggtccacgttggcatgcacccaaggcacaagtcattgaaagctaaatttccaggtaacggcctcctggcacc

SEQ ID NO: 5142 - DNA, 522 bp, Homo sapiens; identical to SEQ ID NO: 1602
  misc_feature 1..522: note = chr12:132221602-132222124
  misc_feature 1..522: note = hypo
  source 1..522: mol_type = genomic DNA

SEQ ID NO: 5143 - DNA, 158 bp, Homo sapiens
  misc_feature 1..158: note = chr12:132423555-132423713
  misc_feature 1..158: note = hypo
  source 1..158: mol_type = genomic DNA
gattacaggcgtgagccactatgcccggccctccagatgcatttttaacagctgaattcatgtgtgaaatgacgtaaggtccgcgtagtccttctttctcagagaccagcgtgcgaggcccaagggacccaccttccgtcacccgttctgctttgttt

SEQ ID NO: 5144 - DNA, 20 bp, Homo sapiens
  misc_feature 1..20: note = chr13:96031715-96031735
  misc_feature 1..20: note = hypo
  source 1..20: mol_type = genomic DNA
atgaccggccgggcacggtg

SEQ ID NO: 5145 - DNA, 462 bp, Homo sapiens
  misc_feature 1..462: note = chr13:110434424-110434886
  misc_feature 1..462: note = hypo
  source 1..462: mol_type = genomic DNA
agaagtcaatgctggcgtaggtgttggcagggggcagggcaccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgt

SEQ ID NO: 5146 - DNA, 35 bp, Homo sapiens
  misc_feature 1..35: note = chr13:111278361-111278396
  misc_feature 1..35: note = hypo
  source 1..35: mol_type = genomic DNA
acaccagagaggagccggcgcggagctccaggtgc

SEQ ID NO: 5147 - DNA, 159 bp, Homo sapiens
  misc_feature 1..159: note = chr13:114304752-114304911
  misc_feature 1..159: note = hypo
  source 1..159: mol_type = genomic DNA
gcagactgaaggtgccgttgggagggtagtacttgacctgcagcggctggccgagctcgcggggctggtcctggggaggagaggccactgcctgagtcaggcgggagctggtgtgtgccggtgtctgtgtgttgcgtttgtgtgcgtgtgtgcacacac

SEQ ID NO: 5148 - DNA, 265 bp, Homo sapiens
  misc_feature 1..265: note = chr13:114748399-114748664
  misc_feature 1..265: note = hypo
  source 1..265: mol_type = genomic DNA
ggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcacttt

SEQ ID NO: 5149 - DNA, 528 bp, Homo sapiens; identical to SEQ ID NO: 1603
  misc_feature 1..528: note = chr13:114780555-114781083
  misc_feature 1..528: note = hypo
  source 1..528: mol_type = genomic DNA

SEQ ID NO: 5150 - DNA, 198 bp, Homo sapiens
  misc_feature 1..198: note = chr14:23776958-23777156
  misc_feature 1..198: note = hypo
  source 1..198: mol_type = genomic DNA
cctcttatagccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcacc

SEQ ID NO: 5151 - DNA, 37 bp, Homo sapiens
  misc_feature 1..37: note = chr14:31027390-31027427
  misc_feature 1..37: note = hypo
  source 1..37: mol_type = genomic DNA
tacaggcgtgagccaccgcgcccggccctcaaactgt

SEQ ID NO: 5152 - DNA, 83 bp, Homo sapiens
  misc_feature 1..83: note = chr14:67886562-67886645
  misc_feature 1..83: note = hypo
  source 1..83: mol_type = genomic DNA
ctcaaaaaaaaaaaaaggctgcatccattcgctaagccacatggcagtgggtctgcatctccccagagcgggtgcttttttct

SEQ ID NO: 5153 - DNA, 149 bp, Homo sapiens
  misc_feature 1..149: note = chr14:73167750-73167899
  misc_feature 1..149: note = hypo
  source 1..149: mol_type = genomic DNA
ctccttttatcatgtcggcattctcactctggaaatatctgtcgtgcggaatcagcctgagccccaggagcgctgaagcagcagagagggtcatgccccatcttcccactccagtctccttccccgggggcaagcgcttttgcaccatg

SEQ ID NO: 5154 - DNA, 273 bp, Homo sapiens
  misc_feature 1..273: note = chr14:93154937-93155210
  misc_feature 1..273: note = hypo
  source 1..273: mol_type = genomic DNA
cacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcgg

SEQ ID NO: 5155 - DNA, 49 bp, Homo sapiens
  misc_feature 1..49: note = chr15:59158488-59158537
  misc_feature 1..49: note = hypo
  source 1..49: mol_type = genomic DNA
acagcaggtatgggccgactcactgtctggggcccgcccagcccagccc

SEQ ID NO: 5156 - DNA, 96 bp, Homo sapiens
  misc_feature 1..96: note = chr15:66649845-66649941
  misc_feature 1..96: note = hypo
  source 1..96: mol_type = genomic DNA
cccagaagttgaaggcggcagtgactaggatcgcactgctggcgatccagctggagatccagtctgggtgacagtgagatcttgtcgcaaaaaaaa

SEQ ID NO: 5157 - DNA, 220 bp, Homo sapiens
  misc_feature 1..220: note = chr15:72412089-72412309
  misc_feature 1..220: note = hypo
  source 1..220: mol_type = genomic DNA
gcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtc

SEQ ID NO: 5158 - DNA, 85 bp, Homo sapiens; identical to SEQ ID NO: 1604
  misc_feature 1..85: note = chr15:78596048-78596133
  misc_feature 1..85: note = hypo
  source 1..85: mol_type = genomic DNA

SEQ ID NO: 5159 - DNA, 154 bp, Homo sapiens
  misc_feature 1..154: note = chr16:612869-613023
  misc_feature 1..154: note = hypo
  source 1..154: mol_type = genomic DNA
gtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctc

SEQ ID NO: 5160 - DNA, 283 bp, Homo sapiens; identical to SEQ ID NO: 1605
  misc_feature 1..283: note = chr16:726729-727012
  misc_feature 1..283: note = hypo
  source 1..283: mol_type = genomic DNA

SEQ ID NO: 5161 - DNA, 748 bp, Homo sapiens
  misc_feature 1..748: note = chr16:734930-735678
  misc_feature 1..748: note = hypo
  source 1..748: mol_type = genomic DNA
cagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcaggatctgggtgccaggggcggcgctgcaggggggaggccccgcccaccacacacctgggtctgctcgtcgatgtccttgcgcacccgttcacccaggacgatgagcacagacacagccatctgcacgtcgccctgctcagcgtagaagtgcagcatgtcgcgcaccagcacgccgaagaagtcgggcggcaggcggctgtcgtagagcgcgtgtgagacagacaggagcgagaaggaggagtccacgggggccagggaggccacatccgcctcgctgccgctcacgtgcggggagtcggccttgtcctgcaggtgctcgggcccgggaggcgtgtccacgatctcgtggcgcagcggaaaggcctcctgcggcagcacgcactcagggtcctcggctggaaggcagggaccagcggaggctctgagtctgtcctccatccgcctctgaaccccaccctgcccggacccccactcac

SEQ ID NO: 5162 - DNA, 230 bp, Homo sapiens
  misc_feature 1..230: note = chr16:837308-837538
  misc_feature 1..230: note = hypo
  source 1..230: mol_type = genomic DNA
aatcctgagtccccacgccccaccccaggactgaccaggtcttaccaatgccaggtaagccttggtcacgcgccgctccttgaagcacctgtacgcgctgccggcggctgccttgtttagggccacgcacagcgccccgctggtggagaaatccagctggtggcagaacctggagtgggacagagtccagagtctgagccactttcctccacagacgccaccgtggggct

SEQ ID NO: 5163 - DNA, 205 bp, Homo sapiens; identical to SEQ ID NO: 1606
  misc_feature 1..205: note = chr16:845955-846160
  misc_feature 1..205: note = hypo
  source 1..205: mol_type = genomic DNA

SEQ ID NO: 5164 - DNA, 28 bp, Homo sapiens
  misc_feature 1..28: note = chr16:1407453-1407481
  misc_feature 1..28: note = hypo
  source 1..28: mol_type = genomic DNA
agtcacccagcacctcgtgtgtatttcg

SEQ ID NO: 5165 - DNA, 145 bp, Homo sapiens
  misc_feature 1..145: note = chr16:1428508-1428653
  misc_feature 1..145: note = hypo
  source 1..145: mol_type = genomic DNA
gatcccaccaggctccgtgctaagtcggcagaagcttcacccaccagctgcagagtgcgcagcatgtggaggggctaagctgccttcaatgctcacccgacaaactacggctcgcactcaactcagagggcgtcagccaccacct

SEQ ID NO: 5166 - DNA, 147 bp, Homo sapiens
  misc_feature 1..147: note = chr16:2029023-2029170
  misc_feature 1..147: note = hypo
  source 1..147: mol_type = genomic DNA
ggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcg

SEQ ID NO: 5167 - DNA, 336 bp, Homo sapiens; identical to SEQ ID NO: 1608
  misc_feature 1..336: note = chr16:2234684-2235020
  misc_feature 1..336: note = hypo
  source 1..336: mol_type = genomic DNA

SEQ ID NO: 5168 - DNA, 117 bp, Homo sapiens
  misc_feature 1..117: note = chr16:2770122-2770239
  misc_feature 1..117: note = hypo
  source 1..117: mol_type = genomic DNA
cagcagcagcaggagcggcaccgccgccggccgcctcatgtcctcaggcctggctggggcgcagggccgtggtcggcggtggcagaagcgttggagcacgagcgaggtgcaggctcc

SEQ ID NO: 5169 - DNA, 82 bp, Homo sapiens
  misc_feature 1..82: note = chr16:2770456-2770538
  misc_feature 1..82: note = hypo
  source 1..82: mol_type = genomic DNA
ccccccagcagaccccgagctgaccgcggtgcacgcgaagtccgtccagcttcattcattattattattattatttttttta

SEQ ID NO: 5170 - DNA, 30 bp, Homo sapiens
  misc_feature 1..30: note = chr16:18802453-18802483
  misc_feature 1..30: note = hypo
  source 1..30: mol_type = genomic DNA
gtgagccaccacacccggctaaaaattttt

SEQ ID NO: 5171 - DNA, 45 bp, Homo sapiens
  misc_feature 1..45: note = chr16:18950973-18951018
  misc_feature 1..45: note = hypo
  source 1..45: mol_type = genomic DNA
gctgggattacaggcgtgagtcaccgtgcccggccctcctgcaac

SEQ ID NO: 5172 - DNA, 337 bp, Homo sapiens
  misc_feature 1..337: note = chr16:30017290-30017627
  misc_feature 1..337: note = hypo
  source 1..337: mol_type = genomic DNA
atttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgg

SEQ ID NO: 5173 - DNA, 294 bp, Homo sapiens
  misc_feature 1..294: note = chr16:30124567-30124861
  misc_feature 1..294: note = hypo
  source 1..294: mol_type = genomic DNA
tcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcc

SEQ ID NO: 5174 - DNA, 197 bp, Homo sapiens; identical to SEQ ID NO: 1609
  misc_feature 1..197: note = chr16:31446899-31447096
  misc_feature 1..197: note = hypo
  source 1..197: mol_type = genomic DNA

SEQ ID NO: 5175 - DNA, 18 bp, Homo sapiens
  misc_feature 1..18: note = chr16:68876852-68876870
  misc_feature 1..18: note = hypo
  source 1..18: mol_type = genomic DNA
tttgagatggagtctcgc

SEQ ID NO: 5176 - DNA, 465 bp, Homo sapiens; identical to SEQ ID NO: 1611
  misc_feature 1..465: note = chr16:87723648-87724113
  misc_feature 1..465: note = hypo
  source 1..465: mol_type = genomic DNA

SEQ ID NO: 5177 - DNA, 312 bp, Homo sapiens; identical to SEQ ID NO: 1612
  misc_feature 1..312: note = chr16:88943712-88944024
  misc_feature 1..312: note = hypo
  source 1..312: mol_type = genomic DNA

SEQ ID NO: 5178 - DNA, 160 bp, Homo sapiens
  misc_feature 1..160: note = chr16:88955208-88955368
  misc_feature 1..160: note = hypo
  source 1..160: mol_type = genomic DNA
ccccgggtgggggcacgaggtgggctggccctgagctccagctaccccacacaggccgtgggatcccctgtgtaccaaggggagactgaggtggacacggccctcacgagagccgggccgcgggcggcacctgctggggcgtggccgggggacaccaggg

SEQ ID NO: 5179 - DNA, 541 bp, Homo sapiens
  misc_feature 1..541: note = chr16:88957405-88957946
  misc_feature 1..541: note = hypo
  source 1..541: mol_type = genomic DNA
tcagcaggtttgggccgggccgagagcctgcaaagctgacaagccccgcgtgctgccaccctggtccacggttgatctgggtgtgaccatctgacctgctttcacctgacacctcttcatccatcggcctgcgcagccacagaagccccttcccgcctgtctaccgccctcacctcccgccctcacctctgctctctccaccccacgtattctgttccagtcacactgacccctctgctgttcctcaagcacagcgggcgccccatacctcagggcctctgcacgtgcagttactgctgtctggaaaaccctgcgctggctctgcacctagctccgccctcatcctcagccctcaccaacacgcctccaagcaaaggactttcggaatacttctccaccacgtgcagctgcagatttgagagtggctgtggaccgaacgccttcccaccccagggtgctggctccaggagggacctgctgcatgtcctgggccctatccccgagccttgcccccacactggcacgtcgtcagtgctcaaaa

SEQ ID NO: 5180 - DNA, 549 bp, Homo sapiens
  misc_feature 1..549: note = chr16:88963214-88963763
  misc_feature 1..549: note = hypo
  source 1..549: mol_type = genomic DNA
gccctcccttaggtgcgcttaccagccttgccccgggtgcctggtccttccggcggcctgctcgccctcgcctgcccgcgcactccctcccgcgctgctgggcagtctcagcagctaaagagacgccaaaaataaccccggcacaagcgctttcattcccacgacaggtgtgttcctaagttagaccgcacacgtgtccccagctgaggattgggggcacacgcgagcacccccgcggctcccccagcctcagagccttggtgggggggtcagatgcgacagaggcaccctaacgcagcccctcctgtcacccctgctccttgctgtgggggctccgggatctgggattcaccaactttgccatccataagatcacagagtggatgacaagagccactgtccaggagctgcacgccaggcgcgagtgcgtggccaggcccatcacagaataatggctgtgaaaaggacagccctgtgcaacagaaacaacgcacagttgttctgctgccctcgttcttagagccgggagtgccacgacagccacacctg

SEQ ID NO: 5181 - DNA, 271 bp, Homo sapiens
  misc_feature 1..271: note = chr16:89072503-89072774
  misc_feature 1..271: note = hypo
  source 1..271: mol_type = genomic DNA
ggagcagaaggccaacgcgggtggctgaggagagggcaaggaagaagaggcaggagtccaccgccagtgccaaccaggggcctcggggcaccgctccaggagcaaccccagagtgcatccacctcctcccgggtgggccacgccttgaggtgctgacggcgccccaaactccactccccggaatcggcccaggctcagccacatcggcccgggctcctacagaagccgacctggagacgaggaactgacctggagacgaggaactgacctg

SEQ ID NO: 5182 - DNA, 93 bp, Homo sapiens
  misc_feature 1..93: note = chr16:89120243-89120336
  misc_feature 1..93: note = hypo
  source 1..93: mol_type = genomic DNA
gtgcagggagaaggccgggcgggtgctggggggcccgtctccctgtgactcgtggacggtgcggtgcagggagaagggcgggcaggtgctgga

SEQ ID NO: 5183 - DNA, 71 bp, Homo sapiens; identical to SEQ ID NO: 1613
  misc_feature 1..71: note = chr16:89220327-89220398
  misc_feature 1..71: note = hypo
  source 1..71: mol_type = genomic DNA

SEQ ID NO: 5184 - DNA, 385 bp, Homo sapiens
  misc_feature 1..385: note = chr16:89220641-89221026
  misc_feature 1..385: note = hypo
  source 1..385: mol_type = genomic DNA
gtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcct

SEQ ID NO: 5185 - DNA, 55 bp, Homo sapiens
  misc_feature 1..55: note = chr16:89558648-89558703
  misc_feature 1..55: note = hypo
  source 1..55: mol_type = genomic DNA
cctgataaaaacagccggcgtatgcgctgatgtgcgttcacgaagaggtgatcca

SEQ ID NO: 5186 - DNA, 233 bp, Homo sapiens
  misc_feature 1..233: note = chr16:89883952-89884185
  misc_feature 1..233: note = hypo
  source 1..233: mol_type = genomic DNA
ccaaacataagaattcgtaaaagcgagtgcctaggcgaagctaatgtgcctcaaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggca

SEQ ID NO: 5187 - DNA, 32 bp, Homo sapiens
  misc_feature 1..32: note = chr17:1136665-1136697
  misc_feature 1..32: note = hypo
  source 1..32: mol_type = genomic DNA
gcgtgacccaccgcgcccggcctctttctttc

SEQ ID NO: 5188 - DNA, 120 bp, Homo sapiens; identical to SEQ ID NO: 1614
  misc_feature 1..120: note = chr17:2207818-2207938
  misc_feature 1..120: note = hypo
  source 1..120: mol_type = genomic DNA

SEQ ID NO: 5189 - DNA, 36 bp, Homo sapiens
  misc_feature 1..36: note = chr17:2220961-2220997
  misc_feature 1..36: note = hypo
  source 1..36: mol_type = genomic DNA
actgcactccagccgggataacggagactccatctc

SEQ ID NO: 5190 - DNA, 30 bp, Homo sapiens; identical to SEQ ID NO: 1615
  misc_feature 1..30: note = chr17:3658849-3658879
  misc_feature 1..30: note = hypo
  source 1..30: mol_type = genomic DNA

SEQ ID NO: 5191 - DNA, 268 bp, Homo sapiens
  misc_feature 1..268: note = chr17:18163086-18163354
  misc_feature 1..268: note = hypo
  source 1..268: mol_type = genomic DNA
ccctacccagtttcctcatttgtaaaatactttctaaggttgtcaccatgagcaaattaacaaagaatgcacgtgtagctcgcagcatacagcaggcgctcagtgagtggcaggttattattccgttttgttttgttttgtgcgccaggttattattcccacttagtgtcagcacccctgtgctcgtacccccctacaaagggaggctccagaagagaagcatccgtcttggtccttgctgttcaagggggctcgccctggctgacac

SEQ ID NO: 5192 - DNA, 142 bp, Homo sapiens; identical to SEQ ID NO: 1616
  misc_feature 1..142: note = chr17:25620573-25620715
  misc_feature 1..142: note = hypo
  source 1..142: mol_type = genomic DNA

SEQ ID NO: 5193 - DNA, 33 bp, Homo sapiens; identical to SEQ ID NO: 1617
  misc_feature 1..33: note = chr17:26927180-26927213
  misc_feature 1..33: note = hypo
  source 1..33: mol_type = genomic DNA

SEQ ID NO: 5194 - DNA, 20 bp, Homo sapiens
  misc_feature 1..20: note = chr17:27170162-27170182
  misc_feature 1..20: note = hypo
  source 1..20: mol_type = genomic DNA
tttttttttctgagtcgaag

SEQ ID NO: 5195 - DNA, 86 bp, Homo sapiens
  misc_feature 1..86: note = chr17:27716046-27716132
  misc_feature 1..86: note = hypo
  source 1..86: mol_type = genomic DNA
catacactgtatacacggattgcttaggtctgatcaacatgctccttccttggagcacagatctactatggccagcctggtctcga

SEQ ID NO: 5196 - DNA, 85 bp, Homo sapiens
  misc_feature 1..85: note = chr17:27716192-27716277
  misc_feature 1..85: note = hypo
  source 1..85: mol_type = genomic DNA
gagccaccgggcccggcccagagttaatttttattcatgaaactcatataacaggtttatttatttcagtcgttttgttggttaa

SEQ ID NO: 5197 - DNA, 37 bp, Homo sapiens
  misc_feature 1..37: note = chr17:30250325-30250362
  misc_feature 1..37: note = hypo
  source 1..37: mol_type = genomic DNA
taaagctctatattgcgggcagatcgcaaggtcagga

SEQ ID NO: 5198 - DNA, 31 bp, Homo sapiens
  misc_feature 1..31: note = chr17:33877286-33877317
  misc_feature 1..31: note = hypo
  source 1..31: mol_type = genomic DNA
aggtgcagtggctcacgcctgtaatcccagc

SEQ ID NO: 5199 - DNA, 146 bp, Homo sapiens; identical to SEQ ID NO: 1618
  misc_feature 1..146: note = chr17:39682499-39682645
  misc_feature 1..146: note = hypo
  source 1..146: mol_type = genomic DNA

SEQ ID NO: 5200 - DNA, 102 bp, Homo sapiens; identical to SEQ ID NO: 1619
  misc_feature 1..102: note = chr17:42331669-42331771
  misc_feature 1..102: note = hypo
  source 1..102: mol_type = genomic DNA

SEQ ID NO: 5201 - DNA, 120 bp, Homo sapiens; identical to SEQ ID NO: 1620
  misc_feature 1..120: note = chr17:49229470-49229590
  misc_feature 1..120: note = hypo
  source 1..120: mol_type = genomic DNA

SEQ ID NO: 5202 - DNA, 34 bp, Homo sapiens
  misc_feature 1..34: note = chr17:55037248-55037282
  misc_feature 1..34: note = hypo
  source 1..34: mol_type = genomic DNA
tcatcagaagcatcccgggaaggatgctcgttac

SEQ ID NO: 5203 - DNA, 37 bp, Homo sapiens; identical to SEQ ID NO: 1621
  misc_feature 1..37: note = chr17:57297023-57297060
  misc_feature 1..37: note = hypo
  source 1..37: mol_type = genomic DNA

SEQ ID NO: 5204 - DNA, 16 bp, Homo sapiens
  misc_feature 1..16: note = chr17:67410381-67410397
  misc_feature 1..16: note = hypo
  source 1..16: mol_type = genomic DNA
gcgagactccctctcg

SEQ ID NO: 5205 - DNA, 19 bp, Homo sapiens
  misc_feature 1..19: note = chr17:73031621-73031640
  misc_feature 1..19: note = hypo
  source 1..19: mol_type = genomic DNA
actccagtctctggccggg

SEQ ID NO: 5206 - DNA, 151 bp, Homo sapiens
  misc_feature 1..151: note = chr17:73586267-73586418
  misc_feature 1..151: note = hypo
  source 1..151: mol_type = genomic DNA
caagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttat

SEQ ID NO: 5207 - DNA, 54 bp, Homo sapiens
  misc_feature 1..54: note = chr17:73636283-73636337
  misc_feature 1..54: note = hypo
  source 1..54: mol_type = genomic DNA
ggctgccaccgacttcgtgcaggagatgcgcgccgtgggcgagaggctgctgct

SEQ ID NO: 5208 - DNA, 292 bp, Homo sapiens
  misc_feature 1..292: note = chr17:76137898-76138190
  misc_feature 1..292: note = hypo
  source 1..292: mol_type = genomic DNA
aacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttcc

SEQ ID NO: 5209 - DNA, 31 bp, Homo sapiens; identical to SEQ ID NO: 1623
  misc_feature 1..31: note = chr17:76211256-76211287
  misc_feature 1..31: note = hypo
  source 1..31: mol_type = genomic DNA

SEQ ID NO: 5210 - DNA, 91 bp, Homo sapiens; identical to SEQ ID NO: 1624
  misc_feature 1..91: note = chr17:76211527-76211618
  misc_feature 1..91: note = hypo
  source 1..91: mol_type = genomic DNA

SEQ ID NO: 5211 - DNA, 309 bp, Homo sapiens; identical to SEQ ID NO: 1625
  misc_feature 1..309: note = chr17:79769384-79769693
  misc_feature 1..309: note = hypo
  source 1..309: mol_type = genomic DNA

SEQ ID NO: 5212 - DNA, 67 bp, Homo sapiens; identical to SEQ ID NO: 1626
  misc_feature 1..67: note = chr17:80797692-80797759
  misc_feature 1..67: note = hypo
  source 1..67: mol_type = genomic DNA

SEQ ID NO: 5213 - DNA, 723 bp, Homo sapiens; identical to SEQ ID NO: 1627
  misc_feature 1..723: note = chr17:80797997-80798720
  misc_feature 1..723: note = hypo
  source 1..723: mol_type = genomic DNA

SEQ ID NO: 5214 - DNA, 290 bp, Homo sapiens
  misc_feature 1..290: note = chr18:10589096-10589386
  misc_feature 1..290: note = hypo
  source 1..290: mol_type = genomic DNA
ttctgctgccagccacgtccttgatactttgtgggtgatttatttcattggctcgctattacttggcagcggcggtggctcctcaagccagcgtgggctccaggtggccccgggccgggaggcgatggccccgggccaggaggcgtggccacggccgctcgccggcgtccgtccccaggaacggccagcactggggcagcggaggaggcagcggtggtggtggcaccgggtagaaggcggtggcactgggtagaaggcaccgccgccgcccgccgcgggaggcttccgcg

SEQ ID NO: 5215 - DNA, 72 bp, Homo sapiens
  misc_feature 1..72: note = chr18:55850845-55850917
  misc_feature 1..72: note = hypo
  source 1..72: mol_type = genomic DNA
attgagtattcacttcgaagctccatgctgcacgcatgggcctgtaaatagctttttcgtgcacttgtgggt

SEQ ID NO: 5216 - DNA, 30 bp, Homo sapiens; identical to SEQ ID NO: 1628
  misc_feature 1..30: note = chr18:77329727-77329757
  misc_feature 1..30: note = hypo
  source 1..30: mol_type = genomic DNA

SEQ ID NO: 5217 - DNA, 405 bp, Homo sapiens
  misc_feature 1..405: note = chr19:403367-403772
  misc_feature 1..405: note = hypo
  source 1..405: mol_type = genomic DNA
agacctgaggcagggcgagacaccacgcaggcgcagaatccctggatgacgcccacttggaagtggaggggggagggcatgggcagctgcagctcccagacaccagcacacacaaacgcacacacaagtgcacaccagcagcgacacaggcacacacaagcgcacacagggtcacacatgcatacacggctcacgtgcttacacgtgcacacgccagcacacaggcagctatactcgagtgcctgcaggcgctcacctggcactgtcacatacgcccaacagatgagcacggtaacggcacacgcagtcacactgcacacacatgcggaagcacatggcgacgtgtgtgcacctacctggcacgcacacgcacacacccgtgcagcctagcgatgagtggctggg

SEQ ID NO: 5218 - DNA, 632 bp, Homo sapiens; identical to SEQ ID NO: 1629
  misc_feature 1..632: note = chr19:883582-884214
  misc_feature 1..632: note = hypo
  source 1..632: mol_type = genomic DNA

SEQ ID NO: 5219 - DNA, 460 bp, Homo sapiens; identical to SEQ ID NO: 1630
  misc_feature 1..460: note = chr19:1004981-1005441
  misc_feature 1..460: note = hypo
  source 1..460: mol_type = genomic DNA

SEQ ID NO: 5220 - DNA, 298 bp, Homo sapiens
  misc_feature 1..298: note = chr19:1171099-1171397
  misc_feature 1..298: note = hypo
  source 1..298: mol_type = genomic DNA
cacaacacacaaacacggatgcacagacacgcacacaatgtgcacccataaaacacacgcgtatgaaacacacgagcaacacacacatgcacaggagcacacagccacaggcacgcacattcacacacacacaacgcacccacatccgtacaacacacacacagaacgcgcacacgtccgtacgacgcacacacagaatgcacgtgcgtacgtacaatgcacacaaagaatacacacatccatacaacacacaggcacacaacacacatgtgcatgcacatggcgcaacatacagata

SEQ ID NO: 5221 - DNA, 261 bp, Homo sapiens; identical to SEQ ID NO: 1631
  misc_feature 1..261: note = chr19:1808152-1808413
  misc_feature 1..261: note = hypo
  source 1..261: mol_type = genomic DNA

SEQ ID NO: 5222 - DNA, 109 bp, Homo sapiens
  misc_feature 1..109: note = chr19:2683891-2684000
  misc_feature 1..109: note = hypo
  source 1..109: mol_type = genomic DNA
gctggtggacagcatcggccagaggagctcaaatccgccctcagccccagggggccgagctgcaaaagcgacgtcaaatggacaaaaatcccaccgggcacagaagtgc

SEQ ID NO: 5223 - DNA, 91 bp, Homo sapiens
  misc_feature 1..91: note = chr19:3219543-3219634
  misc_feature 1..91: note = hypo
  source 1..91: mol_type = genomic DNA
tcccacgcgctttacttcctcagtaacatccatggcacgggcatcctgcagtgaccgatgcccaccagactgcatccgctaacaagacagg

SEQ ID NO: 5224 - DNA, 57 bp, Homo sapiens
  misc_feature 1..57: note = chr19:3296613-3296670
  misc_feature 1..57: note = hypo
  source 1..57: mol_type = genomic DNA
cgagggggcctcacccgtgtccgcggcgcccgccgaggcccccgagggcctgcttgg

SEQ ID NO: 5225 - DNA, 194 bp, Homo sapiens
  misc_feature 1..194: note = chr19:3778200-3778394
  misc_feature 1..194: note = hypo
  source 1..194: mol_type = genomic DNA
gcgaggtggagccgtcggcgtcctgccctgagacggaggctggggcacctgcactgcgtagctcccgggccagcttctcggccagtttgcggaagggtggccggcgggcgggctctgcctcccagcagctgctcatgaggacgtgcacggggcctggacagccctcggggggttccatgcggtaccccttctcc

SEQ ID NO: 5226 - DNA, 350 bp, Homo sapiens
  misc_feature 1..350: note = chr19:4548034-4548384
  misc_feature 1..350: note = hypo
  source 1..350: mol_type = genomic DNA
tcacttcatacaccccgagtactgctggcagcgagccacaggcactcggaccacgcagcgggggaaggcagccagcaggccccccgaagctgcgtccagctccaagctcagcagccgctgccctgtctcgccaccgccgggccgtccacacctggggacaagcagagtggtgaggctgagcgcatctcagcccatctcccctcctgctggcgaccccttcccacctttgcccagacttacctgtccggccggtaggtctcaaactcctccaggaagacactgagcccagacgtccctgaggtgctggcattgggccggacgaggaacttgaggaccgtccccgcctcaga

SEQ ID NO: 5227 - DNA, 216 bp, Homo sapiens; identical to SEQ ID NO: 1632
  misc_feature 1..216: note = chr19:4555896-4556112
  misc_feature 1..216: note = hypo
  source 1..216: mol_type = genomic DNA

SEQ ID NO: 5228 - DNA, 85 bp, Homo sapiens
  misc_feature 1..85: note = chr19:4670740-4670825
  misc_feature 1..85: note = hypo
  source 1..85: mol_type = genomic DNA
cgaacttctcataatcgttgcagccaagatgtgtgtgcatcgatattcaaaattagcagagggaaagtaggatgagaagcaggat

SEQ ID NO: 5229 - DNA, 102 bp, Homo sapiens
  misc_feature 1..102: note = chr19:5914992-5915094
  misc_feature 1..102: note = hypo
  source 1..102: mol_type = genomic DNA
tttgccaagctggaccgcagtggggacggcgtcgtgacggtggacgacctccgcggggtgtacagtggccgtgcccaccccaaggtgcgcagtggggagtgg

SEQ ID NO: 5230 - DNA, 41 bp, Homo sapiens; identical to SEQ ID NO: 1633
  misc_feature 1..41: note = chr19:10231201-10231242
  misc_feature 1..41: note = hypo
  source 1..41: mol_type = genomic DNA

SEQ ID NO: 5231 - DNA, 557 bp, Homo sapiens; identical to SEQ ID NO: 1634
  misc_feature 1..557: note = chr19:18989724-18990281
  misc_feature 1..557: note = hypo
  source 1..557: mol_type = genomic DNA

SEQ ID NO: 5232 - DNA, 120 bp, Homo sapiens; identical to SEQ ID NO: 1635
  misc_feature 1..120: note = chr19:41881475-41881595
  misc_feature 1..120: note = hypo
  source 1..120: mol_type = genomic DNA

SEQ ID NO: 5233 - DNA, 44 bp, Homo sapiens
  misc_feature 1..44: note = chr19:46234843-46234887
  misc_feature 1..44: note = hypo
  source 1..44: mol_type = genomic DNA
attacaggcgtgagccaccgcgcccggcccgtcccctcctttct

SEQ ID NO: 5234 - DNA, 411 bp, Homo sapiens
  misc_feature 1..411: note = chr20:401582-401993
  misc_feature 1..411: note = hypo
  source 1..411: mol_type = genomic DNA
gaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctg

SEQ ID NO: 5235 - DNA, 43 bp, Homo sapiens
  misc_feature 1..43: note = chr20:799104-799147
  misc_feature 1..43: note = hypo
  source 1..43: mol_type = genomic DNA
gagtgaggggtggggcgtagtttcagatttttttttttttttt

SEQ ID NO: 5236 - DNA, 43 bp, Homo sapiens
  misc_feature 1..43: note = chr20:799687-799730
  misc_feature 1..43: note = hypo
  source 1..43: mol_type = genomic DNA
gtgccgggatcacaggcgtgagccaccgcgccgggcccagctt

SEQ ID NO: 5237 - DNA, 147 bp, Homo sapiens
  misc_feature 1..147: note = chr20:2113428-2113575
  misc_feature 1..147: note = hypo
  source 1..147: mol_type = genomic DNA
caatctaggtttaaacggcagctctcctacttactagctgggcggctttgggcaagtgatctaccttctctgggcccccatttccttgtctggtcagtgcagtaagtgttgctcactgtaggctgtgtccggcgcagttcctagctc

SEQ ID NO: 5238 - DNA, 43 bp, Homo sapiens; identical to SEQ ID NO: 1636
  misc_feature 1..43: note = chr20:3027758-3027801
  misc_feature 1..43: note = hypo
  source 1..43: mol_type = genomic DNA

SEQ ID NO: 5239 - DNA, 20 bp, Homo sapiens
  misc_feature 1..20: note = chr20:16554697-16554717
  misc_feature 1..20: note = hypo
  source 1..20: mol_type = genomic DNA
taagggagttaaaggcgaac

SEQ ID NO: 5240 - DNA, 139 bp, Homo sapiens
  misc_feature 1..139: note = chr20:16555017-16555156
  misc_feature 1..139: note = hypo
  source 1..139: mol_type = genomic DNA
ccaggccgacaactggtatcttaaggcttagggcctctggtagaagtgagctccacctcccttcctgtgtagaaggtaaatgcattcattcattcagtgaatcgagcatgcatgaaatcgtttgcgcacacccagaagc

SEQ ID NO: 5241 - DNA, 20 bp, Homo sapiens
  misc_feature 1..20: note = chr20:25230509-25230529
  misc_feature 1..20: note = hypo
  source 1..20: mol_type = genomic DNA
agtcttgccctgtagcgtga

SEQ ID NO: 5242 - DNA, 19 bp, Homo sapiens
  misc_feature 1..19: note = chr20:25230769-25230788
  misc_feature 1..19: note = hypo
  source 1..19: mol_type = genomic DNA
ccaacgcacccgacccgca

SEQ ID NO: 5243 - DNA, 153 bp, Homo sapiens
  misc_feature 1..153: note = chr20:30864866-30865019
  misc_feature 1..153: note = hypo
  source 1..153: mol_type = genomic DNA
ccgcatgatctgttttaaataattactctggccaccttatggaaaatggattgttcggacagagctggacaaaagaatggaaacagaccagatatttcaggcaggctagagatgagcgtggcctggccttgcctggggcggttgtgactgact

SEQ ID NO: 5244 - DNA, 102 bp, Homo sapiens; identical to SEQ ID NO: 1637
  misc_feature 1..102: note = chr20:42218592-42218694
  misc_feature 1..102: note = hypo
  source 1..102: mol_type = genomic DNA

SEQ ID NO: 5245 - DNA, 86 bp, Homo sapiens
  misc_feature 1..86: note = chr20:47905517-47905603
  misc_feature 1..86: note = hypo
  source 1..86: mol_type = genomic DNA
accctaaacaagaagcggtatagaccagaatggagcactgattgtaatccaccttctttcttagaaactggcgatggaatatgaga

SEQ ID NO: 5246 - DNA, 343 bp, Homo sapiens; identical to SEQ ID NO: 1638
  misc_feature 1..343: note = chr20:49261761-49262104
  misc_feature 1..343: note = hypo
  source 1..343: mol_type = genomic DNA

SEQ ID NO: 5247 - DNA, 68 bp, Homo sapiens
  misc_feature 1..68: note = chr20:49286826-49286894
  misc_feature 1..68: note = hypo
  source 1..68: mol_type = genomic DNA
agcaatcttgggcatcggacttggctagaaatccctctcctcctgggaagtctcgtcatcaacaccca

SEQ ID NO: 5248 - DNA, 212 bp, Homo sapiens; identical to SEQ ID NO: 1639
  misc_feature 1..212: note = chr20:49346547-49346759
  misc_feature 1..212: note = hypo
  source 1..212: mol_type = genomic DNA

SEQ ID NO: 5249 - DNA, 26 bp, Homo sapiens
  misc_feature 1..26: note = chr20:49350870-49350896
  misc_feature 1..26: note = hypo
  source 1..26: mol_type = genomic DNA
aactaggtagtgtgccggtccttttt

SEQ ID NO: 5250 - DNA, 139 bp, Homo sapiens
  misc_feature 1..139: note = chr20:49377921-49378060
  misc_feature 1..139: note = hypo
  source 1..139: mol_type = genomic DNA
cgagaatcccccttcctaaattggtaaaatctgattcatcagaattgcaattttgatcaaagccagtaactcctcacacaaatccttctatgtgtgcagaaagtgagcgtctgaaaactccaggcggagtttttgcgct

SEQ ID NO: 5251 - DNA, 157 bp, Homo sapiens
  misc_feature 1..157: note = chr20:60477380-60477537
  misc_feature 1..157: note = hypo
  source 1..157: mol_type = genomic DNA
gcccttcaccagccacggagacccggggtctatgggcagtgccctaaatgccagccatgccctggggcacgcggtcaccaccccgcagaaccgctcccgtgctcgttgcaggagtgcaagggcagatccacagaggagcgtgcggggccccaccttc

SEQ ID NO: 5252 - DNA, 463 bp, Homo sapiens
  misc_feature 1..463: note = chr20:61505867-61506330
  misc_feature 1..463: note = hypo
  source 1..463: mol_type = genomic DNA
gaccctgtggggctggtccctacaggggcatgtgggaagatcccagtgaagctgaggaccacgagccctgcaagtccattgggatctgccggtgaactccgcaggtcgtctttgaaggcacatgtggctcttctgccactgcctggggagctgagacccctttgcccaaagaccctcaagtgccttccctagggagctgccctgtaaggtgccgccgtcctgcccgggactcaccaccacctctgtgttccttctagacctagatccagactggagttccagcaggccccaaaagagaaagtgtgaggtgtggcctacaaatatgtttccctacgaaaacctgcggaaaatgtgtggaaatcgatgttgagagtgcgggatctgggtgggaggaatataagcttgcgtaagtggacagggactcagatacgagattctggatttgatgcgttggagggaacgg

SEQ ID NO: 5253 - DNA, 66 bp, Homo sapiens
  misc_feature 1..66: note = chr20:62031666-62031732
  misc_feature 1..66: note = hypo
  source 1..66: mol_type = genomic DNA
gcaggaccccacacccgaagtcccccgcaaacccgcactggcgcattcttacggctctggcatcaa

SEQ ID NO: 5254 - DNA, 309 bp, Homo sapiens; identical to SEQ ID NO: 1641
  misc_feature 1..309: note = chr20:62046201-62046510
  misc_feature 1..309: note = hypo
  source 1..309: mol_type = genomic DNA

SEQ ID NO: 5255 - DNA, 86 bp, Homo sapiens; identical to SEQ ID NO: 1642
  misc_feature 1..86: note = chr20:62115180-62115266
  misc_feature 1..86: note = hypo
  source 1..86: mol_type = genomic DNA

SEQ ID NO: 5256 - DNA, 348 bp, Homo sapiens
  misc_feature 1..348: note = chr20:62126081-62126429
  misc_feature 1..348: note = hypo
  source 1..348: mol_type = genomic DNA
cacctgccggtgcctcgctctgggccagggggtccagccagctcccgtggcccgccccgccctagccgccactcacgttgggggagggctccagcatgttgtcaccgtgccagccggagatgggcacaaagggcacggtggccgggttgtagccgatcttcttgatgtaggcgctgacttccttgacgatctcgtcgtagcgcttctcgctgtaggccggctctgtggagtccattttgttcacgcccacgatgagctgcttcacacccagcgtgtaggccagcagggcatgctcccgcgtctgcccattcttggagatgcccgcctcgaactcgcccacgcccgccg

SEQ ID NO: 5257 - DNA, 247 bp, Homo sapiens
  misc_feature 1..247: note = chr20:62383189-62383436
  misc_feature 1..247: note = hypo
  source 1..247: mol_type = genomic DNA
tctcccatgaagccccgccccccggtgggtctcccggtggagctcggctcctgcaggtccgctccggaacctgctgactctcctgcgattcctaaactggcagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccc

SEQ ID NO: 5258 - DNA, 300 bp, Homo sapiens
  misc_feature 1..300: note = chr21:44866603-44866903
  misc_feature 1..300: note = hypo
  source 1..300: mol_type = genomic DNA
cttccctgccacagccggcccagcgggagccaggtcagggcctggagacacagcgccccccaccggagccactgcccggcccagcagcacctgcggagaatcccaccagctcccacgcctcccgccgcgccaccgccccggctttctgcaaatccaccttatggaagccggataaggtgaagtccacatataactaaaagcgagttactgagggttactttctttgcagagtggttcccctaaaggattcctttaaacatgatccggtcagccagtgctcacttacgttcaccaagtcac

SEQ ID NO: 5259 - DNA, 222 bp, Homo sapiens
  misc_feature 1..222: note = chr21:46036605-46036827
  misc_feature 1..222: note = hypo
  source 1..222: mol_type = genomic DNA
gtgagaatgagacaccgtgacaatgcggctgcgcaccggacacctggctcagcgcaggcagcgcacggacagagtctgcggtgtgaccacaccaagcagccctaaggcagcacgtgcccgcacaagcctcagcctctgctccggtcacgcctgcccacttgggtgtattttttgtctgacttttgcttctggggccgaacaacccagcgaattcaacacagc

SEQ ID NO: 5260 - DNA, 349 bp, Homo sapiens
  misc_feature 1..349: note = chr21:46319156-46319505
  misc_feature 1..349: note = hypo
  source 1..349: mol_type = genomic DNA
agcgtcagccctgcccgtgcttcgaaccctctctggggaaggctggagaggcagaggctgccacgcaggagtgcagggcagagagctgccacgccctctgggcaatgtgtgcatagactcgggctttcagagtccaggcatgagcagcatttgaggcgtctcaccgtgggactggggatgtccacgggggcagaatcccagccttccccacacggtggacctgctttcgcactgagggacactcagtttcggtagaggccatgagtgtcaggtgcggctctccctacccgagttccgggacccgagggccgtccctcccgtctgtggctcccggcggaggacctgagtc

SEQ ID NO: 5261 - DNA, 215 bp, Homo sapiens
  misc_feature 1..215: note = chr21:47746178-47746393
  misc_feature 1..215: note = hypo
  source 1..215: mol_type = genomic DNA
gactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggagg

SEQ ID NO: 5262 - DNA, 16 bp, Homo sapiens
  misc_feature 1..16: note = chr22:18110631-18110647
  misc_feature 1..16: note = hypo
  source 1..16: mol_type = genomic DNA
acgaccttgtcaaaac

SEQ ID NO: 5263 - DNA, 15 bp, Homo sapiens
  misc_feature 1..15: note = chr22:20864657-20864672
  misc_feature 1..15: note = hypo
  source 1..15: mol_type = genomic DNA
cgagactccatctca

SEQ ID NO: 5264 - DNA, 23 bp, Homo sapiens
  misc_feature 1..23: note = chr22:30158368-30158391
  misc_feature 1..23: note = hypo
  source 1..23: mol_type = genomic DNA
tgtcaggagctgggccgcacagc

SEQ ID NO: 5265 - DNA, 30 bp, Homo sapiens
  misc_feature 1..30: note = chr22:35079354-35079384
  misc_feature 1..30: note = hypo
  source 1..30: mol_type = genomic DNA
ggagctgttcctattcggccatcttggctc

SEQ ID NO: 5266 - DNA, 30 bp, Homo sapiens
  misc_feature 1..30: note = chr22:35768487-35768517
  misc_feature 1..30: note = hypo
  source 1..30: mol_type = genomic DNA
caaaaacttcaaggccgggcgcggtggctc

SEQ ID NO: 5267 - DNA, 17 bp, Homo sapiens
  misc_feature 1..17: note = chr22:41839926-41839943
  misc_feature 1..17: note = hypo
  source 1..17: mol_type = genomic DNA
gccggaaggtttttcag

SEQ ID NO: 5268 - DNA, 74 bp, Homo sapiens
  misc_feature 1..74: note = chr22:47005080-47005154
  misc_feature 1..74: note = hypo
  source 1..74: mol_type = genomic DNA
acatacatcgcagaccgctgagtggcgctggttgctgtctgggccggcttggcctcaggcgatcctgttgccct

SEQ ID NO: 5269 - DNA, 138 bp, Homo sapiens
  misc_feature 1..138: note = chr22:50149332-50149470
  misc_feature 1..138: note = hypo
  source 1..138: mol_type = genomic DNA
ccctttccatggcaacgacccataaggtgccacccctttccatggcaacgccccatacggtgccacccctttccatggcaacgccccatacggtgccacccctttacatggcaacgccccatacggtgccatcccttt

SEQ ID NO: 5270 - DNA, 410 bp, Homo sapiens; identical to SEQ ID NO: 1644
  misc_feature 1..410: note = chr22:50899279-50899689
  misc_feature 1..410: note = hypo
  source 1..410: mol_type = genomic DNA

SEQ ID NO: 5271 - DNA, 30 bp, Homo sapiens
  misc_feature 1..30: note = chr1:975836-975866
  misc_feature 1..30: note = hyper
  source 1..30: mol_type = genomic DNA
gctggcgggaatcctcggcgggcggggtct

SEQ ID NO: 5272 - DNA, 107 bp, Homo sapiens; identical to SEQ ID NO: 1645
  misc_feature 1..107: note = chr1:1475537-1475644
  misc_feature 1..107: note = hyper
  source 1..107: mol_type = genomic DNA

SEQ ID NO: 5273 - DNA, 39 bp, Homo sapiens
  misc_feature 1..39: note = chr1:1535851-1535890
  misc_feature 1..39: note = hyper
  source 1..39: mol_type = genomic DNA
ggacttcgtgctttacgatgggggcgcagcggtctggca

SEQ ID NO: 5274 - DNA, 30 bp, Homo sapiens
  misc_feature 1..30: note = chr1:1567286-1567316
  misc_feature 1..30: note = hyper
  source 1..30: mol_type = genomic DNA
cttcgctcccccctccgaggaccccgccca

SEQ ID NO: 5275 - DNA, 33 bp, Homo sapiens
  misc_feature 1..33: note = chr1:1567781-1567814
  misc_feature 1..33: note = hyper
  source 1..33: mol_type = genomic DNA
gggttgggggggtcctcacgtctgtgggtctgg

SEQ ID NO: 5276 - DNA, 37 bp, Homo sapiens
  misc_feature 1..37: note = chr1:1935385-1935422
  misc_feature 1..37: note = hyper
  source 1..37: mol_type = genomic DNA
ggaggtcgcgggccccgaggcgcggctgaagggccag

SEQ ID NO: 5277 - DNA, 611 bp, Homo sapiens; identical to SEQ ID NO: 1646
  misc_feature 1..611: note = chr1:2374994-2375605
  misc_feature 1..611: note = hyper
  source 1..611: mol_type = genomic DNA

SEQ ID NO: 5278 - DNA, 64 bp, Homo sapiens
  misc_feature 1..64: note = chr1:2560861-2560925
  misc_feature 1..64: note = hyper
  source 1..64: mol_type = genomic DNA
cgcttctgccctgcacggccggcgctctccaccatccccactgggccttcggacttccccatca

SEQ ID NO: 5279 - DNA, 30 bp, Homo sapiens
  misc_feature 1..30: note = chr1:2984719-2984749
  misc_feature 1..30: note = hyper
  source 1..30: mol_type = genomic DNA
gtgtccccagtggcccgggtccccgaaggt

SEQ ID NO: 5280 - DNA, 30 bp, Homo sapiens
  misc_feature 1..30: note = chr1:2985189-2985219
  misc_feature 1..30: note = hyper
  source 1..30: mol_type = genomic DNA
aatgcaggagaaaagcgggccggggcgacg

SEQ ID NO: 5281 - DNA, 42 bp, Homo sapiens
  misc_feature 1..42: note = chr1:2987163-2987205
  misc_feature 1..42: note = hyper
  source 1..42: mol_type = genomic DNA
acgccgttccgtccgcgcctccggggccgggtccctccaggc

SEQ ID NO: 5282 - DNA, 69 bp, Homo sapiens
  misc_feature 1..69: note = chr1:3087621-3087690
  misc_feature 1..69: note = hyper
  source 1..69: mol_type = genomic DNA
ccccgcacccctcagcgccccacggagacctgcaccttccagactgacagtgctcggggccctctctcc

SEQ ID NO: 5283 - DNA, 85 bp, Homo sapiens
  misc_feature 1..85: note = chr1:3310353-3310438
  misc_feature 1..85: note = hyper
  source 1..85: mol_type = genomic DNA
tgcgcggattcccgttcacctctgacccccgaagcagttggaggcaggtcggggacccccgcccccgccccgccccgcctcgggc

SEQ ID NO: 5284 - DNA, 98 bp, Homo sapiens; identical to SEQ ID NO: 1
  misc_feature 1..98: note = chr1:3567247-3567345
  misc_feature 1..98: note = hyper
  source 1..98: mol_type = genomic DNA

SEQ ID NO: 5285 - DNA, 114 bp, Homo sapiens; identical to SEQ ID NO: 2
  misc_feature 1..114: note = chr1:3567737-3567851
  misc_feature 1..114: note = hyper
  source 1..114: mol_type = genomic DNA

SEQ ID NO: 5286 - DNA, 395 bp, Homo sapiens; identical to SEQ ID NO: 3
  misc_feature 1..395: note = chr1:3567882-3568277
  misc_feature 1..395: note = hyper
  source 1..395: mol_type = genomic DNA

SEQ ID NO: 5287 - DNA, 35 bp, Homo sapiens
  misc_feature 1..35: note = chr1:3663252-3663287
  misc_feature 1..35: note = hyper
  source 1..35: mol_type = genomic DNA
caggtcggtgaactccgccgcgtagtcgtgtaaag

SEQ ID NO: 5288 - DNA, 271 bp, Homo sapiens
  misc_feature 1..271: note = chr1:3663650-3663921
  misc_feature 1..271: note = hyper
  source 1..271: mol_type = genomic DNA
gggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgt

SEQ ID NO: 5289 - DNA, 152 bp, Homo sapiens
  misc_feature 1..152: note = chr1:4712671-4712823
  misc_feature 1..152: note = hyper
  source 1..152: mol_type = genomic DNA
aggggttcctggagccgacacggtccggtccggagcccctccctgccctgctggctcctagtgtgcgaagccggccccttccaggcccactccggttgcaggaagggcctccctggtgcagcaccgcctcctcacaccgctaggtggcagca

SEQ ID NO: 5290 - DNA, 31 bp, Homo sapiens
  misc_feature 1..31: note = chr1:4714044-4714075
  misc_feature 1..31: note = hyper
  source 1..31: mol_type = genomic DNA
ggttcggggcagaagcgccgaagctccgacc

SEQ ID NO: 5291 - DNA, 113 bp, Homo sapiens; identical to SEQ ID NO: 4
  misc_feature 1..113: note = chr1:4715427-4715540
  misc_feature 1..113: note = hyper
  source 1..113: mol_type = genomic DNA

SEQ ID NO: 5292 - DNA, 528 bp, Homo sapiens; identical to SEQ ID NO: 5
  misc_feature 1..528: note = chr1:4715574-4716102
  misc_feature 1..528: note = hyper
  source 1..528: mol_type = genomic DNA

SEQ ID NO: 5293 - DNA, 62 bp, Homo sapiens
  misc_feature 1..62: note = chr1:4716475-4716537
  misc_feature 1..62: note = hyper
  source 1..62: mol_type = genomic DNA
ggacagaggtggaggcggagagcagcgtgcggttctcgagtttgtccactgggatgcactgc

SEQ ID NO: 5294 - DNA, 126 bp, Homo sapiens
  misc_feature 1..126: note = chr1:4716538-4716664
  misc_feature 1..126: note = hyper
  source 1..126: mol_type = genomic DNA
ctcccgcgttggggacgaaaaggccagtagttgttagcccgctgcttgagccgcccccactcagggatgaagctgcggggggagtgaggcgaagggagggaggatctagtgcgtgtcctgattttg

SEQ ID NO: 5295 - DNA, 79 bp, Homo sapiens
  misc_feature 1..79: note = chr1:6208701-6208780
  misc_feature 1..79: note = hyper
  source 1..79: mol_type = genomic DNA
tctaggggagtcagacgcggagaagggcgcgaggaagctattgtggacggggtctcgagcagcgcgggcgaagctttgc

SEQ ID NO: 5296 - DNA, 145 bp, Homo sapiens
  misc_feature 1..145: note = chr1:6241066-6241211
  misc_feature 1..145: note = hyper
  source 1..145: mol_type = genomic DNA
agaagcgacacctgtcgcagagcaggaaggagccgccgccaccagccctcggtcgttaaaggtgaagatggaggccaaagccctcgggagcaagactggaattttaaatgagcgcctccagtctccgcggcggcaagtcttaaag

SEQ ID NO: 5297 - DNA, 188 bp, Homo sapiens
  misc_feature 1..188: note = chr1:6301754-6301942
  misc_feature 1..188: note = hyper
  source 1..188: mol_type = genomic DNA
agccacgggtgggggcgtcagaaagtagggggatcattccaggtggggagaccactgaccgaaaacgggccacaggacagggggcgcggcgggcagtgtcggggttggggtcggggggcaacggaggcggaagtccattcagtggaccagggcggagcgacgcctgagaattccgcccaggccttgag

SEQ ID NO: 5298 - DNA, 192 bp, Homo sapiens
  misc_feature 1..192: note = chr1:6304118-6304310
  misc_feature 1..192: note = hyper
  source 1..192: mol_type = genomic DNA
gggagcttcccagtgcgtcctccctcggtcccctcctcctcaaggtttctagagtccagagggcctcattgacatgtaaacgagggtccctataaaggcggcgctgcctcgcactggtgcatggactgcaacatgggcacggagcctgctgcccggggcagcctccccggcaacttccgaaaggtctggggt

SEQ ID NO: 5299 - DNA, 763 bp, Homo sapiens
  misc_feature 1..763: note = chr1:6309258-6310021
  misc_feature 1..763: note = hyper
  source 1..763: mol_type = genomic DNA
aaacgctgaggccaacgccccctcacccctgggaggggtggcgcatgtctgcgcgcggggcggaggcgggcgtctttggtgctgcggccccggagagcggcctggcctgcctggcgtccgtggggaggcgccggcggtcctaggacgcggagcccagcgagtccgagtgcagcgtggcgtagcccgaggactcggagggggaactcaggaagctgctggtgctgccgccgccgcccgccgcgcgcagccccccgggctcgccccacgacgcgctcaggccggggcgcagagagccggcgtgcgagtgcgcagaggggcgtggccctgggctccgctgggcgctgcttgggggcgtcggggcctctccgggatctgcgccgtcgggggcggcgggcgcagcggggaagggcccgggcgggcggcgcagggcctgtggctcgcactcgaaggcggtcagggcgaaggcgtcgggcagcagcgaggccgaggcggagcgggggccgggcccggggcggcggcgcgggctgccggggggcgagtcgcgggctccccgcgggccgctatccagggccgagggccgcagcgacagcaggctctcggccgagcggcggcgcgcgcgggacggtggtgcgtcctccgcgaaggccaggaggctggcgcggcgccgctcgggcccggcaggcagcaccaggtgcgccagggcggccaggtcctcgccggagccccagcgcggcaggaaggcgggcagcgggacggcggccca

SEQ ID NO: 5300 - DNA, 517 bp, Homo sapiens; identical to SEQ ID NO: 6
  misc_feature 1..517: note = chr1:6480368-6480885
  misc_feature 1..517: note = hyper
  source 1..517: mol_type = genomic DNA

SEQ ID NO: 5301 - DNA, 15 bp, Homo sapiens
  misc_feature 1..15: note = chr1:6500973-6500988
  misc_feature 1..15: note = hyper
  source 1..15: mol_type = genomic DNA
ctcactgcgtgcccc

SEQ ID NO: 5302 - DNA, 125 bp, Homo sapiens; identical to SEQ ID NO: 8
  misc_feature 1..125: note = chr1:6501054-6501179
  misc_feature 1..125: note = hyper
  source 1..125: mol_type = genomic DNA

SEQ ID NO: 5303 - DNA, 34 bp, Homo sapiens
  misc_feature 1..34: note = chr1:6507490-6507524
  misc_feature 1..34: note = hyper
  source 1..34: mol_type = genomic DNA
ggtgtcgcatttcctgcaacgtgagccaggtcgg

SEQ ID NO: 5304 - DNA, 48 bp, Homo sapiens
  misc_feature 1..48: note = chr1:6508019-6508067
  misc_feature 1..48: note = hyper
  source 1..48: mol_type = genomic DNA
gggattggcgggccccgggtgatgtcaggccgtcggagcccataggct

SEQ ID NO: 5305 - DNA, 53 bp, Homo sapiens
  misc_feature 1..53: note = chr1:6508969-6509022
  misc_feature 1..53: note = hyper
  source 1..53: mol_type = genomic DNA
gaaccatgttcctaacggctgcgccgcggaccccaaggcgtccagggagctgc

SEQ ID NO: 5306 - DNA, 77 bp, Homo sapiens
  misc_feature 1..77: note = chr1:8002422-8002499
  misc_feature 1..77: note = hyper
  source 1..77: mol_type = genomic DNA
gccgtcctcctgccccgcggttcccagcacgagctctcccgacagaagaggaaaacgcggcgcgactcggttggggg

SEQ ID NO: 5307 - DNA, 30 bp, Homo sapiens; identical to SEQ ID NO: 9
  misc_feature 1..30: note = chr1:8277113-8277143
  misc_feature 1..30: note = hyper
  source 1..30: mol_type = genomic DNA

SEQ ID NO: 5308 - DNA, 48 bp, Homo sapiens
  misc_feature 1..48: note = chr1:9243236-9243284
  misc_feature 1..48: note = hyper
  source 1..48: mol_type = genomic DNA
tcagccgaggggccgcggctcagcccccctcaccggccttaaaggttc

SEQ ID NO: 5309 - DNA, 348 bp, Homo sapiens
  misc_feature 1..348: note = chr1:9712291-9712639
  misc_feature 1..348: note = hyper
  source 1..348: mol_type = genomic DNA
ggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaa

SEQ ID NO: 5310 - DNA, 140 bp, Homo sapiens
  misc_feature 1..140: note = chr1:9712874-9713014
  misc_feature 1..140: note = hyper
  source 1..140: mol_type = genomic DNA
tgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcact

SEQ ID NO: 5311 - DNA, 78 bp, Homo sapiens
  misc_feature 1..78: note = chr1:10057431-10057509
  misc_feature 1..78: note = hyper
  source 1..78: mol_type = genomic DNA
ggtctcgggatcaggcgaaggcggccgggccgggcctgtaggtacgtcctctgtccgtgcctccgccctgctgcgccc

SEQ ID NO: 5312 - DNA, 68 bp, Homo sapiens
  misc_feature 1..68: note = chr1:10948552-10948620
  misc_feature 1..68: note = hyper
  source 1..68: mol_type = genomic DNA
gcgggaggctccagacgcccagagcccacagcttcccgcccggggcggctgagcggtcccggggagag

SEQ ID NO: 5313 - DNA, 50 bp, Homo sapiens; identical to SEQ ID NO: 10
  misc_feature 1..50: note = chr1:11540129-11540179
  misc_feature 1..50: note = hyper
  source 1..50: mol_type = genomic DNA

SEQ ID NO: 5314 - DNA, 61 bp, Homo sapiens
  misc_feature 1..61: note = chr1:11752522-11752583
  misc_feature 1..61: note = hyper
  source 1..61: mol_type = genomic DNA
tcagcctggctcccccgacggcgctggtctttcgcctgtggtctcccgctctgtccctcct

SEQ ID NO: 5315 - DNA, 40 bp, Homo sapiens
  misc_feature 1..40: note = chr1:11919143-11919183
  misc_feature 1..40: note = hyper
  source 1..40: mol_type = genomic DNA
gtgggaggtggagaccgggcagagccgaccttgtatagaa

SEQ ID NO: 5316 - DNA, 158 bp, Homo sapiens
  misc_feature 1..158: note = chr1:11959080-11959238
  misc_feature 1..158: note = hyper
  source 1..158: mol_type = genomic DNA
acctggatccgaggtcggcccctgtccccggtgctgaaatgcgggcgcccgcggggttcacggccaggactcagccctggagtccctgagaccgctagccccgtagcaatcccctatgtaggatttgtttcaagggctcagaccggcacagagccccc

SEQ ID NO: 5317 - DNA, 133 bp, Homo sapiens; identical to SEQ ID NO: 11
  misc_feature 1..133: note = chr1:12123421-12123554
  misc_feature 1..133: note = hyper
  source 1..133: mol_type = genomic DNA

SEQ ID NO: 5318 - DNA, 15 bp, Homo sapiens
  misc_feature 1..15: note = chr1:12123787-12123802
  misc_feature 1..15: note = hyper
  source 1..15: mol_type = genomic DNA
cgcaagggaggacac

SEQ ID NO: 5319 - DNA, 134 bp, Homo sapiens
  misc_feature 1..134: note = chr1:13840532-13840666
  misc_feature 1..134: note = hyper
  source 1..134: mol_type = genomic DNA
aaggcgtgtcccgggcgtgcgccctgccccctcgcgcccgcctggtgccaaagcacgctccctgcacgccaccctatgtcgccaaagggagtgggacctgggtcactctgactctgctccgggggcaatccctg

SEQ ID NO: 5320 - DNA, 368 bp, Homo sapiens; identical to SEQ ID NO: 1659
  misc_feature 1..368: note = chr1:13910330-13910698
  misc_feature 1..368: note = hyper
  source 1..368: mol_type = genomic DNA

SEQ ID NO: 5321 - DNA, 13 bp, Homo sapiens
  misc_feature 1..13: note = chr1:13910699-13910712
  misc_feature 1..13: note = hyper
  source 1..13: mol_type = genomic DNA
cgggggagctgag

SEQ ID NO: 5322 - DNA, 30 bp, Homo sapiens
  misc_feature 1..30: note = chr1:14219604-14219634
  misc_feature 1..30: note = hyper
  source 1..30: mol_type = genomic DNA
ggagcccagggtcggcgctgcaggcagcgg

SEQ ID NO: 5323 - DNA, 30 bp, Homo sapiens
  misc_feature 1..30: note = chr1:14924607-14924637
  misc_feature 1..30: note = hyper
  source 1..30: mol_type = genomic DNA
aggcgggagcaccagcggcccacgccgagg

SEQ ID NO: 5324 - DNA, 142 bp, Homo sapiens
  misc_feature 1..142: note = chr1:14925056-14925198
  misc_feature 1..142: note = hyper
  source 1..142: mol_type = genomic DNA
tgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctc

SEQ ID NO: 5325 - DNA, 361 bp, Homo sapiens
  misc_feature 1..361: note = chr1:14925199-14925560
  misc_feature 1..361: note = hyper
  source 1..361: mol_type = genomic DNA
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggagg

SEQ ID NO: 5326 - DNA, 127 bp, Homo sapiens; identical to SEQ ID NO: 1661
  misc_feature 1..127: note = chr1:14925923-14926050
  misc_feature 1..127: note = hyper
  source 1..127: mol_type = genomic DNA

SEQ ID NO: 5327 - DNA, 80 bp, Homo sapiens
  misc_feature 1..80: note = chr1:16553585-16553665
  misc_feature 1..80: note = hyper
  source 1..80: mol_type = genomic DNA
gcaggctcagttcctcggcgtagcacagcggctcccaggcgcgctcagctcggcgaagggtgcggcgctatgccggggta

SEQ ID NO: 5328 - DNA, 30 bp, Homo sapiens
  misc_feature 1..30: note = chr1:16861712-16861742
  misc_feature 1..30: note = hyper
  source 1..30: mol_type = genomic DNA
caggccggctgacagcgtagtgaaggaaga

SEQ ID NO: 5329 - DNA, 55 bp, Homo sapiens
  misc_feature 1..55: note = chr1:18436492-18436547
  misc_feature 1..55: note = hyper
  source 1..55: mol_type = genomic DNA
gctctccctggaacccgggagcagggttcttctggctgcccggctgcagagagct

SEQ ID NO: 5330 - DNA, 156 bp, Homo sapiens
  misc_feature 1..156: note = chr1:18436827-18436983
  misc_feature 1..156: note = hyper
  source 1..156: mol_type = genomic DNA
gcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaa

SEQ ID NO: 5331 - DNA, 229 bp, Homo sapiens; identical to SEQ ID NO: 13
  misc_feature 1..229: note = chr1:18437202-18437431
  misc_feature 1..229: note = hyper
  source 1..229: mol_type = genomic DNA

SEQ ID NO: 5332 - DNA, 94 bp, Homo sapiens; identical to SEQ ID NO: 14
  misc_feature 1..94: note = chr1:18437432-18437526
  misc_feature 1..94: note = hyper
  source 1..94: mol_type = genomic DNA

SEQ ID NO: 5333 - DNA, 79 bp, Homo sapiens
  misc_feature 1..79: note = chr1:18437738-18437817
  misc_feature 1..79: note = hyper
  source 1..79: mol_type = genomic DNA
cccatgcccctccagcgtggccccgcccctagccataaactccacccctcttccaccccataaccgctctgcaaatggg

SEQ ID NO: 5334 - DNA, 30 bp, Homo sapiens
  misc_feature 1..30: note = chr1:18956574-18956604
  misc_feature 1..30: note = hyper
  source 1..30: mol_type = genomic DNA
aaggagttataggcccggcctgggggcctg

SEQ ID NO: 5335 - DNA, 476 bp, Homo sapiens; identical to SEQ ID NO: 15
  misc_feature 1..476: note = chr1:18956811-18957287
  misc_feature 1..476: note = hyper
  source 1..476: mol_type = genomic DNA

SEQ ID NO: 5336 - DNA, 80 bp, Homo sapiens
  misc_feature 1..80: note = chr1:18957507-18957587
  misc_feature 1..80: note = hyper
  source 1..80: mol_type = genomic DNA
gtgtggagggagaagcgagtgtggtccggagaaagaaggcgtggagaagagggagggagcgagagcgagagaataaatat

SEQ ID NO: 5337 - DNA, 219 bp, Homo sapiens
  misc_feature 1..219: note = chr1:18957985-18958204
  misc_feature 1..219: note = hyper
  source 1..219: mol_type = genomic DNA
ttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcct

SEQ ID NO: 5338 - DNA, 58 bp, Homo sapiens
  misc_feature 1..58: note = chr1:18958829-18958887
  misc_feature 1..58: note = hyper
  source 1..58: mol_type = genomic DNA
tagagaacctctaaacggcgagaggggcacggcaatgtccaaacgagaagaaagagct

SEQ ID NO: 5339 - DNA, 35 bp, Homo sapiens
  misc_feature 1..35: note = chr1:18959220-18959255
  misc_feature 1..35: note = hyper
  source 1..35: mol_type = genomic DNA
tgggctggcagcctgcgatccgggaggagctccct

SEQ ID NO: 5340 - DNA, 123 bp, Homo sapiens
  misc_feature 1..123: note = chr1:18959573-18959696
  misc_feature 1..123: note = hyper
  source 1..123: mol_type = genomic DNA
cgactttgcgacgcacgatttctgattaaatccgagagtggcttcagacaccgacttttacaaagagaggtggggggaccgggagagcgagggagggggcggtaggaacggcccagcagcgga

SEQ ID NO: 5341 - DNA, 93 bp, Homo sapiens; identical to SEQ ID NO: 16
  misc_feature 1..93: note = chr1:18960897-18960990
  misc_feature 1..93: note = hyper
  source 1..93: mol_type = genomic DNA

SEQ ID NO: 5342 - DNA, 334 bp, Homo sapiens
  misc_feature 1..334: note = chr1:18962827-18963161
  misc_feature 1..334: note = hyper
  source 1..334: mol_type = genomic DNA
ggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctacccc

SEQ ID NO: 5343 - DNA, 30 bp, Homo sapiens
  misc_feature 1..30: note = chr1:18963693-18963723
  misc_feature 1..30: note = hyper
  source 1..30: mol_type = genomic DNA
gcttttgtttcttgacgggaggaagtttcg

SEQ ID NO: 5344 - DNA, 96 bp, Homo sapiens
  misc_feature 1..96: note = chr1:18964297-18964393
  misc_feature 1..96: note = hyper
  source 1..96: mol_type = genomic DNA
tgccgcagtcccgcccgggacaaaagggcgagggaagaaagggagccagctgtgccgggcgccccgctgtgcccggcctgccgaggggccacgggt

SEQ ID NO: 5345 - DNA, 94 bp, Homo sapiens
  misc_feature 1..94: note = chr1:18968003-18968097
  misc_feature 1..94: note = hyper
  source 1..94: mol_type = genomic DNA
tggggtcccccgctgcgagggcgtgcgggttttgtgttcccctcggggcacgcaccgccacacttgggctgtttcaaggcgtttgtacctaaaa

SEQ ID NO: 5346 - DNA, 625 bp, Homo sapiens
  misc_feature 1..625: note = chr1:18969533-18970158
  misc_feature 1..625: note = hyper
  source 1..625: mol_type = genomic DNA
ctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagat

SEQ ID NO: 5347 - DNA, 30 bp, Homo sapiens
  misc_feature 1..30: note = chr1:18970361-18970391
  misc_feature 1..30: note = hyper
  source 1..30: mol_type = genomic DNA
ttctgcgctccaacccggggcgctgggcag

SEQ ID NO: 5348 - DNA, 64 bp, Homo sapiens
  misc_feature 1..64: note = chr1:18971750-18971814
  misc_feature 1..64: note = hyper
  source 1..64: mol_type = genomic DNA
gcttcgccacgggttcgagggagaggcggagggaggagcggctgggctgcggagcctcttgcct

SEQ ID NO: 5349 - DNA, 29 bp, Homo sapiens
  misc_feature 1..29: note = chr1:19043114-19043143
  misc_feature 1..29: note = hyper
  source 1..29: mol_type = genomic DNA
cgtctccctgatcgcgtcataaccctgag

SEQ ID NO: 5350 - DNA, 287 bp, Homo sapiens
  misc_feature 1..287: note = chr1:19043456-19043743
  misc_feature 1..287: note = hyper
  source 1..287: mol_type = genomic DNA
gggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactg

SEQ ID NO: 5351 - DNA, 151 bp, Homo sapiens
  misc_feature 1..151: note = chr1:19043756-19043907
  misc_feature 1..151: note = hyper
  source 1..151: mol_type = genomic DNA
cgctcgtccagtcttggtcgcggggcctcggccgtctcgggacggggcaggcggcgaagggacgggcagccggtaagcaagacccttgctgcctgctggagagagaggctccctcgggagcgccccgttccccacccgttcattagttcat

SEQ ID NO: 5352 - DNA, 276 bp, Homo sapiens
  misc_feature 1..276: note = chr1:20618169-20618445
  misc_feature 1..276: note = hyper
  source 1..276: mol_type = genomic DNA
atgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagcagcgggtgcagtgtggcgcctgctaacgcatcaagcctccgctggaagttccaccataacgtctgcggcagccccaacagttccaccccatgctcccgccgccggcaccacagcagc

SEQ ID NO: 5353 - DNA, 72 bp, Homo sapiens
  misc_feature 1..72: note = chr1:20669776-20669848
  misc_feature 1..72: note = hyper
  source 1..72: mol_type = genomic DNA
cggcgcgcaggatgccgacctatggagcgagaccttccaccacctggcggcccgcgccatcatccgcgactt

SEQ ID NO: 5354 - DNA, 40 bp, Homo sapiens
  misc_feature 1..40: note = chr1:20692819-20692859
  misc_feature 1..40: note = hyper
  source 1..40: mol_type = genomic DNA
gtcggtccccactcccgacgggcctcgcattcctggtcct

SEQ ID NO: 5355 - DNA, 55 bp, Homo sapiens
  misc_feature 1..55: note = chr1:20810635-20810690
  misc_feature 1..55: note = hyper
  source 1..55: mol_type = genomic DNA
aggtgcggagatgagcggaaccaggaggggacgccaaaaccggttcccacgacgc

SEQ ID NO: 5356 - DNA, 92 bp, Homo sapiens
  misc_feature 1..92: note = chr1:20878524-20878616
  misc_feature 1..92: note = hyper
  source 1..92: mol_type = genomic DNA
cagcggtctggcccacgaccttggaagaacctgggagaaagcttcaccaagcgacagtacttttccactgcactgctcggccacctcggctg

SEQ ID NO: 5357 - DNA, 124 bp, Homo sapiens
  misc_feature 1..124: note = chr1:20878905-20879029
  misc_feature 1..124: note = hyper
  source 1..124: mol_type = genomic DNA
gcctgtgcagggtcccgggcagcgcgagcctgcgtggggggaggggagaagagggcaaggggaggggacaagagagctagcggtcccgcccggtgatgtaggcagcccggggaggtggagccgc

SEQ ID NO: 5358 - DNA, 199 bp, Homo sapiens
  misc_feature 1..199: note = chr1:20879030-20879229
  misc_feature 1..199: note = hyper
  source 1..199: mol_type = genomic DNA
acgcctgaaggagtccccaccgcagccgcgctctcggtctgccccactaagcagccgccagcggctccggcgacccaaattgcggcggcagggaccgcggaaatcccaccgtttgggcttggtggacgtccagcccacctcacccccagccccggcccctcctcgcttcccagacggctggagacactcccgggaaaag

SEQ ID NO: 5359 - DNA, 182 bp, Homo sapiens
  misc_feature 1..182: note = chr1:20879255-20879437
  misc_feature 1..182: note = hyper
  source 1..182: mol_type = genomic DNA
cgcacctcggctgctggcccggctgggcaccgggcatctgcgaagctagccctgcctggcactgggcatctccaggcaacgactgtccccggccctgcccagcttctcgcgactccagggcggtggacttctgcgcgccttccctcccccggtctcccgacaggacgccggtgagctccctg

SEQ ID NO: 5360 - DNA, 169 bp, Homo sapiens
  misc_feature 1..169: note = chr1:20879462-20879631
  misc_feature 1..169: note = hyper
  source 1..169: mol_type = genomic DNA
cgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtg

SEQ ID NO: 5361 - DNA, 760 bp, Homo sapiens
  misc_feature 1..760: note = chr1:20879845-20880605
  misc_feature 1..760: note = hyper
  source 1..760: mol_type = genomic DNA
gcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggct

SEQ ID NO: 5362 - DNA, 79 bp, Homo sapiens
  misc_feature 1..79: note = chr1:21044125-21044204
  misc_feature 1..79: note = hyper
  source 1..79: mol_type = genomic DNA
tggcagcgcagctctcgctcccgctggttcatgggacggcagcgcacgacaaccttcaccgcctcggaggccatggcgc

SEQ ID NO: 5363 - DNA, 102 bp, Homo sapiens
  misc_feature 1..102: note = chr1:21754482-21754584
  misc_feature 1..102: note = hyper
  source 1..102: mol_type = genomic DNA
ggggggcgttctcggcgcggagtggagtggagcggagcgggctggtgctgggggcgcggagagcgcagtgctggccggggccgggagcggggccgagcggga

SEQ ID NO: 5364 - DNA, 42 bp, Homo sapiens
  misc_feature 1..42: note = chr1:21835408-21835450
  misc_feature 1..42: note = hyper
  source 1..42: mol_type = genomic DNA
agagagacagggacacgtgggcagagacggataaagacagag

SEQ ID NO: 5365 - DNA, 50 bp, Homo sapiens
  misc_feature 1..50: note = chr1:21836105-21836155
  misc_feature 1..50: note = hyper
  source 1..50: mol_type = genomic DNA
ctttaatggcagggccggggtctccagcgccacgccgcccacagcagccc

SEQ ID NO: 5366 - DNA, 331 bp, Homo sapiens; identical to SEQ ID NO: 17
  misc_feature 1..331: note = chr1:22140683-22141014
  misc_feature 1..331: note = hyper
  source 1..331: mol_type = genomic DNA

SEQ ID NO: 5367 - DNA, 287 bp, Homo sapiens; identical to SEQ ID NO: 18
  misc_feature 1..287: note = chr1:22141015-22141302
  misc_feature 1..287: note = hyper
  source 1..287: mol_type = genomic DNA

SEQ ID NO: 5368 - DNA, 30 bp, Homo sapiens
  misc_feature 1..30: note = chr1:22933907-22933937
  misc_feature 1..30: note = hyper
  source 1..30: mol_type = genomic DNA
ttctgctgccacctccgcttccctcagcga

SEQ ID NO: 5369 - DNA, 255 bp, Homo sapiens
  misc_feature 1..255: note = chr1:23748862-23749117
  misc_feature 1..255: note = hyper
  source 1..255: mol_type = genomic DNA
gtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccat

SEQ ID NO: 5370 - DNA, 812 bp, Homo sapiens
  misc_feature 1..812: note = chr1:25256012-25256824
  misc_feature 1..812: note = hyper
  source 1..812: mol_type = genomic DNA
ctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctgg

SEQ ID NO: 5371 - DNA, 37 bp, Homo sapiens
  misc_feature 1..37: note = chr1:25257156-25257193
  misc_feature 1..37: note = hyper
  source 1..37: mol_type = genomic DNA
gggcctgtgacttctgcaaccccgggctgggggccgc

SEQ ID NO: 5372 - DNA, 106 bp, Homo sapiens
  misc_feature 1..106: note = chr1:26372988-26373094
  misc_feature 1..106: note = hyper
  source 1..106: mol_type = genomic DNA
agaggctactggggccgcgtctgccccctccgactggcggctgccctgggcttgatcatgttcccctctcaggccggagaccccccgaggtcggcttgcgttcctg

SEQ ID NO: 5373 - DNA, 312 bp, Homo sapiens
  misc_feature 1..312: note = chr1:26551804-26552116
  misc_feature 1..312: note = hyper
  source 1..312: mol_type = genomic DNA
caaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatc

SEQ ID NO: 5374 - DNA, 309 bp, Homo sapiens
  misc_feature 1..309: note = chr1:26735645-26735954
  misc_feature 1..309: note = hyper
  source 1..309: mol_type = genomic DNA
tcttggagagcaccccgtacgagagaaagggaaataacttctgcagtctcttgctttcctccccatcttccccttccctacccccactcatccggtctctctgaaatacacatgtgcccacatccgcacgtgcacacacacacacacacaaacacacacacagagccacagcgtgagaattccaaaaggttctgcacactcggtggagaagattgaattcagagcaagcggatgcccccgaaagcaggctctgtccctttaaatgggttgtagtggtgggggaggggaactggccggagctggcattgt

SEQ ID NO: 5375 - DNA, 400 bp, Homo sapiens
  misc_feature 1..400: note = chr1:26737246-26737646
  misc_feature 1..400: note = hyper
  source 1..400: mol_type = genomic DNA
cgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggcgtgcgcgccagactacgtgggtggatggagaggagaggcttgtcccgccgtgagtctctggga

SEQ ID NO: 5376 - DNA, 82 bp, Homo sapiens
  misc_feature 1..82: note = chr1:26738220-26738302
  misc_feature 1..82: note = hyper
  source 1..82: mol_type = genomic DNA
ccctgttaactatctcgtgggggagtagtgggaggcagcaccaattatcagcacccccgcccccttccgggaacccctccgg

SEQ ID NO: 5377 - DNA, 138 bp, Homo sapiens
  misc_feature 1..138: note = chr1:28199339-28199477
  misc_feature 1..138: note = hyper
  source 1..138: mol_type = genomic DNA
ctcggcttttgctttcgtggaacggggaccgctgacctgccccgcagggtagtgatgaaaagtcagtgggttgaggcgcgggaggtggatgcagccgggccactcctaggtggccccgcggtgcgcatgggacagagc

SEQ ID NO: 5378 - DNA, 52 bp, Homo sapiens
  misc_feature 1..52: note = chr1:29138840-29138892
  misc_feature 1..52: note = hyper
  source 1..52: mol_type = genomic DNA
tccccgcgcccagggcgcacggtggagagggacgcggcggagccggccggca

SEQ ID NO: 5379 - DNA, 164 bp, Homo sapiens
  misc_feature 1..164: note = chr1:29448530-29448694
  misc_feature 1..164: note = hyper
  source 1..164: mol_type = genomic DNA
cgcgctcgggttttccgcagcggagctccgagccaggcacgcgcggcagaagccggagttggcccggccagcgggcggagaggagggaggggggcgcaggctgttccctggcgcatcccgggctgcaaatctgccgcctgcgtccggtccgcaagcccgcgggt

SEQ ID NO: 5380 - DNA, 425 bp, Homo sapiens; identical to SEQ ID NO: 1668
  misc_feature 1..425: note = chr1:29586066-29586491
  misc_feature 1..425: note = hyper
  source 1..425: mol_type = genomic DNA

SEQ ID NO: 5381 - DNA, 30 bp, Homo sapiens
  misc_feature 1..30: note = chr1:29805064-29805094
  misc_feature 1..30: note = hyper
  source 1..30: mol_type = genomic DNA
cctcgcggtgagggtcgctcctgggtgtgg

SEQ ID NO: 5382 - DNA, 108 bp, Homo sapiens
  misc_feature 1..108: note = chr1:30559030-30559138
  misc_feature 1..108: note = hyper
  source 1..108: mol_type = genomic DNA
ggaggtcccgggggccgccccgcctcgcagcctgggctctgcctgctctgcgtccacgccagcataagccccagccggctccgtctcccctaacgactctaattacca

SEQ ID NO: 5383 - DNA, 124 bp, Homo sapiens; identical to SEQ ID NO: 1669
  misc_feature 1..124: note = chr1:30815454-30815578
  misc_feature 1..124: note = hyper
  source 1..124: mol_type = genomic DNA

SEQ ID NO: 5384 - DNA, 230 bp, Homo sapiens
  misc_feature 1..230: note = chr1:32180184-32180414
  misc_feature 1..230: note = hyper
  source 1..230: mol_type = genomic DNA
actcctaatccttcccggctgtggctgctaccgcttgccccgccggcaccgccctgccaagggcgcagagtcgggccagcagagccggagtgatgccgggccatcgaggcgtcctcagcccccgaggtgggaggtggtgggggggcggggaggagaagaagaaggctctcccgacacggtgactcaggcctccttgacccgctcctgggtgggcacgttcctgcgccccg

SEQ ID NO: 5385 - DNA, 228 bp, Homo sapiens
  misc_feature 1..228: note = chr1:32180905-32181133
  misc_feature 1..228: note = hyper
  source 1..228: mol_type = genomic DNA
cgccctaggccctgcctcctatctggctccgcccagccctggccaaccttagaacctgtcccaaggtccagagaggcctagatgaggggtagcctgcctctgagaggcatggagccctcctcccgcgtggggtcagggaatagaagggcgtcgagggtggcgggtgagggaacgttcctggcgccgcgaacgggaagcctccaggctgcaggacgtagctgcggggac

SEQ ID NO: 5386 - DNA, 15 bp, Homo sapiens
  misc_feature 1..15: note = chr1:32237531-32237546
  misc_feature 1..15: note = hyper
  source 1..15: mol_type = genomic DNA
cccaccgccggaagc

SEQ ID NO: 5387 - DNA, 1008 bp, Homo sapiens; identical to SEQ ID NO: 20
  misc_feature 1..1008: note = chr1:32237638-32238646
  misc_feature 1..1008: note = hyper
  source 1..1008: mol_type = genomic DNA

SEQ ID NO: 5388 - DNA, 130 bp, Homo sapiens
  misc_feature 1..130: note = chr1:32410234-32410364
  misc_feature 1..130: note = hyper
  source 1..130: mol_type = genomic DNA
ctagagcttcccctgcgtccgcctttgggggaggggagggagtgaagctgtgaattccgggagaagtcaagggtcgctcggggcgtgggtccgcgcgcggaggggctcgctgtcccggtgccagcgggag

SEQ ID NO: 5389 - DNA, 16 bp, Homo sapiens
  misc_feature 1..16: note = chr1:32827808-32827824
  misc_feature 1..16: note = hyper
  source 1..16: mol_type = genomic DNA
ggcctctggccatggc

SEQ ID NO: 5390 - DNA, 240 bp, Homo sapiens
  misc_feature 1..240: note = chr1:32930682-32930922
  misc_feature 1..240: note = hyper
  source 1..240: mol_type = genomic DNA
tgcgctgctggaacccgctggaaggtgagcgcgaagaagcgggttggcgctgccgctttcgttggtttggggaggattcctagcacccgggaggctggctggagattggggttagcgggcagggttgcccccactcagtcatcctccttcggaccgcttggccctggcaactcctgggacctccgccccgcgagcccttctagcgtggggaggggcaggcgcggccgtggggccccagct

SEQ ID NO: 5391 - DNA, 35 bp, Homo sapiens
  misc_feature 1..35: note = chr1:33351678-33351713
  misc_feature 1..35: note = hyper
  source 1..35: mol_type = genomic DNA
tgccaattcggccctcgaagcgacgtgcggctcag

SEQ ID NO: 5392 - DNA, 30 bp, Homo sapiens
  misc_feature 1..30: note = chr1:33772555-33772585
  misc_feature 1..30: note = hyper
  source 1..30: mol_type = genomic DNA
ccagtccaggccccccgcacagtgcgccgt

SEQ ID NO: 5393 - DNA, 985 bp, Homo sapiens
  misc_feature 1..985: note = chr1:34628827-34629812
  misc_feature 1..985: note = hyper
  source 1..985: mol_type = genomic DNA
cagcgattcccccaccgcccatgtggcaagtctgggtgaccagcagcgtcggtatgcacagcctcccagtgggtgtgggtgtgcgagaggccagagctcccaggcgcgcgcaccgcgggcgcccctctctgggtgtcggtggctatgactcttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggggtgctgtgggtaaagcgggagggcaccagtcgcggccagtagcctccacaggggaccgggttccctcgaaggttcgcgtacctcccccgcgcgctgcaagctgcagccagacacccgcgaagttccgggactctccgcacccgctagatctgccccttcccggactcggtcgtcgggagctggtcccgccgcccgcgccgccgctgccgctgccgcagccgaggcgctcggctgcagcagggcgcgggaaagggcactttggcgcggagtgagcaccgaggggaatgtggcagcgcgaagcctggcggcggcactccctcccccgcctcgggctacaaccccc

SEQ ID NO: 5394 - DNA, 741 bp, Homo sapiens; identical to SEQ ID NO: 1672
  misc_feature 1..741: note = chr1:34630245-34630986
  misc_feature 1..741: note = hyper
  source 1..741: mol_type = genomic DNA

SEQ ID NO: 5395 - DNA, 30 bp, Homo sapiens
  misc_feature 1..30: note = chr1:34631535-34631565
  misc_feature 1..30: note = hyper
  source 1..30: mol_type = genomic DNA
tcatttgacccagtgcggtcccactcctac

SEQ ID NO: 5396 - DNA, 192 bp, Homo sapiens
  misc_feature 1..192: note = chr1:34632140-34632332
  misc_feature 1..192: note = hyper
  source 1..192: mol_type = genomic DNA
caagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattgggg

SEQ ID NO: 5397 - DNA, 21 bp, Homo sapiens
  misc_feature 1..21: note = chr1:34642862-34642883
  misc_feature 1..21: note = hyper
  source 1..21: mol_type = genomic DNA
gctctgcgaggggctccctgg

SEQ ID NO: 5398 - DNA, 136 bp, Homo sapiens
  misc_feature 1..136: note = chr1:35258578-35258714
  misc_feature 1..136: note = hyper
  source 1..136: mol_type = genomic DNA
cccccgccgctcgtgcggtccagcagggctcccgcgggcgtcactccggccatcgtccccacctccacctgggccgcccggcaggcaggcggtgagtcgggggctaggaagggaccaggggcgccacctgctcgcg

SEQ ID NO: 5399 - DNA, 720 bp, Homo sapiens
  misc_feature 1..720: note = chr1:35351039-35351759
  misc_feature 1..720: note = hyper
  source 1..720: mol_type = genomic DNA
cagggtcagagccctcgtgggcgcctccccgttccatacctgcaccccaatggacggccgccacttccgctgccgcgccaggctccgcagctcctccctgccagggatggtcttgatgatgagtgtggggggcttggggctggcccggggcggcaccggcgccaactccagtgtgcgcgcacccatggcggggccgtccagcccgtcggcggagctgcagcgccgggcggggccctcggccgccgtgaagctctcgtgcgcggagtcggtgctgctctgggcggtgatggagatgcggggcggggcctggcttcccggcgggatggggggcggggcctttctgaagttgaaggctgtggccggcgagcgcagagacgcagtgggtgaggctcgcggccctgcctgggtcctgggcccgcgcccgactcccaccctcaagaggccctacgggaccctgcagcggcgcgcactccacatgctgctgcacacacgccaacggacgctctccccgtcatccgaccccgggagcgagcgatctgcgcgggtcacagcacagtcgagggggaggccagaacccggacccagggcgctctcctgcctagggccgggccaggggcaggaaggtgtactcacaggagccgggcctccctgagacagcggcaggggtagcgaggaggggcaggcagtcgtcgtcttgagagcagccggcctggatggccc

SEQ ID NO: 5400 - DNA, 60 bp, Homo sapiens
  misc_feature 1..60: note = chr1:35390613-35390673
  misc_feature 1..60: note = hyper
  source 1..60: mol_type = genomic DNA
atcccactcagcacccgggacagttcccagcgacattgccggccccggtagccagaaacc

SEQ ID NO: 5401 - DNA, 16 bp, Homo sapiens
  misc_feature 1..16: note = chr1:35395525-35395541
  misc_feature 1..16: note = hyper
  source 1..16: mol_type = genomic DNA
ccaggaacaggcaccc

SEQ ID NO: 5402 - DNA, 207 bp, Homo sapiens
  misc_feature 1..207: note = chr1:35395542-35395749
  misc_feature 1..207: note = hyper
  source 1..207: mol_type = genomic DNA
aagtgtcacggccacgcacagccgacctgggtacagggacccaagcccggcggcgggcgggcggtcggggaccagctcagcctcacggaccgggtctcgccccccgccgaggggcagtcacgccctgaatgtcacacacagcccccaggcccgtccgcttaggagactctccttcgggctttcccggtcggccgcctgacctcagct

SEQ ID NO: 5403 - DNA, 36 bp, Homo sapiens
  misc_feature 1..36: note = chr1:35395964-35396000
  misc_feature 1..36: note = hyper
  source 1..36: mol_type = genomic DNA
gggattgtgccatggcggggtcggggtggggggaaa

SEQ ID NO: 5404 - DNA, 940 bp, Homo sapiens; identical to SEQ ID NO: 21
  misc_feature 1..940: note = chr1:36042549-36043489
  misc_feature 1..940: note = hyper
  source 1..940: mol_type = genomic DNA

SEQ ID NO: 5405 - DNA, 30 bp, Homo sapiens
  misc_feature 1..30: note = chr1:36549840-36549870
  misc_feature 1..30: note = hyper
  source 1..30: mol_type = genomic DNA
aagaaaggggtttgacggggaaccggactg

SEQ ID NO: 5406 - DNA, 92 bp, Homo sapiens; identical to SEQ ID NO: 1674
  misc_feature 1..92: note = chr1:37498753-37498845
  misc_feature 1..92: note = hyper
  source 1..92: mol_type = genomic DNA

SEQ ID NO: 5407 - DNA, 200 bp, Homo sapiens; identical to SEQ ID NO: 1675
  misc_feature 1..200: note = chr1:37498888-37499088
  misc_feature 1..200: note = hyper
  source 1..200: mol_type = genomic DNA

SEQ ID NO: 5408 - DNA, 223 bp, Homo sapiens; identical to SEQ ID NO: 1676
  misc_feature 1..223: note = chr1:37499460-37499683
  misc_feature 1..223: note = hyper
  source 1..223: mol_type = genomic DNA

SEQ ID NO: 5409 - DNA, 142 bp, Homo sapiens; identical to SEQ ID NO: 1677
  misc_feature 1..142: note = chr1:37500013-37500155
  misc_feature 1..142: note = hyper
  source 1..142: mol_type = genomic DNA

SEQ ID NO: 5410 - DNA, 67 bp, Homo sapiens
  misc_feature 1..67: note = chr1:37500508-37500575
  misc_feature 1..67: note = hyper
  source 1..67: mol_type = genomic DNA
gcccgccgggagcagcgagaccgggagcccgccgtctgcggagcctggcctcgcggctcccacgcgg

SEQ ID NO: 5411 - DNA, 204 bp, Homo sapiens
  misc_feature 1..204: note = chr1:37500602-37500806
  misc_feature 1..204: note = hyper
  source 1..204: mol_type = genomic DNA
cgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggg

SEQ ID NO: 5412 - DNA, 188 bp, Homo sapiens
  misc_feature 1..188: note = chr1:38219712-38219900
  misc_feature 1..188: note = hyper
  source 1..188: mol_type = genomic DNA
ggcgcgtccaggctccgctcccccgtacgccgccttccggggcgctggcccccatatccgcccacgtgcgccccagtgcggagaccctgccctcaccaccacctggatcaggccttccttcttggccactcccaccccccaccctccgcagtgcagcctggaggggggactcacgggtgcaggaagcc

SEQ ID NO: 5413 - DNA, 155 bp, Homo sapiens
  misc_feature 1..155: note = chr1:38230088-38230243
  misc_feature 1..155: note = hyper
  source 1..155: mol_type = genomic DNA
cccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtc

SEQ ID NO: 5414 - skipped

SEQ ID NO: 5415 - DNA, 218 bp, Homo sapiens
  misc_feature 1..218: note = chr1:38230623-38230841
  misc_feature 1..218: note = hyper
  source 1..218: mol_type = genomic DNA
tcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagccgcgccagcctagcaccgctgagcaatgcccccagaccccagagccagcggggggcggagtct

SEQ ID NO: 5416 - DNA, 162 bp, Homo sapiens; identical to SEQ ID NO: 22
  misc_feature 1..162: note = chr1:38510087-38510249
  misc_feature 1..162: note = hyper
  source 1..162: mol_type = genomic DNA

SEQ ID NO: 5417 - DNA, 425 bp, Homo sapiens; identical to SEQ ID NO: 23
  misc_feature 1..425: note = chr1:38510309-38510734
  misc_feature 1..425: note = hyper
  source 1..425: mol_type = genomic DNA

SEQ ID NO: 5418 - DNA, 160 bp, Homo sapiens; identical to SEQ ID NO: 24
  misc_feature 1..160: note = chr1:38510773-38510933
  misc_feature 1..160: note = hyper
  source 1..160: mol_type = genomic DNA

SEQ ID NO: 5419 - DNA, 866 bp, Homo sapiens; identical to SEQ ID NO: 25
  misc_feature 1..866: note = chr1:38510934-38511800
  misc_feature 1..866: note = hyper
  source 1..866: mol_type = genomic DNA

SEQ ID NO: 5420 - DNA, 269 bp, Homo sapiens; identical to SEQ ID NO: 26
  misc_feature 1..269: note = chr1:38511821-38512090
  misc_feature 1..269: note = hyper
  source 1..269: mol_type = genomic DNA

SEQ ID NO: 5421 - DNA, 64 bp, Homo sapiens
  misc_feature 1..64: note = chr1:39044122-39044186
  misc_feature 1..64: note = hyper
  source 1..64: mol_type = genomic DNA
acggggaccgggagacgcgatccggagagcggtgggaagtattcgcctccgttcctcaaacaca

SEQ ID NO: 5422 - DNA, 478 bp, Homo sapiens; identical to SEQ ID NO: 1683
  misc_feature 1..478: note = chr1:39269643-39270121
  misc_feature 1..478: note = hyper
  source 1..478: mol_type = genomic DNA

SEQ ID NO: 5423 - DNA, 165 bp, Homo sapiens
  misc_feature 1..165: note = chr1:40105139-40105304
  misc_feature 1..165: note = hyper
  source 1..165: mol_type = genomic DNA
cctgctcggcgagcccgtcgggccgacccccaccccgctcgccctccgcctgctcggtccccgcatcccggcccttacctcagctggccctcttggcccacgtcgatgggtccgtcggactccccgtcggagccgctcggctccttgggtcgcttcatggcgaac

SEQ ID NO: 5424 - DNA, 79 bp, Homo sapiens
  misc_feature 1..79: note = chr1:40105538-40105617
  misc_feature 1..79: note = hyper
  source 1..79: mol_type = genomic DNA
tctgctccgctgtctcggctgccgcgcgctgggtggccttgggcaggtgccctgggaggccccgcggggaagccaggag

SEQ ID NO: 5425 - DNA, 120 bp, Homo sapiens; identical to SEQ ID NO: 1684
  misc_feature 1..120: note = chr1:40237083-40237203
  misc_feature 1..120: note = hyper
  source 1..120: mol_type = genomic DNA

SEQ ID NO: 5426 - DNA, 173 bp, Homo sapiens
  misc_feature 1..173: note = chr1:40781428-40781601
  misc_feature 1..173: note = hyper
  source 1..173: mol_type = genomic DNA
ggggcgcagctcttccgcgaactcccacgtattgagaatcttctgtatagcaggcactgtgtgccattacatgcattcattatcttacagaatactcagaaccgggaggcgggcgctattacgggccccagtttgcagtcgaagaaactggctcagaacgtgaagggtccatg

SEQ ID NO: 5427 - DNA, 91 bp, Homo sapiens
  misc_feature 1..91: note = chr1:41267904-41267995
  misc_feature 1..91: note = hyper
  source 1..91: mol_type = genomic DNA
tgtgaggtggaagggcgaggccgaggcggcggtggcgtcgcgtcccccctctccgcccctggcctcggggacgcggcggcaccttcacact

SEQ ID NO: 5428 - DNA, 428 bp, Homo sapiens; identical to SEQ ID NO: 1685
  misc_feature 1..428: note = chr1:41284168-41284596
  misc_feature 1..428: note = hyper
  source 1..428: mol_type = genomic DNA

SEQ ID NO: 5429 - DNA, 30 bp, Homo sapiens
  misc_feature 1..30: note = chr1:41327007-41327037
  misc_feature 1..30: note = hyper
  source 1..30: mol_type = genomic DNA
gtctctttcactttacggccgaggctgggg

SEQ ID NO: 5430 - skipped

SEQ ID NO: 5431 - DNA, 414 bp, Homo sapiens
  misc_feature 1..414: note = chr1:41847478-41847892
  misc_feature 1..414: note = hyper
  source 1..414: mol_type = genomic DNA
gcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcc

SEQ ID NO: 5432 - DNA, 11 bp, Homo sapiens
  misc_feature 1..11: note = chr1:43533901-43533912
  misc_feature 1..11: note = hyper
  source 1..11: mol_type = genomic DNA
ggtgtgcgccc

SEQ ID NO: 5433 - DNA, 30 bp, Homo sapiens
  misc_feature 1..30: note = chr1:43534162-43534192
  misc_feature 1..30: note = hyper
  source 1..30: mol_type = genomic DNA
aggcggcctctgtgccgacccagctgattc

SEQ ID NO: 5434 - DNA, 141 bp, Homo sapiens; identical to SEQ ID NO: 27
  misc_feature 1..141: note = chr1:44872582-44872723
  misc_feature 1..141: note = hyper
  source 1..141: mol_type = genomic DNA

SEQ ID NO: 5435 - DNA, 141 bp, Homo sapiens; identical to SEQ ID NO: 28
  misc_feature 1..141: note = chr1:44872923-44873064
  misc_feature 1..141: note = hyper
  source 1..141: mol_type = genomic DNA

SEQ ID NO: 5436 - DNA, 108 bp, Homo sapiens; identical to SEQ ID NO: 29
  misc_feature 1..108: note = chr1:44873065-44873173
  misc_feature 1..108: note = hyper
  source 1..108: mol_type = genomic DNA

SEQ ID NO: 5437 - DNA, 281 bp, Homo sapiens; identical to SEQ ID NO: 30
  misc_feature 1..281: note = chr1:44873509-44873790
  misc_feature 1..281: note = hyper
  source 1..281: mol_type = genomic DNA

SEQ ID NO: 5438 - DNA, 94 bp, Homo sapiens; identical to SEQ ID NO: 31
  misc_feature 1..94: note = chr1:44883121-44883215
  misc_feature 1..94: note = hyper
  source 1..94: mol_type = genomic DNA

SEQ ID NO: 5439 - DNA, 95 bp, Homo sapiens; identical to SEQ ID NO: 32
  misc_feature 1..95: note = chr1:44883751-44883846
  misc_feature 1..95: note = hyper
  source 1..95: mol_type = genomic DNA

SEQ ID NO: 5440 - DNA, 15 bp, Homo sapiens
  misc_feature 1..15: note = chr1:44884108-44884123
  misc_feature 1..15: note = hyper
  source 1..15: mol_type = genomic DNA
cgaagtccagggctc

SEQ ID NO: 5441 - DNA, 91 bp, Homo sapiens
  misc_feature 1..91: note = chr1:45250257-45250348
  misc_feature 1..91: note = hyper
  source 1..91: mol_type = genomic DNA
cgaggacccgcgtgccgggtcaggcccagtgcaagccactcaccgcaggttgaaggtggagcccaggaatgagggccgcagagactcggcc

SEQ ID NO: 5442 - DNA, 32 bp, Homo sapiens
  misc_feature 1..32: note = chr1:45252161-45252193
  misc_feature 1..32: note = hyper
  source 1..32: mol_type = genomic DNA
ggaagcgcttaagcacgcgggtgctgaccgag

SEQ ID NO: 5443 - DNA, 181 bp, Homo sapiens
  misc_feature 1..181: note = chr1:46632764-46632945
  misc_feature 1..181: note = hyper
  source 1..181: mol_type = genomic DNA
gctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctg

SEQ ID NO: 5444 - DNA, 40 bp, Homo sapiens; identical to SEQ ID NO: 1692
  misc_feature 1..40: note = chr1:46913837-46913877
  misc_feature 1..40: note = hyper
  source 1..40: mol_type = genomic DNA

SEQ ID NO: 5445 - DNA, 360 bp, Homo sapiens; identical to SEQ ID NO: 1693
  misc_feature 1..360: note = chr1:46913886-46914246
  misc_feature 1..360: note = hyper
  source 1..360: mol_type = genomic DNA

SEQ ID NO: 5446 - DNA, 137 bp, Homo sapiens; identical to SEQ ID NO: 1694
  misc_feature 1..137: note = chr1:46914285-46914422
  misc_feature 1..137: note = hyper
  source 1..137: mol_type = genomic DNA

SEQ ID NO: 5447 - DNA, 122 bp, Homo sapiens; identical to SEQ ID NO: 1695
  misc_feature 1..122: note = chr1:46951196-46951318
  misc_feature 1..122: note = hyper
  source 1..122: mol_type = genomic DNA

SEQ ID NO: 5448 - DNA, 95 bp, Homo sapiens; identical to SEQ ID NO: 1696
  misc_feature 1..95: note = chr1:46951644-46951739
  misc_feature 1..95: note = hyper
  source 1..95: mol_type = genomic DNA

SEQ ID NO: 5449 - DNA, 229 bp, Homo sapiens; identical to SEQ ID NO: 33
  misc_feature 1..229: note = chr1:46956387-46956616
  misc_feature 1..229: note = hyper
  source 1..229: mol_type = genomic DNA

SEQ ID NO: 5450 - DNA, 155 bp, Homo sapiens; identical to SEQ ID NO: 34
  misc_feature 1..155: note = chr1:46956684-46956839
  misc_feature 1..155: note = hyper
  source 1..155: mol_type = genomic DNA

SEQ ID NO: 5451 - DNA, 314 bp, Homo sapiens; identical to SEQ ID NO: 35
  misc_feature 1..314: note = chr1:46956840-46957154
  misc_feature 1..314: note = hyper
  source 1..314: mol_type = genomic DNA

SEQ ID NO: 5452 - DNA, 326 bp, Homo sapiens; identical to SEQ ID NO: 36
  misc_feature 1..326: note = chr1:47009560-47009886
  misc_feature 1..326: note = hyper
  source 1..326: mol_type = genomic DNA

SEQ ID NO: 5453 - DNA, 126 bp, Homo sapiens; identical to SEQ ID NO: 37
  misc_feature 1..126: note = chr1:47009910-47010036
  misc_feature 1..126: note = hyper
  source 1..126: mol_type = genomic DNA

SEQ ID NO: 5454 - DNA, 28 bp, Homo sapiens
  misc_feature 1..28: note = chr1:47010104-47010132
  misc_feature 1..28: note = hyper
  source 1..28: mol_type = genomic DNA
cgtccgcactttccgagagccaggcacg

SEQ ID NO: 5455 - DNA, 30 bp, Homo sapiens
  misc_feature 1..30: note = chr1:47695212-47695242
  misc_feature 1..30: note = hyper
  source 1..30: mol_type = genomic DNA
cctcctccccccacccgccttaaaaaaccc

SEQ ID NO: 5456 - DNA, 30 bp, Homo sapiens
  misc_feature 1..30: note = chr1:47695896-47695926
  misc_feature 1..30: note = hyper
  source 1..30: mol_type = genomic DNA
aggtaaaaacaaacccgacactactttcaa

SEQ ID NO: 5457 - DNA, 226 bp, Homo sapiens; identical to SEQ ID NO: 39
  misc_feature 1..226: note = chr1:47696295-47696521
  misc_feature 1..226: note = hyper
  source 1..226: mol_type = genomic DNA

SEQ ID NO: 5458 - DNA, 345 bp, Homo sapiens; identical to SEQ ID NO: 40
  misc_feature 1..345: note = chr1:47696620-47696965
  misc_feature 1..345: note = hyper
  source 1..345: mol_type = genomic DNA

SEQ ID NO: 5459 - DNA, 44 bp, Homo sapiens; identical to SEQ ID NO: 41
  misc_feature 1..44: note = chr1:47696986-47697030
  misc_feature 1..44: note = hyper
  source 1..44: mol_type = genomic DNA

SEQ ID NO: 5460 - DNA, 606 bp, Homo sapiens; identical to SEQ ID NO: 42
  misc_feature 1..606: note = chr1:47697341-47697947
  misc_feature 1..606: note = hyper
  source 1..606: mol_type = genomic DNA

SEQ ID NO: 5461 - DNA, 89 bp, Homo sapiens; identical to SEQ ID NO: 43
  misc_feature 1..89: note = chr1:47698006-47698095
  misc_feature 1..89: note = hyper
  source 1..89: mol_type = genomic DNA

SEQ ID NO: 5462 - DNA, 55 bp, Homo sapiens
  misc_feature 1..55: note = chr1:47882051-47882106
  misc_feature 1..55: note = hyper
  source 1..55: mol_type = genomic DNA
tcgcgccgtcggggccgccgccgtcgccgctcgcaggagccgagccagggcggga

SEQ ID NO: 5463 - DNA, 34 bp, Homo sapiens
  misc_feature 1..34: note = chr1:47882769-47882803
  misc_feature 1..34: note = hyper
  source 1..34: mol_type = genomic DNA
ctactcgcaggtccccgaccgcctggtactgccc

SEQ ID NO: 5464 - DNA, 370 bp, Homo sapiens; identical to SEQ ID NO: 1708
  misc_feature 1..370: note = chr1:47909575-47909945
  misc_feature 1..370: note = hyper
  source 1..370: mol_type = genomic DNA

SEQ ID NO: 5465 - DNA, 86 bp, Homo sapiens
  misc_feature 1..86: note = chr1:47910539-47910625
  misc_feature 1..86: note = hyper
  source 1..86: mol_type = genomic DNA
gctcgaggctgaggccgctccggaggcctggaggcttcggactgctggactagtggggaaggaaggcggtttcctccgcagcgccc

SEQ ID NO: 5466 - DNA, 127 bp, Homo sapiens
  misc_feature 1..127: note = chr1:47910748-47910875
  misc_feature 1..127: note = hyper
  source 1..127: mol_type = genomic DNA
cgctcgctgtccgcgactttgcatttctcctgcagcaggggtctctacccggtgccttcctcccggcacgctagcctcctcgccgaaatttcgtcgtcccggagtcggtaaccgagtcccaggcttt

SEQ ID NO: 5467 - DNA, 222 bp, Homo sapiens; identical to SEQ ID NO: 1709
  misc_feature 1..222: note = chr1:48059057-48059279
  misc_feature 1..222: note = hyper
  source 1..222: mol_type = genomic DNA

SEQ ID NO: 5468 - DNA, 52 bp, Homo sapiens
  misc_feature 1..52: note = chr1:48191010-48191062
  misc_feature 1..52: note = hyper
  source 1..52: mol_type = genomic DNA
aaagtcaatattggccgcggcgcccgcccggggcacccgggagcccctctgg

SEQ ID NO: 5469 - DNA, 79 bp, Homo sapiens
  misc_feature 1..79: note = chr1:48462159-48462238
  misc_feature 1..79: note = hyper
  source 1..79: mol_type = genomic DNA
gggagcgccccttctcgctcctggctgggagctggagccgggacaggcaggagcgaaggaagggcgcccgaggctgcgc

SEQ ID NO: 5470 - DNA, 16 bp, Homo sapiens
  misc_feature 1..16: note = chr1:49242343-49242359
  misc_feature 1..16: note = hyper
  source 1..16: mol_type = genomic DNA
ggctctcgggcccggc

SEQ ID NO: 5471 - DNA, 151 bp, Homo sapiens
  misc_feature 1..151: note = chr1:49242360-49242511
  misc_feature 1..151: note = hyper
  source 1..151: mol_type = genomic DNA
cccaattcctccgggccccggtacacggcgtacaccttctggttgtcaaaatccagccgcgagcgggggctgaagtcgcgcacgcacgacacgggcagcgcgtagcagacgttgtcctccaggaaccgcacaaaggcgtacatggtgggcg

SEQ ID NO: 5472 - DNA, 64 bp, Homo sapiens
  misc_feature 1..64: note = chr1:49242884-49242948
  misc_feature 1..64: note = hyper
  source 1..64: mol_type = genomic DNA
attgattaaaaggtgcgctgcgtgcaggattatattgcttcaacaatcgcgctgccaaattgca

SEQ ID NO: 5473 - DNA, 218 bp, Homo sapiens
  misc_feature 1..218: note = chr1:50513693-50513911
  misc_feature 1..218: note = hyper
  source 1..218: mol_type = genomic DNA
agggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacgg

SEQ ID NO: 5474 - DNA, 34 bp, Homo sapiens
  misc_feature 1..34: note = chr1:50514141-50514175
  misc_feature 1..34: note = hyper
  source 1..34: mol_type = genomic DNA
tgaaacttgggttgacgcgcgccccctccccagc

SEQ ID NO: 5475 - DNA, 665 bp, Homo sapiens; identical to SEQ ID NO: 1710
  misc_feature 1..665: note = chr1:50798652-50799317
  misc_feature 1..665: note = hyper
  source 1..665: mol_type = genomic DNA

SEQ ID NO: 5476 - DNA, 127 bp, Homo sapiens; identical to SEQ ID NO: 1711
  misc_feature 1..127: note = chr1:50799393-50799520
  misc_feature 1..127: note = hyper
  source 1..127: mol_type = genomic DNA

SEQ ID NO: 5477 - DNA, 302 bp, Homo sapiens; identical to SEQ ID NO: 1712
  misc_feature 1..302: note = chr1:50880931-50881233
  misc_feature 1..302: note = hyper
  source 1..302: mol_type = genomic DNA

SEQ ID NO: 5478 - DNA, 65 bp, Homo sapiens
  misc_feature 1..65: note = chr1:50881486-50881551
  misc_feature 1..65: note = hyper
  source 1..65: mol_type = genomic DNA
acctcactcctagaacgcccaccgctcacgaagccttcctgagctctacccgaaggtgctgacag

SEQ ID NO: 5479 - DNA, 88 bp, Homo sapiens; identical to SEQ ID NO: 1713
  misc_feature 1..88: note = chr1:50881869-50881957
  misc_feature 1..88: note = hyper
  source 1..88: mol_type = genomic DNA

SEQ ID NO: 5480 - DNA, 119 bp, Homo sapiens; identical to SEQ ID NO: 1714
  misc_feature 1..119: note = chr1:50882143-50882262
  misc_feature 1..119: note = hyper
  source 1..119: mol_type = genomic DNA

SEQ ID NO: 5481 - DNA, 59 bp, Homo sapiens
  misc_feature 1..59: note = chr1:50882470-50882529
  misc_feature 1..59: note = hyper
  source 1..59: mol_type = genomic DNA
gtcgccggacccagccgaggggaggagtcattcttttcctggagcgggggagtcaccct

SEQ ID NO: 5482 - DNA, 600 bp, Homo sapiens; identical to SEQ ID NO: 44
  misc_feature 1..600: note = chr1:50882808-50883408
  misc_feature 1..600: note = hyper
  source 1..600: mol_type = genomic DNA

SEQ ID NO: 5483 - DNA, 15 bp, Homo sapiens
  misc_feature 1..15: note = chr1:50883962-50883977
  misc_feature 1..15: note = hyper
  source 1..15: mol_type = genomic DNA
ccatccactgagagc

SEQ ID NO: 5484 - DNA, 333 bp, Homo sapiens; identical to SEQ ID NO: 46
  misc_feature 1..333: note = chr1:50884020-50884353
  misc_feature 1..333: note = hyper
  source 1..333: mol_type = genomic DNA

SEQ ID NO: 5485 - DNA, 198 bp, Homo sapiens; identical to SEQ ID NO: 47
  misc_feature 1..198: note = chr1:50884690-50884888
  misc_feature 1..198: note = hyper
  source 1..198: mol_type = genomic DNA

SEQ ID NO: 5486 - DNA, 131 bp, Homo sapiens
  misc_feature 1..131: note = chr1:50886104-50886235
  misc_feature 1..131: note = hyper
  source 1..131: mol_type = genomic DNA
aaaccagggagggtgcggaagaaactagaaggagggagggcgcagcaagcggttgtccagagggcgttaggaacgcgagaaggggaaaagaaactagggcgtctcagaacctagggcgtctcaaaacctag

SEQ ID NO: 5487 - DNA, 634 bp, Homo sapiens; identical to SEQ ID NO: 48
  misc_feature 1..634: note = chr1:50886451-50887085
  misc_feature 1..634: note = hyper
  source 1..634: mol_type = genomic DNA

SEQ ID NO: 5488 - DNA, 60 bp, Homo sapiens; identical to SEQ ID NO: 49
  misc_feature 1..60: note = chr1:50887175-50887235
  misc_feature 1..60: note = hyper
  source 1..60: mol_type = genomic DNA

SEQ ID NO: 5489 - DNA, 30 bp, Homo sapiens
  misc_feature 1..30: note = chr1:50888238-50888268
  misc_feature 1..30: note = hyper
  source 1..30: mol_type = genomic DNA
agtcggggcggaagacgtatcctgcgaaaa

SEQ ID NO: 5490 - DNA, 121 bp, Homo sapiens
  misc_feature 1..121: note = chr1:50888675-50888796
  misc_feature 1..121: note = hyper
  source 1..121: mol_type = genomic DNA
ctctcccagacccttcgggcgtccctaaggcccacggggcccaggcctcctcaacaggggccgcagaccaggtctccacccactgctctccctgcggccctcaactacctgccttgggctc

SEQ ID NO: 5491 - DNA, 727 bp, Homo sapiens; identical to SEQ ID NO: 1721
  misc_feature 1..727: note = chr1:50889123-50889850
  misc_feature 1..727: note = hyper
  source 1..727: mol_type = genomic DNA

SEQ ID NO: 5492 - DNA, 307 bp, Homo sapiens; identical to SEQ ID NO: 1722
  misc_feature 1..307: note = chr1:50890061-50890368
  misc_feature 1..307: note = hyper
  source 1..307: mol_type = genomic DNA

SEQ ID NO: 5493 - DNA, 152 bp, Homo sapiens; identical to SEQ ID NO: 1723
  misc_feature 1..152: note = chr1:50890795-50890947
  misc_feature 1..152: note = hyper
  source 1..152: mol_type = genomic DNA

SEQ ID NO: 5494 - DNA, 322 bp, Homo sapiens; identical to SEQ ID NO: 50
  misc_feature 1..322: note = chr1:50891148-50891470
  misc_feature 1..322: note = hyper
  source 1..322: mol_type = genomic DNA

SEQ ID NO: 5495 - DNA, 131 bp, Homo sapiens; identical to SEQ ID NO: 1725
  misc_feature 1..131: note = chr1:50892153-50892284
  misc_feature 1..131: note = hyper
  source 1..131: mol_type = genomic DNA

SEQ ID NO: 5496 - DNA, 525 bp, Homo sapiens; identical to SEQ ID NO: 1726
  misc_feature 1..525: note = chr1:50892336-50892861
  misc_feature 1..525: note = hyper
  source 1..525: mol_type = genomic DNA

SEQ ID NO: 5497 - skipped

SEQ ID NO: 5498 - DNA, 273 bp, Homo sapiens
  misc_feature 1..273: note = chr1:50893150-50893423
  misc_feature 1..273: note = hyper
  source 1..273: mol_type = genomic DNA
tggtcatagccacggatctatgccacgacctgggaccgggcataatttcggagccagaaagtactcctgtggtggcgccgggtttctcaggcgctcttccagctaagggccaggagcccagcgatttccctacagttgcttactgaagtcgcaccattctctgcgaggcaggtccgattattccacttgtcaggtgagaaaacagactcggagaggtgagatgacttgttccacattatcacaattagtgagtaacagtgcaaaaatcaaacc

SEQ ID NO: 5499 - DNA, 298 bp, Homo sapiens
  misc_feature 1..298: note = chr1:50893518-50893816
  misc_feature 1..298: note = hyper
  source 1..298: mol_type = genomic DNA
cgttggccgggaacccgctggtgctcagcttctatccggaccccggacctaaaggccgggcagaacaaccaactgaaggtggaggagcgagggcactggtgctgattgagcggcaggagcccccgaggcggagtcccagcggctgcagccctcctttggatcaagccctcgcgtcttccgggcaggcggaagggaggcgtctgcccagtgtcgccaggcttctcacgattttctggttgggagcatctaagcctgagacaaacgcatggagagcggtgttcaccgccccactatttgt

SEQ ID NO: 5500 - DNA, 248 bp, Homo sapiens
  misc_feature 1..248: note = chr1:53068182-53068430
  misc_feature 1..248: note = hyper
  source 1..248: mol_type = genomic DNA
gggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacg

SEQ ID NO: 5501 - DNA, 351 bp, Homo sapiens
  misc_feature 1..351: note = chr1:53098702-53099053
  misc_feature 1..351: note = hyper
  source 1..351: mol_type = genomic DNA
tcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttc

SEQ ID NO: 5502 - DNA, 312 bp, Homo sapiens
  misc_feature 1..312: note = chr1:53099054-53099366
  misc_feature 1..312: note = hyper
  source 1..312: mol_type = genomic DNA
tctctgccgttctcaggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcaggtaccgtccctggccctca

SEQ ID NO: 5503 - DNA, 52 bp, Homo sapiens
  misc_feature 1..52: note = chr1:53168843-53168895
  misc_feature 1..52: note = hyper
  source 1..52: mol_type = genomic DNA
gggggctgcccagctcgccgtcctctgcagatcccctcgggactctcagcat

SEQ ID NO: 5504 - DNA, 49 bp, Homo sapiens; identical to SEQ ID NO: 1727
  misc_feature 1..49: note = chr1:53308559-53308608
  misc_feature 1..49: note = hyper
  source 1..49: mol_type = genomic DNA

SEQ ID NO: 5505 - DNA, 368 bp, Homo sapiens; identical to SEQ ID NO: 1728
  misc_feature 1..368: note = chr1:53308907-53309275
  misc_feature 1..368: note = hyper
  source 1..368: mol_type = genomic DNA

SEQ ID NO: 5506 - DNA, 30 bp, Homo sapiens
  misc_feature 1..30: note = chr1:53527576-53527606
  misc_feature 1..30: note = hyper
  source 1..30: mol_type = genomic DNA
gcggaccagacagcccgccttcccggtctc

SEQ ID NO: 5507 - DNA, 92 bp, Homo sapiens
  misc_feature 1..92: note = chr1:53527939-53528031
  misc_feature 1..92: note = hyper
  source 1..92: mol_type = genomic DNA
gttcggcctgtggggcgccgctcggcgccggggcgcagcaggtacagggcgctggcagccggggtgggccgaggggccgggggctgagcccg

SEQ ID NO: 5508 - DNA, 184 bp, Homo sapiens
  misc_feature 1..184: note = chr1:53528255-53528439
  misc_feature 1..184: note = hyper
  source 1..184: mol_type = genomic DNA
gaaagaatctgagggcggttgggggcgggggctggagtgggaggacgccggcgggcgacagggaatgtggggggcaggtggaactgcgtaggggcggggacccctgtcatgagagcctgggcccgaagtatccccgcgtctttccacgtcaactcatcaggccccctagcgactccaacctcca

SEQ ID NO: 5509 - DNA, 504 bp, Homo sapiens; identical to SEQ ID NO: 51
  misc_feature 1..504: note = chr1:54203828-54204332
  misc_feature 1..504: note = hyper
  source 1..504: mol_type = genomic DNA

SEQ ID NO: 5510 - DNA, 135 bp, Homo sapiens
  misc_feature 1..135: note = chr1:55462748-55462883
  misc_feature 1..135: note = hyper
  source 1..135: mol_type = genomic DNA
caggctcggtttcctcgcctgtgaaatgcgggcgatgactcccctccccgccgcgactgctcatcaccgggtccgagcccagccgctgaccccgggggaagcgccttgctcagcgccgggcggcccacgaggccc

SEQ ID NO: 5511 - DNA, 30 bp, Homo sapiens
  misc_feature 1..30: note = chr1:57111203-57111233
  misc_feature 1..30: note = hyper
  source 1..30: mol_type = genomic DNA
ggccgaggggagaggcgggagccccgggcc

SEQ ID NO: 5512 - DNA, 70 bp, Homo sapiens
  misc_feature 1..70: note = chr1:57888327-57888397
  misc_feature 1..70: note = hyper
  source 1..70: mol_type = genomic DNA
ctctcccagcctaagcggaagtgccccagcagacccccaacaatgaggatttgtgcgatgcagttggggg

SEQ ID NO: 5513 - DNA, 255 bp, Homo sapiens
  misc_feature 1..255: note = chr1:57888780-57889035
  misc_feature 1..255: note = hyper
  source 1..255: mol_type = genomic DNA
gcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagaggatccgaagaaaggccggggtccgaggaacgcgggatccagttctcac

SEQ ID NO: 5514 - DNA, 67 bp, Homo sapiens
  misc_feature 1..67: note = chr1:57889036-57889103
  misc_feature 1..67: note = hyper
  source 1..67: mol_type = genomic DNA
gtgcccgcgaaagggctgggattactgggatagagtcggtttttcgagaggtcgaagccgaatctca

SEQ ID NO: 5515 - DNA, 126 bp, Homo sapiens
  misc_feature 1..126: note = chr1:57889478-57889604
  misc_feature 1..126: note = hyper
  source 1..126: mol_type = genomic DNA
ccaggagccctcctccgcgccccggggctccagcgaagcctcctggctccccggcgccctgtcctcgcggggcacctgcggcgctgaactcaagggttgccgcgcgcccccgccgcgcctcacctc

SEQ ID NO: 5516 - DNA, 329 bp, Homo sapiens
  misc_feature 1..329: note = chr1:57889605-57889934
  misc_feature 1..329: note = hyper
  source 1..329: mol_type = genomic DNA
cctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccgggg

SEQ ID NO: 5517 - DNA, 218 bp, Homo sapiens
  misc_feature 1..218: note = chr1:57890367-57890585
  misc_feature 1..218: note = hyper
  source 1..218: mol_type = genomic DNA
gcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 5518 - DNA, 29 bp, Homo sapiens
  misc_feature 1..29: note = chr1:58715503-58715532
  misc_feature 1..29: note = hyper
  source 1..29: mol_type = genomic DNA
cggccacaacttgggcggctctgtgcggc

SEQ ID NO: 5519 - DNA, 322 bp, Homo sapiens; identical to SEQ ID NO: 53
  misc_feature 1..322: note = chr1:58715533-58715855
  misc_feature 1..322: note = hyper
  source 1..322: mol_type = genomic DNA

SEQ ID NO: 5520 - DNA, 15 bp, Homo sapiens
  misc_feature 1..15: note = chr1:58715978-58715993
  misc_feature 1..15: note = hyper
  source 1..15: mol_type = genomic DNA
cgagcgggctccgct

SEQ ID NO: 5521 - DNA, 400 bp, Homo sapiens
  misc_feature 1..400: note = chr1:59042095-59042495
  misc_feature 1..400: note = hyper
  source 1..400: mol_type = genomic DNA
gcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggcc

SEQ ID NO: 5522 - DNA, 30 bp, Homo sapiens
  misc_feature 1..30: note = chr1:62784565-62784595
  misc_feature 1..30: note = hyper
  source 1..30: mol_type = genomic DNA
gctgggaggcgggggcgccaggtcggccca

SEQ ID NO: 5523 - DNA, 256 bp, Homo sapiens
  misc_feature 1..256: note = chr1:62784890-62785146
  misc_feature 1..256: note = hyper
  source 1..256: mol_type = genomic DNA
cccaggcgcgcaccccggggctggcgcaccctggtcgtccgcggcgcgcacaccctccaggcgccctctggccgacggtctcggccctggccccggcgcacccctgcgggcacacccaccgcggcggatgcgggactggccaggcgccgccagccgcggcttcgccccgcgtcgccagctgccaacagcgcccgagtccccgccttcgctaggggagaaaaaaaagactcctgacgcggcgcggactttggtgtgt

SEQ ID NO: 5524 - DNA, 342 bp, Homo sapiens; identical to SEQ ID NO: 55
  misc_feature 1..342: note = chr1:63539509-63539851
  misc_feature 1..342: note = hyper
  source 1..342: mol_type = genomic DNA

SEQ ID NO: 5525 - DNA, 32 bp, Homo sapiens
  misc_feature 1..32: note = chr1:63784373-63784405
  misc_feature 1..32: note = hyper
  source 1..32: mol_type = genomic DNA
actcttggtgggggacgcgcccttcactccgc

SEQ ID NO: 5526 - DNA, 306 bp, Homo sapiens; identical to SEQ ID NO: 56
  misc_feature 1..306: note = chr1:63784987-63785293
  misc_feature 1..306: note = hyper
  source 1..306: mol_type = genomic DNA

SEQ ID NO: 5527 - DNA, 149 bp, Homo sapiens; identical to SEQ ID NO: 57
  misc_feature 1..149: note = chr1:63785618-63785767
  misc_feature 1..149: note = hyper
  source 1..149: mol_type = genomic DNA

SEQ ID NO: 5528 - DNA, 251 bp, Homo sapiens; identical to SEQ ID NO: 58
  misc_feature 1..251: note = chr1:63786078-63786329
  misc_feature 1..251: note = hyper
  source 1..251: mol_type = genomic DNA

SEQ ID NO: 5529 - DNA, 102 bp, Homo sapiens; identical to SEQ ID NO: 1737
  misc_feature 1..102: note = chr1:63786656-63786758
  misc_feature 1..102: note = hyper
  source 1..102: mol_type = genomic DNA

SEQ ID NO: 5530 - DNA, 32 bp, Homo sapiens; identical to SEQ ID NO: 1738
  misc_feature 1..32: note = chr1:63787031-63787063
  misc_feature 1..32: note = hyper
  source 1..32: mol_type = genomic DNA

SEQ ID NO: 5531 - DNA, 308 bp, Homo sapiens
  misc_feature 1..308: note = chr1:63787302-63787610
  misc_feature 1..308: note = hyper
  source 1..308: mol_type = genomic DNA
caccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggt

SEQ ID NO: 5532 - DNA, 315 bp, Homo sapiens
  misc_feature 1..315: note = chr1:63788359-63788674
  misc_feature 1..315: note = hyper
  source 1..315: mol_type = genomic DNA
cctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccga

SEQ ID NO: 5533 - DNA, 280 bp, Homo sapiens; identical to SEQ ID NO: 59
  misc_feature 1..280: note = chr1:63789217-63789497
  misc_feature 1..280: note = hyper
  source 1..280: mol_type = genomic DNA

SEQ ID NO: 5534 - DNA, 31 bp, Homo sapiens; identical to SEQ ID NO: 60
  misc_feature 1..31: note = chr1:63789728-63789759
  misc_feature 1..31: note = hyper
  source 1..31: mol_type = genomic DNA

SEQ ID NO: 5535 - DNA, 26 bp, Homo sapiens
  misc_feature 1..26: note = chr1:63790252-63790278
  misc_feature 1..26: note = hyper
  source 1..26: mol_type = genomic DNA
ggtcccggtcccgctgcccaatcctg

SEQ ID NO: 5536 - DNA, 15 bp, Homo sapiens
  misc_feature 1..15: note = chr1:63792634-63792649
  misc_feature 1..15: note = hyper
  source 1..15: mol_type = genomic DNA
ccaccgccggagact

SEQ ID NO: 5537 - DNA, 87 bp, Homo sapiens
  misc_feature 1..87: note = chr1:63792797-63792884
  misc_feature 1..87: note = hyper
  source 1..87: mol_type = genomic DNA
cggacccagaccctcaagctgccagcggttgtttaaagtcctggcagatgtcaggaagatgggcccggccgtcgcaccctcaaaagc

SEQ ID NO: 5538 - DNA, 584 bp, Homo sapiens; identical to SEQ ID NO: 61
  misc_feature 1..584: note = chr1:63795350-63795934
  misc_feature 1..584: note = hyper
  source 1..584: mol_type = genomic DNA

SEQ ID NO: 5539 - DNA, 218 bp, Homo sapiens; identical to SEQ ID NO: 62
  misc_feature 1..218: note = chr1:63795935-63796153
  misc_feature 1..218: note = hyper
  source 1..218: mol_type = genomic DNA

SEQ ID NO: 5540 - DNA, 275 bp, Homo sapiens
  misc_feature 1..275: note = chr1:65731231-65731506
  misc_feature 1..275: note = hyper
  source 1..275: mol_type = genomic DNA
gggggaagagagaaacgaatttaaataaaaactcaaaaaaggaaagggctaaccgaaaaatgagccaaccaaattttaagttcaacaacaagcattctggaggattctggggttttaaattcggaggctccttaaatattctgccgcagttgggggaggagcgatggacccctaggtctccggaggctacacgtgttccccgatcccgtttccagggggagcccttccttcctattgcgctggtcgtgctcctggcccgcgtgcccaggaagggc

SEQ ID NO: 5541 - DNA, 186 bp, Homo sapiens
  misc_feature 1..186: note = chr1:65991321-65991507
  misc_feature 1..186: note = hyper
  source 1..186: mol_type = genomic DNA
acctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtggga

SEQ ID NO: 5542 - DNA, 30 bp, Homo sapiens
  misc_feature 1..30: note = chr1:66258273-66258303
  misc_feature 1..30: note = hyper
  source 1..30: mol_type = genomic DNA
ctggtaccgtgcccgcggaatattgcagga

SEQ ID NO: 5543 - DNA, 41 bp, Homo sapiens
  misc_feature 1..41: note = chr1:66258719-66258760
  misc_feature 1..41: note = hyper
  source 1..41: mol_type = genomic DNA
cggctgcaggctcttcgtcgcgggccgggctgcacgcgagc

SEQ ID NO: 5544 - DNA, 13 bp, Homo sapiens
  misc_feature 1..13: note = chr1:66258761-66258774
  misc_feature 1..13: note = hyper
  source 1..13: mol_type = genomic DNA
ccctccgggcaga

SEQ ID NO: 5545 - DNA, 139 bp, Homo sapiens
  misc_feature 1..139: note = chr1:66259292-66259431
  misc_feature 1..139: note = hyper
  source 1..139: mol_type = genomic DNA
attgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 5546 - DNA, 462 bp, Homo sapiens; identical to SEQ ID NO: 63
  misc_feature 1..462: note = chr1:66998790-66999252
  misc_feature 1..462: note = hyper
  source 1..462: mol_type = genomic DNA

SEQ ID NO: 5547 - DNA, 43 bp, Homo sapiens
  misc_feature 1..43: note = chr1:66999572-66999615
  misc_feature 1..43: note = hyper
  source 1..43: mol_type = genomic DNA
gtaagcttaaggagacgacgaggaggggcgggggaagtgcgtc

SEQ ID NO: 5548 - DNA, 378 bp, Homo sapiens; identical to SEQ ID NO: 64
  misc_feature 1..378: note = chr1:67217965-67218343
  misc_feature 1..378: note = hyper
  source 1..378: mol_type = genomic DNA

SEQ ID NO: 5549 - DNA, 621 bp, Homo sapiens; identical to SEQ ID NO: 1746
  misc_feature 1..621: note = chr1:67773159-67773780
  misc_feature 1..621: note = hyper
  source 1..621: mol_type = genomic DNA

SEQ ID NO: 5550 - DNA, 39 bp, Homo sapiens
  misc_feature 1..39: note = chr1:70033537-70033576
  misc_feature 1..39: note = hyper
  source 1..39: mol_type = genomic DNA
aaaaaagagagggggcggggagagcggtgagacacagcc

SEQ ID NO: 5551 - DNA, 502 bp, Homo sapiens; identical to SEQ ID NO: 1747
  misc_feature 1..502: note = chr1:70033989-70034491
  misc_feature 1..502: note = hyper
  source 1..502: mol_type = genomic DNA

SEQ ID NO: 5552 - DNA, 13 bp, Homo sapiens
  misc_feature 1..13: note = chr1:70034492-70034505
  misc_feature 1..13: note = hyper
  source 1..13: mol_type = genomic DNA
gcgaagatgtggt

SEQ ID NO: 5553 - DNA, 43 bp, Homo sapiens
  misc_feature 1..43: note = chr1:70035121-70035164
  misc_feature 1..43: note = hyper
  source 1..43: mol_type = genomic DNA
attaaggatgcaggacgtgtttcggattcgacgtggaaagagg

SEQ ID NO: 5554 - DNA, 48 bp, Homo sapiens
  misc_feature 1..48: note = chr1:71513699-71513747
  misc_feature 1..48: note = hyper
  source 1..48: mol_type = genomic DNA
tctcctccagttctccgctaaagtgtcggtggacggcaagcagctaat

SEQ ID NO: 5555 - DNA, 76 bp, Homo sapiens
  misc_feature 1..76: note = chr1:72747951-72748027
  misc_feature 1..76: note = hyper
  source 1..76: mol_type = genomic DNA
gacagaaagatagaccgaaacaagtacgaaaagcacgccgttcttcctacctaagcaccgccgtgtccccttttct

SEQ ID NO: 5556 - DNA, 158 bp, Homo sapiens
  misc_feature 1..158: note = chr1:72750097-72750255
  misc_feature 1..158: note = hyper
  source 1..158: mol_type = genomic DNA
aagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtgg

SEQ ID NO: 5557 - DNA, 30 bp, Homo sapiens
  misc_feature 1..30: note = chr1:72750522-72750552
  misc_feature 1..30: note = hyper
  source 1..30: mol_type = genomic DNA
aatgttagtcatttgcggatgaatgaaaac

SEQ ID NO: 5558 - DNA, 30 bp, Homo sapiens
  misc_feature 1..30: note = chr1:75595334-75595364
  misc_feature 1..30: note = hyper
  source 1..30: mol_type = genomic DNA
cctatccccagaaaccgagaaaaccatctg

SEQ ID NO: 5559 - DNA, 170 bp, Homo sapiens
  misc_feature 1..170: note = chr1:75595821-75595991
  misc_feature 1..170: note = hyper
  source 1..170: mol_type = genomic DNA
gccatagcttttagccgggaagctttccaggctgccctgcttaatttcggcgtggttcctaattttctctctcccatcctctctcttagactggaaacgcttcccctatttcttccgtagcggaccgggagagcttactggcgctctgcgaaccggctggaaagaaacac

SEQ ID NO: 5560 - DNA, 158 bp, Homo sapiens
  misc_feature 1..158: note = chr1:75596135-75596293
  misc_feature 1..158: note = hyper
  source 1..158: mol_type = genomic DNA
cgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcac

SEQ ID NO: 5561 - DNA, 151 bp, Homo sapiens; identical to SEQ ID NO: 65
  misc_feature 1..151: note = chr1:75596708-75596859
  misc_feature 1..151: note = hyper
  source 1..151: mol_type = genomic DNA

SEQ ID NO: 5562 - DNA, 418 bp, Homo sapiens; identical to SEQ ID NO: 66
  misc_feature 1..418: note = chr1:75596929-75597347
  misc_feature 1..418: note = hyper
  source 1..418: mol_type = genomic DNA

SEQ ID NO: 5563 - DNA, 256 bp, Homo sapiens
  misc_feature 1..256: note = chr1:75597923-75598179
  misc_feature 1..256: note = hyper
  source 1..256: mol_type = genomic DNA
cccagaccgacaggacgatcagccctgggattcatagcaaacacattcccctcttcttgcacactcgacccccagccaaaggcttataccgcccaggacatagaaattgactcaccgcccagaggcttacagctcaaggaggggtgcgcgcagctgcaccccgggacaggtcagcatcccacaaggcgcctggagtaaagcgaggccagaccaatctttcacgtcttctgctcctgtctgacgaccattcttcttc

SEQ ID NO: 5564 - DNA, 482 bp, Homo sapiens
  misc_feature 1..482: note = chr1:75600203-75600685
  misc_feature 1..482: note = hyper
  source 1..482: mol_type = genomic DNA
cttttattagtggatcggggcgggggaggggggagatcggcagacacggacagcctctgaccctctggagttggtatgtgataagcagccctagcagtgccatgtattggaagaacgatcagatgtttgtgtgtaaactagtagcaaaggacgtgccggagctggcagttccccctgagaaggtgagcgagccgacgcctggccagaccagctgaatcgcagtgtccttgaaactcgagttgtttgggctcctaaacaaggttcagaaactacctgtaacggcctcatcttcagacctggcaattttttttttttattacgtagtagcgttagtcagtaatcattgcactccctccccaaaagctcacttaacctgagacatggagactgtaatttgggagatgaagcctcgagcctaaggcgctctcaggtccatgtgagtcgtgcttttgttctatttgctgtggtgatcgtggcggtcc

SEQ ID NO: 5565 - DNA, 433 bp, Homo sapiens
  misc_feature 1..433: note = chr1:75600686-75601119
  misc_feature 1..433: note = hyper
  source 1..433: mol_type = genomic DNA
ggagagtgggtcgggaggactgggcggctgtcgggtggaaccggagacctggctcgtttcgttcggctgcccgcggacacttgcctgccctgaggcacacctccctctgcggggctccagaaaggcctccgggatccctgggcttgccgggagagccattttacctaaaatgccaaaagaaaaccgcagggcacaaaacgagtcacgcggtttgtctgagtagactggggaagctgacaagctctcacctcactcgggaggcaggacctgtgggtatttggtgttttaagtttgaaatcatctgcagcctgtctgagggcctcagcaggacgcgcgcggggcgcccctgactatttctttgctccgaagccggttggggacaccaggcgaaagcggagctgttctgtttaaacgccctttgtgtgtgaggacg

SEQ ID NO: 5566 - DNA, 89 bp, Homo sapiens
  misc_feature 1..89: note = chr1:75601187-75601276
  misc_feature 1..89: note = hyper
  source 1..89: mol_type = genomic DNA
cggtccgggaggcccccaggttggtatcttgcctggtgcttccagagggagggagaaggggaggcgaacagtcagaaatgcagaagtgc

SEQ ID NO: 5567 - DNA, 151 bp, Homo sapiens
  misc_feature 1..151: note = chr1:75601277-75601428
  misc_feature 1..151: note = hyper
  source 1..151: mol_type = genomic DNA
agccgctcgagttcggggtacccacccgcccccgagctagagtttttggaaacgaaagcggtctaagcccagggacgctgcgttttcgtttaagaacaaaactccagcaaatacttggaaacacttgagtaacgcgcgttgtttctttaaa

SEQ ID NO: 5568 - DNA, 369 bp, Homo sapiens; identical to SEQ ID NO: 1751
  misc_feature 1..369: note = chr1:75601983-75602352
  misc_feature 1..369: note = hyper
  source 1..369: mol_type = genomic DNA

SEQ ID NO: 5569 - DNA, 416 bp, Homo sapiens
  misc_feature 1..416: note = chr1:75602743-75603159
  misc_feature 1..416: note = hyper
  source 1..416: mol_type = genomic DNA
ggaggggtctagaaccgcctgcgcctcgcggtttcctgcaggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtaggatagggcctcgggtgcgaggcccaaggggagcgggcttagcgtgggagctctgggaaaagagtaatgttcctcccaccaacctttccgttcaagttctgggtgaaggttgtaggcttttgcagaaaatcagcccagtttagggcaactcatgcggtgggataaagtgagaagaaatcccagactcttctatgtcgttgcaaaacagct

SEQ ID NO: 5570 - DNA, 449 bp, Homo sapiens
  misc_feature 1..449: note = chr1:76080278-76080727
  misc_feature 1..449: note = hyper
  source 1..449: mol_type = genomic DNA
gaaaagcaaaaagcacgccaaagcctgagcgctgctgtagtccaagccaatgtattcagtaatacccttcacccctcagttctcatctgagttcctgtccttttttatataaccccaaaggctcagtaagtcgctgcctcccaggtcattgggcccattgtgttgaaatccaacttcgaacgacgccccttccttgccaccatcctcaggtccagttcccccgcgcacagccttcctcaccgcgcatggtgtcgagcccacttccacctctctgcagtgctgcagacaacctctagggctctgcgagtcccccagcgagagctagggagccgacaagctgcgacctctgcgagtccgcgctgcgggagcgggtggcttgcacctgctccccgcgcgccggctctgcgacccctaggcaagacgcagcccaggaggctccctcccgagtc

SEQ ID NO: 5571 - DNA, 230 bp, Homo sapiens
  misc_feature 1..230: note = chr1:76080728-76080958
  misc_feature 1..230: note = hyper
  source 1..230: mol_type = genomic DNA
cgccccggaccacgccgcaatgcctcgtcaccccagcaacaagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggag

SEQ ID NO: 5572 - DNA, 223 bp, Homo sapiens
  misc_feature 1..223: note = chr1:76082155-76082378
  misc_feature 1..223: note = hyper
  source 1..223: mol_type = genomic DNA
ctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 5573 - DNA, 30 bp, Homo sapiens
  misc_feature 1..30: note = chr1:76540210-76540240
  misc_feature 1..30: note = hyper
  source 1..30: mol_type = genomic DNA
agcgcactctgcgcacgtcgagccgcgaaa

SEQ ID NO: 5574 - DNA, 76 bp, Homo sapiens
  misc_feature 1..76: note = chr1:76540498-76540574
  misc_feature 1..76: note = hyper
  source 1..76: mol_type = genomic DNA
cccctgacccaggcgcgcccgctgctcggtggcaggagggccggcggagcgccatggcctgcatcctgaaggtaac

SEQ ID NO: 5575 - DNA, 13 bp, Homo sapiens
  misc_feature 1..13: note = chr1:76540575-76540588
  misc_feature 1..13: note = hyper
  source 1..13: mol_type = genomic DNA
acttggatctgtg

SEQ ID NO: 5576 - DNA, 30 bp, Homo sapiens
  misc_feature 1..30: note = chr1:77333003-77333033
  misc_feature 1..30: note = hyper
  source 1..30: mol_type = genomic DNA
gtgggtacactggctcggttaactctctct

SEQ ID NO: 5577 - DNA, 50 bp, Homo sapiens
  misc_feature 1..50: note = chr1:77333384-77333434
  misc_feature 1..50: note = hyper
  source 1..50: mol_type = genomic DNA
ttgtggcaactccaccgggcaaagagggggatccccgggctcagggtcca

SEQ ID NO: 5578 - DNA, 218 bp, Homo sapiens; identical to SEQ ID NO: 67
  misc_feature 1..218: note = chr1:77334168-77334386
  misc_feature 1..218: note = hyper
  source 1..218: mol_type = genomic DNA

SEQ ID NO: 5579 - DNA, 119 bp, Homo sapiens; identical to SEQ ID NO: 68
  misc_feature 1..119: note = chr1:77334408-77334527
  misc_feature 1..119: note = hyper
  source 1..119: mol_type = genomic DNA

SEQ ID NO: 5580 - DNA, 54 bp, Homo sapiens
  misc_feature 1..54: note = chr1:77334828-77334882
  misc_feature 1..54: note = hyper
  source 1..54: mol_type = genomic DNA
gaaccggagggtgagcgcagccagcccgcggccactgctcgggatccagcgttc

SEQ ID NO: 5581 - DNA, 75 bp, Homo sapiens
  misc_feature 1..75: note = chr1:77747307-77747382
  misc_feature 1..75: note = hyper
  source 1..75: mol_type = genomic DNA
agttcctcggagacccggaggtaaccgtgtatgtgcgtgcgagtgtgtctgtgtgcgtacaaggtccggagaagc

SEQ ID NO: 5582 - DNA, 343 bp, Homo sapiens
  misc_feature 1..343: note = chr1:77747383-77747726
  misc_feature 1..343: note = hyper
  source 1..343: mol_type = genomic DNA
aaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcc

SEQ ID NO: 5583 - DNA, 318 bp, Homo sapiens
  misc_feature 1..318: note = chr1:77748403-77748721
  misc_feature 1..318: note = hyper
  source 1..318: mol_type = genomic DNA
aggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctgg

SEQ ID NO: 5584 - DNA, 178 bp, Homo sapiens
  misc_feature 1..178: note = chr1:78354744-78354922
  misc_feature 1..178: note = hyper
  source 1..178: mol_type = genomic DNA
tgccctgctcccctgcgccttgtcggctgagtttcgggtgcgttccctactgtagggagggagccctctgtgagcggagtgggtgccgatccctcggctgaacccttggggtccttagggaagttcagtgccgtcccccaccacttgccccagccgcggtctccgtctctgccagcag

SEQ ID NO: 5585 - DNA, 403 bp, Homo sapiens
  misc_feature 1..403: note = chr1:78511453-78511856
  misc_feature 1..403: note = hyper
  source 1..403: mol_type = genomic DNA
attgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggc

SEQ ID NO: 5586 - DNA, 497 bp, Homo sapiens
  misc_feature 1..497: note = chr1:78511857-78512354
  misc_feature 1..497: note = hyper
  source 1..497: mol_type = genomic DNA
cgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggaggtaaggcgccaggtgctcaggctctcccgcctctccgccgcgccgcgccgcgccgcgcgtatttctgtgggcccaggagggttgagcggcgtttcccggagcgcgaaatccgatgccgtgttgagtccgccgggggcgtcccgggggaaagtgagtgtgccttccctggaagggaaaatttaacttggcaggaccgcagaaagtcacagtcccccttgctccgagatctggcctttgggaagcgggttgagggaggcaacctttcttccgcttgcaaatgtgtttgctccagatgtcccggattccgccggccgttcaaggcgtgagcaccttccc

SEQ ID NO: 5587 - DNA, 267 bp, Homo sapiens; identical to SEQ ID NO: 1754
  misc_feature 1..267: note = chr1:78957231-78957498
  misc_feature 1..267: note = hyper
  source 1..267: mol_type = genomic DNA

SEQ ID NO: 5588 - DNA, 30 bp, Homo sapiens
  misc_feature 1..30: note = chr1:82267630-82267660
  misc_feature 1..30: note = hyper
  source 1..30: mol_type = genomic DNA
gcgtgtgggaaactgcgggaaaatgttgac

SEQ ID NO: 5589 - DNA, 49 bp, Homo sapiens
  misc_feature 1..49: note = chr1:82267942-82267991
  misc_feature 1..49: note = hyper
  source 1..49: mol_type = genomic DNA
ctctgtgcccagcttcggagacctgtttgctttgcgcctccagtccggg

SEQ ID NO: 5590 - DNA, 30 bp, Homo sapiens
  misc_feature 1..30: note = chr1:82268226-82268256
  misc_feature 1..30: note = hyper
  source 1..30: mol_type = genomic DNA
ttaggatgaggctcccgtagccatgcattt

SEQ ID NO: 5591 - DNA, 132 bp, Homo sapiens
  misc_feature 1..132: note = chr1:85358461-85358593
  misc_feature 1..132: note = hyper
  source 1..132: mol_type = genomic DNA
gctttttgctcctagcggggaaaaaggtgggaaaagagcaagttgtgccatacacccgccgggagagtcttgtcccggggtttggagtgggtctggagcccaggcttgcacgccaggcaaccccgaaaagcc

SEQ ID NO: 5592 - DNA, 71 bp, Homo sapiens
  misc_feature 1..71: note = chr1:85358751-85358822
  misc_feature 1..71: note = hyper
  source 1..71: mol_type = genomic DNA
cgcatgccctcggggtcgagcgcgacggggcgaccgggcgccgggctccagccgggcgcggagaagcagcg

SEQ ID NO: 5593 - DNA, 59 bp, Homo sapiens
  misc_feature 1..59: note = chr1:85359218-85359277
  misc_feature 1..59: note = hyper
  source 1..59: mol_type = genomic DNA
tgtttgaagtggctgcgggaagtgcagcccacacccaccacccccgtgggaggcaggct

SEQ ID NO: 5594 - DNA, 69 bp, Homo sapiens
  misc_feature 1..69: note = chr1:85463878-85463947
  misc_feature 1..69: note = hyper
  source 1..69: mol_type = genomic DNA
aaagtgcgaccggcgcgcaaggaataggaaaagcgagttgccctgcgcccgcgtcgggatgaaaggcag

SEQ ID NO: 5595 - DNA, 335 bp, Homo sapiens
  misc_feature 1..335: note = chr1:86621580-86621915
  misc_feature 1..335: note = hyper
  source 1..335: mol_type = genomic DNA
tagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaa

SEQ ID NO: 5596 - DNA, 26 bp, Homo sapiens
  misc_feature 1..26: note = chr1:86622526-86622552
  misc_feature 1..26: note = hyper
  source 1..26: mol_type = genomic DNA
tccttggaaacagcccgcgcccgaac

SEQ ID NO: 5597 - DNA, 51 bp, Homo sapiens
  misc_feature 1..51: note = chr1:87617774-87617825
  misc_feature 1..51: note = hyper
  source 1..51: mol_type = genomic DNA
cttgcagagtggccccgccgccgtcctgaactttctcgggaggggaaggcg

SEQ ID NO: 5598 - DNA, 590 bp, Homo sapiens; identical to SEQ ID NO: 1755
  misc_feature 1..590: note = chr1:91172087-91172677
  misc_feature 1..590: note = hyper
  source 1..590: mol_type = genomic DNA

SEQ ID NO: 5599 - DNA, 147 bp, Homo sapiens
  misc_feature 1..147: note = chr1:91176423-91176570
  misc_feature 1..147: note = hyper
  source 1..147: mol_type = genomic DNA
taggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcc

SEQ ID NO: 5600 - DNA, 45 bp, Homo sapiens
  misc_feature 1..45: note = chr1:91176908-91176953
  misc_feature 1..45: note = hyper
  source 1..45: mol_type = genomic DNA
tatcaaataatggttcggaagaggccagcacgaaaaatggagctg

SEQ ID NO: 5601 - DNA, 417 bp, Homo sapiens; identical to SEQ ID NO: 69
  misc_feature 1..417: note = chr1:91177840-91178257
  misc_feature 1..417: note = hyper
  source 1..417: mol_type = genomic DNA

SEQ ID NO: 5602 - DNA, 241 bp, Homo sapiens; identical to SEQ ID NO: 70
  misc_feature 1..241: note = chr1:91181807-91182048
  misc_feature 1..241: note = hyper
  source 1..241: mol_type = genomic DNA

SEQ ID NO: 5603 - DNA, 162 bp, Homo sapiens; identical to SEQ ID NO: 1758
  misc_feature 1..162: note = chr1:91182320-91182482
  misc_feature 1..162: note = hyper
  source 1..162: mol_type = genomic DNA

SEQ ID NO: 5604 - DNA, 84 bp, Homo sapiens
  misc_feature 1..84: note = chr1:91183284-91183368
  misc_feature 1..84: note = hyper
  source 1..84: mol_type = genomic DNA
tcccgaggtggcagccgcgcgccactcggcagccccgtagccgagtttctgaactttcttggaaagttgcggggcagacacggc

SEQ ID NO: 5605 - DNA, 30 bp, Homo sapiens
  misc_feature 1..30: note = chr1:91183775-91183805
  misc_feature 1..30: note = hyper
  source 1..30: mol_type = genomic DNA
cgagtccagtggtcccggtgtccacaatca

SEQ ID NO: 5606 - DNA, 139 bp, Homo sapiens; identical to SEQ ID NO: 1759
  misc_feature 1..139: note = chr1:91184274-91184413
  misc_feature 1..139: note = hyper
  source 1..139: mol_type = genomic DNA

SEQ ID NO: 5607 - DNA, 73 bp, Homo sapiens; identical to SEQ ID NO: 1760
  misc_feature 1..73: note = chr1:91184414-91184487
  misc_feature 1..73: note = hyper
  source 1..73: mol_type = genomic DNA

SEQ ID NO: 5608 - DNA, 30 bp, Homo sapiens
  misc_feature 1..30: note = chr1:91184823-91184853
  misc_feature 1..30: note = hyper
  source 1..30: mol_type = genomic DNA
ctccaaaggctgggccgaaatctggagttt

SEQ ID NO: 5609 - DNA, 119 bp, Homo sapiens; identical to SEQ ID NO: 1761
  misc_feature 1..119: note = chr1:91185190-91185309
  misc_feature 1..119: note = hyper
  source 1..119: mol_type = genomic DNA

SEQ ID NO: 5610 - DNA, 230 bp, Homo sapiens; identical to SEQ ID NO: 1762
  misc_feature 1..230: note = chr1:91185347-91185577
  misc_feature 1..230: note = hyper
  source 1..230: mol_type = genomic DNA

SEQ ID NO: 5611 - DNA, 481 bp, Homo sapiens; identical to SEQ ID NO: 71
  misc_feature 1..481: note = chr1:91188983-91189464
  misc_feature 1..481: note = hyper
  source 1..481: mol_type = genomic DNA

SEQ ID NO: 5612 - DNA, 34 bp, Homo sapiens
  misc_feature 1..34: note = chr1:91189724-91189758
  misc_feature 1..34: note = hyper
  source 1..34: mol_type = genomic DNA
ctcccacccagcccacgcgcgcttccccaccccc

SEQ ID NO: 5613 - DNA, 269 bp, Homo sapiens; identical to SEQ ID NO: 72
  misc_feature 1..269: note = chr1:91190137-91190406
  misc_feature 1..269: note = hyper
  source 1..269: mol_type = genomic DNA

SEQ ID NO: 5614 - DNA, 80 bp, Homo sapiens; identical to SEQ ID NO: 1765
  misc_feature 1..80: note = chr1:91190869-91190949
  misc_feature 1..80: note = hyper
  source 1..80: mol_type = genomic DNA

SEQ ID NO: 5615 - DNA, 17 bp, Homo sapiens
  misc_feature 1..17: note = chr1:91190984-91191001
  misc_feature 1..17: note = hyper
  source 1..17: mol_type = genomic DNA
cggagagtgcccctccc

SEQ ID NO: 5616 - DNA, 233 bp, Homo sapiens; identical to SEQ ID NO: 1767
  misc_feature 1..233: note = chr1:91191002-91191235
  misc_feature 1..233: note = hyper
  source 1..233: mol_type = genomic DNA

SEQ ID NO: 5617 - DNA, 249 bp, Homo sapiens; identical to SEQ ID NO: 1768
  misc_feature 1..249: note = chr1:91191289-91191538
  misc_feature 1..249: note = hyper
  source 1..249: mol_type = genomic DNA

SEQ ID NO: 5618 - DNA, 233 bp, Homo sapiens; identical to SEQ ID NO: 73
  misc_feature 1..233: note = chr1:91192344-91192577
  misc_feature 1..233: note = hyper
  source 1..233: mol_type = genomic DNA

SEQ ID NO: 5619 - DNA, 54 bp, Homo sapiens; identical to SEQ ID NO: 74
  misc_feature 1..54: note = chr1:91192681-91192735
  misc_feature 1..54: note = hyper
  source 1..54: mol_type = genomic DNA

SEQ ID NO: 5620 - DNA, 71 bp, Homo sapiens
  misc_feature 1..71: note = chr1:91194749-91194820
  misc_feature 1..71: note = hyper
  source 1..71: mol_type = genomic DNA
gagctgcaggaaaaccgaatcgcgcttagggtcaggagcaagacaggagctttcagcgaagatctgaacat

SEQ ID NO: 5621 - DNA, 242 bp, Homo sapiens; identical to SEQ ID NO: 75
  misc_feature 1..242: note = chr1:91195148-91195390
  misc_feature 1..242: note = hyper
  source 1..242: mol_type = genomic DNA

SEQ ID NO: 5622 - DNA, 316 bp, Homo sapiens
  misc_feature 1..316: note = chr1:91195879-91196195
  misc_feature 1..316: note = hyper
  source 1..316: mol_type = genomic DNA
taaaatcattgttcacgtgtcaatttaaaagaccattaaagcagcttattttggttttaattggaacctcctcccttccaactacaggcttaaaagaaaaaaaaaaaaaactctcccccacacccaggcgcgcgcacgcacgcgggcacgcagcagcgatggggatgtaggtcaccccgcgggttagggccacgcgcccgcactcccgccgcagccgcaaccgcagccgcagccgcagccaacgcggccgcggagcgacgcagtccgcagcctcgaatttccagaaattccagcactggcagcagcacgtctagtt

SEQ ID NO: 5623 - DNA, 201 bp, Homo sapiens
  misc_feature 1..201: note = chr1:91196225-91196426
  misc_feature 1..201: note = hyper
  source 1..201: mol_type = genomic DNA
cgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaa

SEQ ID NO: 5624 - DNA, 71 bp, Homo sapiens; identical to SEQ ID NO: 1772
  misc_feature 1..71: note = chr1:91316261-91316332
  misc_feature 1..71: note = hyper
  source 1..71: mol_type = genomic DNA

SEQ ID NO: 5625 - DNA, 128 bp, Homo sapiens
  misc_feature 1..128: note = chr1:91316627-91316755
  misc_feature 1..128: note = hyper
  source 1..128: mol_type = genomic DNA
ccgcgctccacagcgcgtcacccgctgccctagcgacccccgggcgaccccggcatcgcctggctgcgccgtcccggcgggccggccctctccacgccctctcctggggtttgcggtgggcacagctc

SEQ ID NO: 5626 - DNA, 39 bp, Homo sapiens
  misc_feature 1..39: note = chr1:92495704-92495743
  misc_feature 1..39: note = hyper
  source 1..39: mol_type = genomic DNA
ggtctactgctactgcgggctctgcgcctccatccacct

SEQ ID NO: 5627 - DNA, 146 bp, Homo sapiens; identical to SEQ ID NO: 1773
  misc_feature 1..146: note = chr1:92948451-92948597
  misc_feature 1..146: note = hyper
  source 1..146: mol_type = genomic DNA

SEQ ID NO: 5628 - DNA, 439 bp, Homo sapiens
  misc_feature 1..439: note = chr1:92948817-92949256
  misc_feature 1..439: note = hyper
  source 1..439: mol_type = genomic DNA
cagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacg

SEQ ID NO: 5629 - DNA, 41 bp, Homo sapiens
  misc_feature 1..41: note = chr1:92949786-92949827
  misc_feature 1..41: note = hyper
  source 1..41: mol_type = genomic DNA
gaggggaacaacagacgaccaacccccgccccaggagaaac

SEQ ID NO: 5630 - DNA, 75 bp, Homo sapiens
  misc_feature 1..75: note = chr1:92950099-92950174
  misc_feature 1..75: note = hyper
  source 1..75: mol_type = genomic DNA
acaaaaaagacaggacgccagagcgcgcaggctgcattagcagagagcgggggtcgggcccgggcccgggaggga

SEQ ID NO: 5631 - DNA, 182 bp, Homo sapiens
  misc_feature 1..182: note = chr1:92950668-92950850
  misc_feature 1..182: note = hyper
  source 1..182: mol_type = genomic DNA
acctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaa

SEQ ID NO: 5632 - DNA, 215 bp, Homo sapiens
  misc_feature 1..215: note = chr1:92951530-92951745
  misc_feature 1..215: note = hyper
  source 1..215: mol_type = genomic DNA
caccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccct

SEQ ID NO: 5633 - DNA, 135 bp, Homo sapiens; identical to SEQ ID NO: 1774
  misc_feature 1..135: note = chr1:92952304-92952439
  misc_feature 1..135: note = hyper
  source 1..135: mol_type = genomic DNA

SEQ ID NO: 5634 - DNA, 270 bp, Homo sapiens
  misc_feature 1..270: note = chr1:98510761-98511031
  misc_feature 1..270: note = hyper
  source 1..270: mol_type = genomic DNA
acctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttcc

SEQ ID NO: 5635 - DNA, 307 bp, Homo sapiens; identical to SEQ ID NO: 1775
  misc_feature 1..307: note = chr1:98511359-98511666
  misc_feature 1..307: note = hyper
  source 1..307: mol_type = genomic DNA

SEQ ID NO: 5636 - DNA, 16 bp, Homo sapiens
  misc_feature 1..16: note = chr1:98515071-98515087
  misc_feature 1..16: note = hyper
  source 1..16: mol_type = genomic DNA
gggaagggacctcggc

SEQ ID NO: 5637 - DNA, 103 bp, Homo sapiens
  misc_feature 1..103: note = chr1:98515088-98515191
  misc_feature 1..103: note = hyper
  source 1..103: mol_type = genomic DNA
cctcgcgctggctgtgccccagtgccttcgcgtggtggcggcttgctcatgcttccgaggagtcccaggcgatagccttcagctgatgcgagcttccagaaag

SEQ ID NO: 5638 - DNA, 244 bp, Homo sapiens
  misc_feature 1..244: note = chr1:98519221-98519465
  misc_feature 1..244: note = hyper
  source 1..244: mol_type = genomic DNA
tctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgc

SEQ ID NO: 5639 - DNA, 30 bp, Homo sapiens
  misc_feature 1..30: note = chr1:99469618-99469648
  misc_feature 1..30: note = hyper
  source 1..30: mol_type = genomic DNA
agaggaggcagtgagcgagtcaaggccaca

SEQ ID NO: 5640 - DNA, 44 bp, Homo sapiens
  misc_feature 1..44: note = chr1:99469930-99469974
  misc_feature 1..44: note = hyper
  source 1..44: mol_type = genomic DNA
cccgaaggcgaggggcgagatcagggactcggcgacgagggcga

SEQ ID NO: 5641 - DNA, 255 bp, Homo sapiens
  misc_feature 1..255: note = chr1:99470275-99470530
  misc_feature 1..255: note = hyper
  source 1..255: mol_type = genomic DNA
ggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccggg

SEQ ID NO: 5642 - DNA, 36 bp, Homo sapiens
  misc_feature 1..36: note = chr1:99470582-99470618
  misc_feature 1..36: note = hyper
  source 1..36: mol_type = genomic DNA
cgctgggtcaatcccccaggctagcccggaggaggc

SEQ ID NO: 5643 - DNA, 166 bp, Homo sapiens
  misc_feature 1..166: note = chr1:99470619-99470785
  misc_feature 1..166: note = hyper
  source 1..166: mol_type = genomic DNA
ctgcgtgggcggacggggcggcagccggcgggacagcggcacctgtacccctcacagggcggacgctgtggggctggagaagctcctggcgggggtaaaatcaaaagggggggaggggaggcagtagagatggagcttccagaaactcttccgaggcaccagctga

SEQ ID NO: 5644 - DNA, 361 bp, Homo sapiens; identical to SEQ ID NO: 1776
  misc_feature 1..361: note = chr1:101004456-101004817
  misc_feature 1..361: note = hyper
  source 1..361: mol_type = genomic DNA

SEQ ID NO: 5645 - DNA, 653 bp, Homo sapiens; identical to SEQ ID NO: 1777
  misc_feature 1..653: note = chr1:101005071-101005724
  misc_feature 1..653: note = hyper
  source 1..653: mol_type = genomic DNA

SEQ ID NO: 5646 - DNA, 78 bp, Homo sapiens
  misc_feature 1..78: note = chr1:101702524-101702602
  misc_feature 1..78: note = hyper
  source 1..78: mol_type = genomic DNA
ggagggaggggaccccgactcgagtaagtttgcgagagcactacgcagtcagtcgggggcagcagcaagatgcgaagc

SEQ ID NO: 5647 - DNA, 155 bp, Homo sapiens
  misc_feature 1..155: note = chr1:101702603-101702758
  misc_feature 1..155: note = hyper
  source 1..155: mol_type = genomic DNA
agccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaa

SEQ ID NO: 5648 - DNA, 30 bp, Homo sapiens
  misc_feature 1..30: note = chr1:101703188-101703218
  misc_feature 1..30: note = hyper
  source 1..30: mol_type = genomic DNA
tctgctgaccagtgccgtcttagaaagttt

SEQ ID NO: 5649 - DNA, 43 bp, Homo sapiens
  misc_feature 1..43: note = chr1:101703599-101703642
  misc_feature 1..43: note = hyper
  source 1..43: mol_type = genomic DNA
gaaagaaaaggcagtcgcttcacggaggcgctaagctttcctg

SEQ ID NO: 5650 - DNA, 226 bp, Homo sapiens
  misc_feature 1..226: note = chr1:101775150-101775376
  misc_feature 1..226: note = hyper
  source 1..226: mol_type = genomic DNA
ttgcaggtggagcagcggcggctgcatcagcgtctcaaattgcgaaaacattttgggctgaagtatttctttgtagcatttcgtggagcccctttcctttgatatacactagccttccgacttccctttgttcttttttcacacgtcaggttttatcgctgacaagctccaacgcgtcaaaggcgttagatctgagggctgcagcagccttcgcggttccgcattg

SEQ ID NO: 5651 - DNA, 60 bp, Homo sapiens
  misc_feature 1..60: note = chr1:103572677-103572737
  misc_feature 1..60: note = hyper
  source 1..60: mol_type = genomic DNA
gagggagggagaaggcggaggggaggagtgaagtcgctctccctccgtgggtactgacag

SEQ ID NO: 5652 - DNA, 281 bp, Homo sapiens
  misc_feature 1..281: note = chr1:103573722-103574003
  misc_feature 1..281: note = hyper
  source 1..281: mol_type = genomic DNA
ccacggctccatctccgagccccgcactcacaactgtgaactcaacccacgaaattgcgactgcagaccaacttcgtcctttccaaggtatcgccagggatgtttgctacacagccattggggagggagagggggaaaaagtcaaagggctttttcttctaaatttgatggtttgcgttcttcgtgtctctagccctttcctctccctctgagttggccccaccggccgggaccctccggccgcgaccctctgatccttcctctgccgggccctgccttca

SEQ ID NO: 5653 - DNA, 107 bp, Homo sapiens
  misc_feature 1..107: note = chr1:107682658-107682765
  misc_feature 1..107: note = hyper
  source 1..107: mol_type = genomic DNA
cttctgtggaggagccgggggggatggggagtagagggagggggccctgttgcctcagcgccccgaggtcgtggagcggcagcagctgcagccggagcagcaccagc

SEQ ID NO: 5654 - DNA, 604 bp, Homo sapiens; identical to SEQ ID NO: 1778
  misc_feature 1..604: note = chr1:107683171-107683775
  misc_feature 1..604: note = hyper
  source 1..604: mol_type = genomic DNA

SEQ ID NO: 5655 - DNA, 13 bp, Homo sapiens
  misc_feature 1..13: note = chr1:107683776-107683789
  misc_feature 1..13: note = hyper
  source 1..13: mol_type = genomic DNA
gggagtggcgggc

SEQ ID NO: 5656 - DNA, 182 bp, Homo sapiens
  misc_feature 1..182: note = chr1:107684241-107684423
  misc_feature 1..182: note = hyper
  source 1..182: mol_type = genomic DNA
cgaggaggcagcgcgcggagccctacgcgcacacacagcggcacacgctcacacccacacacaagtcttcccgggggtgcgccccgggccggtgatgcgtcctcttgttgtgtccggagcccaggcgtggggtctgagcctccatccgccgactgacaggggccccgcgctctccctctctc

SEQ ID NO: 5657 - DNA, 450 bp, Homo sapiens; identical to SEQ ID NO: 76
  misc_feature 1..450: note = chr1:108506627-108507077
  misc_feature 1..450: note = hyper
  source 1..450: mol_type = genomic DNA

SEQ ID NO: 5658 - DNA, 228 bp, Homo sapiens; identical to SEQ ID NO: 77
  misc_feature 1..228: note = chr1:108507148-108507376
  misc_feature 1..228: note = hyper
  source 1..228: mol_type = genomic DNA

SEQ ID NO: 5659 - DNA, 113 bp, Homo sapiens; identical to SEQ ID NO: 78
  misc_feature 1..113: note = chr1:108507494-108507607
  misc_feature 1..113: note = hyper
  source 1..113: mol_type = genomic DNA

SEQ ID NO: 5660 - DNA, 550 bp, Homo sapiens; identical to SEQ ID NO: 79
  misc_feature 1..550: note = chr1:108507657-108508207
  misc_feature 1..550: note = hyper
  source 1..550: mol_type = genomic DNA

SEQ ID NO: 5661 - DNA, 340 bp, Homo sapiens; identical to SEQ ID NO: 80
  misc_feature 1..340: note = chr1:108508208-108508548
  misc_feature 1..340: note = hyper
  source 1..340: mol_type = genomic DNA

SEQ ID NO: 5662 - DNA, 38 bp, Homo sapiens; identical to SEQ ID NO: 81
  misc_feature 1..38: note = chr1:108508549-108508587
  misc_feature 1..38: note = hyper
  source 1..38: mol_type = genomic DNA

SEQ ID NO: 5663 - DNA, 591 bp, Homo sapiens
  misc_feature 1..591: note = chr1:109203618-109204209
  misc_feature 1..591: note = hyper
  source 1..591: mol_type = genomic DNA
gcttccatcatcctgcggtaagcagcatgcccaaccgaaaaaacaaagctcgtcgcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcgg

SEQ ID NO: 5664 - DNA, 66 bp, Homo sapiens
  misc_feature 1..66: note = chr1:109656914-109656980
  misc_feature 1..66: note = hyper
  source 1..66: mol_type = genomic DNA
aggtgacccagggaacgggaccggagcttcatgcctgcaaagaggtactgccgcccccctacccga

SEQ ID NO: 5665 - DNA, 97 bp, Homo sapiens
  misc_feature 1..97: note = chr1:110009644-110009741
  misc_feature 1..97: note = hyper
  source 1..97: mol_type = genomic DNA
accgccctgaccccccggccggctgtgtctccgcaggtggaccgcctactcgtggggctgcgctggcggcggctggaggagccgctgggcttcatca

SEQ ID NO: 5666 - DNA, 42 bp, Homo sapiens
  misc_feature 1..42: note = chr1:110283094-110283136
  misc_feature 1..42: note = hyper
  source 1..42: mol_type = genomic DNA
agggcctggcgaccccgaggcgggacccgggcaggagtgctg

SEQ ID NO: 5667 - DNA, 312 bp, Homo sapiens; identical to SEQ ID NO: 82
  misc_feature 1..312: note = chr1:110610586-110610898
  misc_feature 1..312: note = hyper
  source 1..312: mol_type = genomic DNA

SEQ ID NO: 5668 - DNA, 232 bp, Homo sapiens; identical to SEQ ID NO: 83
  misc_feature 1..232: note = chr1:110611045-110611277
  misc_feature 1..232: note = hyper
  source 1..232: mol_type = genomic DNA

SEQ ID NO: 5669 - DNA, 80 bp, Homo sapiens; identical to SEQ ID NO: 84
  misc_feature 1..80: note = chr1:110611434-110611514
  misc_feature 1..80: note = hyper
  source 1..80: mol_type = genomic DNA

SEQ ID NO: 5670 - DNA, 141 bp, Homo sapiens; identical to SEQ ID NO: 85
  misc_feature 1..141: note = chr1:110611653-110611794
  misc_feature 1..141: note = hyper
  source 1..141: mol_type = genomic DNA

SEQ ID NO: 5671 - skipped

SEQ ID NO: 5672 - DNA, 128 bp, Homo sapiens; identical to SEQ ID NO: 1790
  misc_feature 1..128: note = chr1:110626790-110626918
  misc_feature 1..128: note = hyper
  source 1..128: mol_type = genomic DNA

SEQ ID NO: 5673 - DNA, 480 bp, Homo sapiens; identical to SEQ ID NO: 1791
  misc_feature 1..480: note = chr1:110627133-110627613
  misc_feature 1..480: note = hyper
  source 1..480: mol_type = genomic DNA

SEQ ID NO: 5674 - DNA, 193 bp, Homo sapiens
  misc_feature 1..193: note = chr1:110672889-110673082
  misc_feature 1..193: note = hyper
  source 1..193: mol_type = genomic DNA
tgtacatttccaggccgcagaccggagcctcccatccctttgggcctcttgggcggtccctacggccacctcccgcagctccctgggggcgggggaccgctggatgagggaggaggggaggtactggggggaaagggcggttggcgggaaggaagtccaggtgagacaggcccgcgttgggactatcgtgcgc

SEQ ID NO: 5675 - DNA, 204 bp, Homo sapiens
  misc_feature 1..204: note = chr1:110673083-110673287
  misc_feature 1..204: note = hyper
  source 1..204: mol_type = genomic DNA
gtatgtcggccggcaggtggggctggtccgggcgcaggaggcggtagagcaggagcagcagggggagccaggctggccgagctggggggtgagcacgtttgtctcaggcagctcatcgcctgacacccccgggaacgggctctgccccaaggcctaaaatgagggaagatgaggaaatgggggtggggacgatggagaggatgg

SEQ ID NO: 5676 - DNA, 595 bp, Homo sapiens; identical to SEQ ID NO: 86
  misc_feature 1..595: note = chr1:110692902-110693497
  misc_feature 1..595: note = hyper
  source 1..595: mol_type = genomic DNA

SEQ ID NO: 5677 - DNA, 433 bp, Homo sapiens; identical to SEQ ID NO: 87
  misc_feature 1..433: note = chr1:110693736-110694169
  misc_feature 1..433: note = hyper
  source 1..433: mol_type = genomic DNA

SEQ ID NO: 5678 - DNA, 295 bp, Homo sapiens; identical to SEQ ID NO: 1794
  misc_feature 1..295: note = chr1:111097952-111098247
  misc_feature 1..295: note = hyper
  source 1..295: mol_type = genomic DNA

SEQ ID NO: 5679 - DNA, 51 bp, Homo sapiens
  misc_feature 1..51: note = chr1:111149588-111149639
  misc_feature 1..51: note = hyper
  source 1..51: mol_type = genomic DNA
ccaccagctcctctccgtgccctccgccccgcgccacgcaaaccccagagg

SEQ ID NO: 5680 - DNA, 239 bp, Homo sapiens; identical to SEQ ID NO: 88
  misc_feature 1..239: note = chr1:111216734-111216973
  misc_feature 1..239: note = hyper
  source 1..239: mol_type = genomic DNA

SEQ ID NO: 5681 - DNA, 381 bp, Homo sapiens; identical to SEQ ID NO: 89
  misc_feature 1..381: note = chr1:111217194-111217575
  misc_feature 1..381: note = hyper
  source 1..381: mol_type = genomic DNA

SEQ ID NO: 5682 - DNA, 136 bp, Homo sapiens; identical to SEQ ID NO: 90
  misc_feature 1..136: note = chr1:111217576-111217712
  misc_feature 1..136: note = hyper
  source 1..136: mol_type = genomic DNA

SEQ ID NO: 5683 - DNA, 179 bp, Homo sapiens; identical to SEQ ID NO: 91
  misc_feature 1..179: note = chr1:111217713-111217892
  misc_feature 1..179: note = hyper
  source 1..179: mol_type = genomic DNA

SEQ ID NO: 5684 - DNA, 93 bp, Homo sapiens; identical to SEQ ID NO: 92
  misc_feature 1..93: note = chr1:111217923-111218016
  misc_feature 1..93: note = hyper
  source 1..93: mol_type = genomic DNA

SEQ ID NO: 5685 - DNA, 162 bp, Homo sapiens
  misc_feature 1..162: note = chr1:111506146-111506308
  misc_feature 1..162: note = hyper
  source 1..162: mol_type = genomic DNA
ctctcaactacacagcgtccggaaacgacggccgactccacatccctaagacggacagaggggcagccgtggggaggattcgaaaccggtacttaccaacgcgaggcgttgcctgaattttcctctgcgggtttcaggaagaccctccgtaggttatttgac

SEQ ID NO: 5686 - DNA, 18 bp, Homo sapiens
  misc_feature 1..18: note = chr1:112283344-112283362
  misc_feature 1..18: note = hyper
  source 1..18: mol_type = genomic DNA
agcactttgagaggccga

SEQ ID NO: 5687 - DNA, 36 bp, Homo sapiens
  misc_feature 1..36: note = chr1:112531573-112531609
  misc_feature 1..36: note = hyper
  source 1..36: mol_type = genomic DNA
ttcgatccctctccccggggccgcgacggcccttgg

SEQ ID NO: 5688 - DNA, 366 bp, Homo sapiens; identical to SEQ ID NO: 1800
  misc_feature 1..366: note = chr1:114695329-114695695
  misc_feature 1..366: note = hyper
  source 1..366: mol_type = genomic DNA

SEQ ID NO: 5689 - DNA, 41 bp, Homo sapiens; identical to SEQ ID NO: 1801
  misc_feature 1..41: note = chr1:114695696-114695737
  misc_feature 1..41: note = hyper
  source 1..41: mol_type = genomic DNA

SEQ ID NO: 5690 - DNA, 310 bp, Homo sapiens; identical to SEQ ID NO: 1802
  misc_feature 1..310: note = chr1:114695799-114696109
  misc_feature 1..310: note = hyper
  source 1..310: mol_type = genomic DNA

SEQ ID NO: 5691 - DNA, 44 bp, Homo sapiens
  misc_feature 1..44: note = chr1:114696420-114696464
  misc_feature 1..44: note = hyper
  source 1..44: mol_type = genomic DNA
agcagctcgaacccgcgccccggccgcactggggcggggcacga

SEQ ID NO: 5692 - DNA, 172 bp, Homo sapiens
  misc_feature 1..172: note = chr1:114696540-114696712
  misc_feature 1..172: note = hyper
  source 1..172: mol_type = genomic DNA
cgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccg

SEQ ID NO: 5693 - DNA, 79 bp, Homo sapiens
  misc_feature 1..79: note = chr1:115880128-115880207
  misc_feature 1..79: note = hyper
  source 1..79: mol_type = genomic DNA
agggctgaaccttggcgacctctacctgaggttgtccaacgcggctccgtggagggccccggtacgccggacggacccc

SEQ ID NO: 5694 - DNA, 194 bp, Homo sapiens
  misc_feature 1..194: note = chr1:115880208-115880402
  misc_feature 1..194: note = hyper
  source 1..194: mol_type = genomic DNA
gcgttggctcgcagacttcctgcgttaacccccggggccctcagtcacgactcccagcccttccgagacgcgctgagggaactgccccaggtctagcgcgccccgttccgctcctccccctacctgggggccgcgcagcactttccctactcggcgctcacctcagccagcgcgctctgcgctccccccgcggt

SEQ ID NO: 5695 - DNA, 117 bp, Homo sapiens
  misc_feature 1..117: note = chr1:115880678-115880795
  misc_feature 1..117: note = hyper
  source 1..117: mol_type = genomic DNA
ctgctcttcggcctgcgggagcctcgggggtaaccagagagctcgccagaccggtatccttgcaaactctcccgcgaagcccagccacccctgcccgcgcccgcgctgcgcccctct

SEQ ID NO: 5696 - DNA, 138 bp, Homo sapiens; identical to SEQ ID NO: 1803
  misc_feature 1..138: note = chr1:116371049-116371187
  misc_feature 1..138: note = hyper
  source 1..138: mol_type = genomic DNA

SEQ ID NO: 5697 - DNA, 13 bp, Homo sapiens
  misc_feature 1..13: note = chr1:116371188-116371201
  misc_feature 1..13: note = hyper
  source 1..13: mol_type = genomic DNA
tcagtcaattcag

SEQ ID NO: 5698 - DNA, 93 bp, Homo sapiens
  misc_feature 1..93: note = chr1:116371436-116371529
  misc_feature 1..93: note = hyper
  source 1..93: mol_type = genomic DNA
agaggaggtgacagacgggcctgtaatttggttccattcgctcgactggagcaacacctgcccccctcccctgggacgcgagggtctcatccc

SEQ ID NO: 5699 - DNA, 70 bp, Homo sapiens
  misc_feature 1..70: note = chr1:116380312-116380382
  misc_feature 1..70: note = hyper
  source 1..70: mol_type = genomic DNA
tctcgggtgtctccacgaggttctcctggcctggaaaatcccccctgcgagcccccgggctcgccagaca

SEQ ID NO: 5700 - DNA, 60 bp, Homo sapiens
  misc_feature 1..60: note = chr1:116380815-116380875
  misc_feature 1..60: note = hyper
  source 1..60: mol_type = genomic DNA
ggtgcgggtagagcgcggctcggctgccgcccttgccgtcgccctcggcctcctccaccg

SEQ ID NO: 5701 - DNA, 75 bp, Homo sapiens
  misc_feature 1..75: note = chr1:116381534-116381609
  misc_feature 1..75: note = hyper
  source 1..75: mol_type = genomic DNA
gggctgcgccgggggcgcctggctctggggtgcggccggtcaggaatccccatcctggagcgcaggcggagagcc

SEQ ID NO: 5702 - DNA, 35 bp, Homo sapiens
  misc_feature 1..35: note = chr1:116381836-116381871
  misc_feature 1..35: note = hyper
  source 1..35: mol_type = genomic DNA
gaaaatgccggcagccgggccgctgagggaggaga

SEQ ID NO: 5703 - DNA, 98 bp, Homo sapiens
  misc_feature 1..98: note = chr1:116382400-116382498
  misc_feature 1..98: note = hyper
  source 1..98: mol_type = genomic DNA
atcggttcccagcaccgcacttgcagaggagcgaattgggccaaaacagctttaatttccctgcgaggaaatcaggtcctctacggcaaaataaaaac

SEQ ID NO: 5704 - DNA, 180 bp, Homo sapiens
  misc_feature 1..180: note = chr1:116711112-116711292
  misc_feature 1..180: note = hyper
  source 1..180: mol_type = genomic DNA
aagggctcccacttgcgccccaagcgcatgcggagaaggttcggcagcgcctcctgccggccgcccggagggtccgcggtggcgccagccccgatcgcagccgcgcaggcccgagggcccctacccgcacggtgaattgtcttccacgcactagtattttctcctcgctttcaactgaat

SEQ ID NO: 5705 - DNA, 15 bp, Homo sapiens
  misc_feature 1..15: note = chr1:119521978-119521993
  misc_feature 1..15: note = hyper
  source 1..15: mol_type = genomic DNA
cgtcacgatcccaca

SEQ ID NO: 5706 - DNA, 15 bp, Homo sapiens
  misc_feature 1..15: note = chr1:119522839-119522854
  misc_feature 1..15: note = hyper
  source 1..15: mol_type = genomic DNA
ttcccggaccctatc

SEQ ID NO: 5707 - DNA, 15 bp, Homo sapiens
  misc_feature 1..15: note = chr1:119522925-119522940
  misc_feature 1..15: note = hyper
  source 1..15: mol_type = genomic DNA
cggttcatccagttg

SEQ ID NO: 5708 - DNA, 30 bp, Homo sapiens
  misc_feature 1..30: note = chr1:119528125-119528155
  misc_feature 1..30: note = hyper
  source 1..30: mol_type = genomic DNA
atcctatcagcaaatcgttaagaaaggctt

SEQ ID NO: 5709 - DNA, 465 bp, Homo sapiens
  misc_feature 1..465: note = chr1:119528653-119529118
  misc_feature 1..465: note = hyper
  source 1..465: mol_type = genomic DNA
aagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaat

SEQ ID NO: 5710 - DNA, 32 bp, Homo sapiens
  misc_feature 1..32: note = chr1:119529378-119529410
  misc_feature 1..32: note = hyper
  source 1..32: mol_type = genomic DNA
cgttgtatgtgcgcgcgcgcacactcaagatt

SEQ ID NO: 5711 - DNA, 144 bp, Homo sapiens; identical to SEQ ID NO: 1805
  misc_feature 1..144: note = chr1:119530005-119530149
  misc_feature 1..144: note = hyper
  source 1..144: mol_type = genomic DNA

SEQ ID NO: 5712 - DNA, 307 bp, Homo sapiens; identical to SEQ ID NO: 1806
  misc_feature 1..307: note = chr1:119530201-119530508
  misc_feature 1..307: note = hyper
  source 1..307: mol_type = genomic DNA

SEQ ID NO: 5713 - DNA, 47 bp, Homo sapiens; identical to SEQ ID NO: 1807
  misc_feature 1..47: note = chr1:119530553-119530600
  misc_feature 1..47: note = hyper
  source 1..47: mol_type = genomic DNA

SEQ ID NO: 5714 - DNA, 124 bp, Homo sapiens; identical to SEQ ID NO: 1808
  misc_feature 1..124: note = chr1:119530601-119530725
  misc_feature 1..124: note = hyper
  source 1..124: mol_type = genomic DNA

SEQ ID NO: 5715 - DNA, 93 bp, Homo sapiens; identical to SEQ ID NO: 1809
  misc_feature 1..93: note = chr1:119531021-119531114
  misc_feature 1..93: note = hyper
  source 1..93: mol_type = genomic DNA

SEQ ID NO: 5716 - DNA, 45 bp, Homo sapiens
  misc_feature 1..45: note = chr1:119535667-119535712
  misc_feature 1..45: note = hyper
  source 1..45: mol_type = genomic DNA
gccacccggtttcctcgccttcggccgccgcggtgtggccggcag

SEQ ID NO: 5717 - DNA, 487 bp, Homo sapiens; identical to SEQ ID NO: 1810
  misc_feature 1..487: note = chr1:119543532-119544019
  misc_feature 1..487: note = hyper
  source 1..487: mol_type = genomic DNA

SEQ ID NO: 5718 - DNA, 606 bp, Homo sapiens; identical to SEQ ID NO: 1811
  misc_feature 1..606: note = chr1:119549129-119549735
  misc_feature 1..606: note = hyper
  source 1..606: mol_type = genomic DNA

SEQ ID NO: 5719 - DNA, 15 bp, Homo sapiens
  misc_feature 1..15: note = chr1:119549914-119549929
  misc_feature 1..15: note = hyper
  source 1..15: mol_type = genomic DNA
cgtctaccccaaccc

SEQ ID NO: 5720 - DNA, 30 bp, Homo sapiens
  misc_feature 1..30: note = chr1:119550276-119550306
  misc_feature 1..30: note = hyper
  source 1..30: mol_type = genomic DNA
tgtcttgttctttgacggggtggccctgtg

SEQ ID NO: 5721 - DNA, 285 bp, Homo sapiens; identical to SEQ ID NO: 93
  misc_feature 1..285: note = chr1:119551013-119551298
  misc_feature 1..285: note = hyper
  source 1..285: mol_type = genomic DNA

SEQ ID NO: 5722 - DNA, 15 bp, Homo sapiens
  misc_feature 1..15: note = chr1:147775398-147775413
  misc_feature 1..15: note = hyper
  source 1..15: mol_type = genomic DNA
ggatgctgggtctga

SEQ ID NO: 5723 - DNA, 102 bp, Homo sapiens
  misc_feature 1..102: note = chr1:147775495-147775597
  misc_feature 1..102: note = hyper
  source 1..102: mol_type = genomic DNA
cggcaagatgtgcctctcaggttttccgaggctttggagcctgcacaattgttctacaaaaggcagtagctccgccgaacgttggatcgtcccttggtctgg

SEQ ID NO: 5724 - DNA, 76 bp, Homo sapiens
  misc_feature 1..76: note = chr1:150185869-150185945
  misc_feature 1..76: note = hyper
  source 1..76: mol_type = genomic DNA
ccagaggaagcaaagcggaagtaggatccaaaacgctttcagcaggccgcctgcgcccccgcgcatgcgcaggtct

SEQ ID NO: 5725 - DNA, 30 bp, Homo sapiens
  misc_feature 1..30: note = chr1:151689335-151689365
  misc_feature 1..30: note = hyper
  source 1..30: mol_type = genomic DNA
gtcagtctcaggggtcgaatacaaattctc

SEQ ID NO: 5726 - DNA, 337 bp, Homo sapiens; identical to SEQ ID NO: 1814
  misc_feature 1..337: note = chr1:151694069-151694406
  misc_feature 1..337: note = hyper
  source 1..337: mol_type = genomic DNA

SEQ ID NO: 5727 - DNA, 30 bp, Homo sapiens
  misc_feature 1..30: note = chr1:152083749-152083779
  misc_feature 1..30: note = hyper
  source 1..30: mol_type = genomic DNA
cttagttgctgctggcgcctctcctcctgc

SEQ ID NO: 5728 - DNA, 92 bp, Homo sapiens
  misc_feature 1..92: note = chr1:152084671-152084763
  misc_feature 1..92: note = hyper
  source 1..92: mol_type = genomic DNA
gcctcagctgctgctcgcgcctctcctcctgctgctcgcgcctctcctgctgctcgcgcctctcctcctgctgctcgcgcctctcctcctcc

SEQ ID NO: 5729 - DNA, 446 bp, Homo sapiens
  misc_feature 1..446: note = chr1:152085058-152085504
  misc_feature 1..446: note = hyper
  source 1..446: mol_type = genomic DNA
ttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgcttctcctcatccagtcccgtggcctggccgagagcatagtaacaagcttgagccactttgaaaataaataggaggaattcgttgaaatcgacacgcccattactgtca

SEQ ID NO: 5730 - DNA, 129 bp, Homo sapiens
  misc_feature 1..129: note = chr1:152487828-152487957
  misc_feature 1..129: note = hyper
  source 1..129: mol_type = genomic DNA
ttcttccaggtttgtcgtgaggagctccgcgatgtcctctcaacagagcgccgtttccgccaaaggcttttccaaggggtcgtcccagggccccgctccgtgtcccgccccggcgcccaccccggcgcc

SEQ ID NO: 5731 - DNA, 38 bp, Homo sapiens
  misc_feature 1..38: note = chr1:153438417-153438455
  misc_feature 1..38: note = hyper
  source 1..38: mol_type = genomic DNA
gccagagttgcgaggcggttccacgtggctgggccgtc

SEQ ID NO: 5732 - DNA, 297 bp, Homo sapiens; identical to SEQ ID NO: 1815
  misc_feature 1..297: note = chr1:153651898-153652195
  misc_feature 1..297: note = hyper
  source 1..297: mol_type = genomic DNA

SEQ ID NO: 5733 - DNA, 15 bp, Homo sapiens
  misc_feature 1..15: note = chr1:154474763-154474778
  misc_feature 1..15: note = hyper
  source 1..15: mol_type = genomic DNA
tgctctttcctcctg

SEQ ID NO: 5734 - DNA, 81 bp, Homo sapiens; identical to SEQ ID NO: 95
  misc_feature 1..81: note = chr1:154474987-154475068
  misc_feature 1..81: note = hyper
  source 1..81: mol_type = genomic DNA

SEQ ID NO: 5735 - DNA, 173 bp, Homo sapiens; identical to SEQ ID NO: 96
  misc_feature 1..173: note = chr1:154475371-154475544
  misc_feature 1..173: note = hyper
  source 1..173: mol_type = genomic DNA

SEQ ID NO: 5736 - DNA, 233 bp, Homo sapiens
  misc_feature 1..233: note = chr1:155043442-155043675
  misc_feature 1..233: note = hyper
  source 1..233: mol_type = genomic DNA
tttcgcagaaccaggcgggcgcgctcgctcccgcggctggggctggcgcgcggacgcgccgctgataacgcatgtgcgaaagagacgcggggcccagtcagctttctccgcactcagacgcacgccctaactgtcgggcgctcccacttgacacggacacacgcccctgccggccgcccagccccttgcaggtgcaagggcggatgcctcagcgaccacgggagccgggctgg

SEQ ID NO: 5737 - DNA, 372 bp, Homo sapiens
  misc_feature 1..372: note = chr1:156215329-156215701
  misc_feature 1..372: note = hyper
  source 1..372: mol_type = genomic DNA
agtagcaggagaggccggtgcacaggaaggagttgagtgcggcggcaggcacaaagaactggtgcaggtggccgtgcagccaggaggccggcatggagtaggcggcataggggaaggcgcagcctgcggtgaggtgggggcgtgcagctgaggcctgaggggcgcgcccctatgtcccgcgtcccacccctcgccccgctccgggacgcccagaccccgcgctcccgcgcctgtccggctcacccagactgtagaggctgagcgcgccgtagtcgaggaagtagcagatgtggcgcatgcggggcgacatggagctgaaggtgtgcgcgcagcacgacgcgaaggggtagaggcaggcgggcagcaggaaga

SEQ ID NO: 5738 - DNA, 662 bp, Homo sapiens; identical to SEQ ID NO: 97
  misc_feature 1..662: note = chr1:156357865-156358527
  misc_feature 1..662: note = hyper
  source 1..662: mol_type = genomic DNA

SEQ ID NO: 5739 - DNA, 714 bp, Homo sapiens; identical to SEQ ID NO: 98
  misc_feature 1..714: note = chr1:156390135-156390849
  misc_feature 1..714: note = hyper
  source 1..714: mol_type = genomic DNA

SEQ ID NO: 5740 - DNA, 59 bp, Homo sapiens
  misc_feature 1..59: note = chr1:156391157-156391216
  misc_feature 1..59: note = hyper
  source 1..59: mol_type = genomic DNA
ggttgtgaaaatggccgggggttcgaggcgagcggtgctctaggggtgggaaaggggtg

SEQ ID NO: 5741 - DNA, 91 bp, Homo sapiens
  misc_feature 1..91: note = chr1:156391242-156391333
  misc_feature 1..91: note = hyper
  source 1..91: mol_type = genomic DNA
cgaagagggtgggggctcggccggcccctcgtggcggacgcgcgggcacgccggattccgaggcgctcgcccacctcgtgctccacgctgg

SEQ ID NO: 5742 - DNA, 48 bp, Homo sapiens; identical to SEQ ID NO: 1821
  misc_feature 1..48: note = chr1:156405367-156405415
  misc_feature 1..48: note = hyper
  source 1..48: mol_type = genomic DNA

SEQ ID NO: 5743 - DNA, 437 bp, Homo sapiens; identical to SEQ ID NO: 1822
  misc_feature 1..437: note = chr1:156405634-156406071
  misc_feature 1..437: note = hyper
  source 1..437: mol_type = genomic DNA

SEQ ID NO: 5744 - DNA, 327 bp, Homo sapiens; identical to SEQ ID NO: 1823
  misc_feature 1..327: note = chr1:156406104-156406431
  misc_feature 1..327: note = hyper
  source 1..327: mol_type = genomic DNA

SEQ ID NO: 5745 - DNA, 30 bp, Homo sapiens
  misc_feature 1..30: note = chr1:156468873-156468903
  misc_feature 1..30: note = hyper
  source 1..30: mol_type = genomic DNA
tggacagctcccaaacgccaaaacacccaa

SEQ ID NO: 5746 - DNA, 170 bp, Homo sapiens
  misc_feature 1..170: note = chr1:156594433-156594603
  misc_feature 1..170: note = hyper
  source 1..170: mol_type = genomic DNA
ctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtctt

SEQ ID NO: 5747 - DNA, 130 bp, Homo sapiens
  misc_feature 1..130: note = chr1:156594923-156595053
  misc_feature 1..130: note = hyper
  source 1..130: mol_type = genomic DNA
gctgtctgaagcccacgcggcgtgccggcgacgcggcgccgtggtggccaaggttgggcacctctacgccgcctggaagttttcggggctagaccagtgcgacggcggctggctggctgacggcagtgtg

SEQ ID NO: 5748 - DNA, 104 bp, Homo sapiens
  misc_feature 1..104: note = chr1:156595080-156595184
  misc_feature 1..104: note = hyper
  source 1..104: mol_type = genomic DNA
cgctgcggggggctcccggatcccggagtgcgcagtttcggcttccccaggccccaacaggcagcctatgggacctactgctacgccgagaattaggcgcccac

SEQ ID NO: 5749 - DNA, 169 bp, Homo sapiens
  misc_feature 1..169: note = chr1:156611775-156611944
  misc_feature 1..169: note = hyper
  source 1..169: mol_type = genomic DNA
gaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctca

SEQ ID NO: 5750 - DNA, 118 bp, Homo sapiens
  misc_feature 1..118: note = chr1:156611993-156612111
  misc_feature 1..118: note = hyper
  source 1..118: mol_type = genomic DNA
cgtgcacccggaggagacccccggaggaggcgacaaacttcgcagtgccgcgacccaaccccagccctgggtaggtgagtgcctccgcagccccgccgcccgccgtggggtcggggac

SEQ ID NO: 5751 - DNA, 30 bp, Homo sapiens
  misc_feature 1..30: note = chr1:156626475-156626505
  misc_feature 1..30: note = hyper
  source 1..30: mol_type = genomic DNA
gatggagacccaggccggaactccatccct

SEQ ID NO: 5752 - DNA, 169 bp, Homo sapiens
  misc_feature 1..169: note = chr1:156626850-156627019
  misc_feature 1..169: note = hyper
  source 1..169: mol_type = genomic DNA
cagcatcagcacacccgaggaacaggacttcatcaacagtgggctgggagacagggcgggaggggcccctgccatatgctctcactctctctcactcgcctaaccgccttcctcattaacccatgcacttattccttggttttctcaagcgtgcattccctcactcatt

SEQ ID NO: 5753 - DNA, 39 bp, Homo sapiens
  misc_feature 1..39: note = chr1:156646736-156646775
  misc_feature 1..39: note = hyper
  source 1..39: mol_type = genomic DNA
tccgtcgtccgctcccgggccagccgcagctgctggcat

SEQ ID NO: 5754 - DNA, 20 bp, Homo sapiens
  misc_feature 1..20: note = chr1:156814933-156814953
  misc_feature 1..20: note = hyper
  source 1..20: mol_type = genomic DNA
tgcaggcatggatgtcgatc

SEQ ID NO: 5755 - DNA, 210 bp, Homo sapiens; identical to SEQ ID NO: 1825
  misc_feature 1..210: note = chr1:156815030-156815240
  misc_feature 1..210: note = hyper
  source 1..210: mol_type = genomic DNA

SEQ ID NO: 5756 - DNA, 107 bp, Homo sapiens
  misc_feature 1..107: note = chr1:156815635-156815742
  misc_feature 1..107: note = hyper
  source 1..107: mol_type = genomic DNA
gacaggcggtctacccgcctctgatcccccccacctgccggggccctgcgcctccatctccccttccccacccgccccgcggccggcctgcgcgtcgtccctgcgca

SEQ ID NO: 5757 - DNA, 422 bp, Homo sapiens
  misc_feature 1..422: note = chr1:156818607-156819029
  misc_feature 1..422: note = hyper
  source 1..422: mol_type = genomic DNA
gggtcttcatagcctcgctgagctccgccctcacctgcctgtggtcccgaagaaattggcctcgtccggtcccgcccccgctccggccccgcccccggcactcacgactccttgtagtacacgatgaagctgagcaggtcgcgggcctccagtggctcatagcgctcccagcgtagcaggatgcggtctgcctccgtcacgttggacacgaagcgcagggtgcgagtctggcctgggtggggcgaggggcctgctcgcaaccgcgcctgccagctgcttgagcgcccaccctgaccccgcggcatcccattcccagtgagacctctgaggagaacttctcagagtgtccccctcgagctttctccctcccccgggtgtgcgtgtctagtgtgtggccgcgtgtccaccggcactggggttgg

SEQ ID NO: 5758 - DNA, 425 bp, Homo sapiens; identical to SEQ ID NO: 99
  misc_feature 1..425: note = chr1:156863061-156863486
  misc_feature 1..425: note = hyper
  source 1..425: mol_type = genomic DNA

SEQ ID NO: 5759 - DNA, 69 bp, Homo sapiens; identical to SEQ ID NO: 100
  misc_feature 1..69: note = chr1:156863640-156863709
  misc_feature 1..69: note = hyper
  source 1..69: mol_type = genomic DNA

SEQ ID NO: 5760 - DNA, 17 bp, Homo sapiens
  misc_feature 1..17: note = chr1:156893962-156893979
  misc_feature 1..17: note = hyper
  source 1..17: mol_type = genomic DNA
ggccaaatggagggacg

SEQ ID NO: 5761 - DNA, 40 bp, Homo sapiens
  misc_feature 1..40: note = chr1:156894252-156894292
  misc_feature 1..40: note = hyper
  source 1..40: mol_type = genomic DNA
cctggagagcaaatacgtgttcttccggcccaccatccag

SEQ ID NO: 5762 - DNA, 54 bp, Homo sapiens
  misc_feature 1..54: note = chr1:157963737-157963791
  misc_feature 1..54: note = hyper
  source 1..54: mol_type = genomic DNA
tgtttcctctggctgcgcgggagaaccgagcaatggggccgcgagggctggagg

SEQ ID NO: 5763 - DNA, 401 bp, Homo sapiens
  misc_feature 1..401: note = chr1:158083182-158083583
  misc_feature 1..401: note = hyper
  source 1..401: mol_type = genomic DNA
ccttttgagattctccggacctgcgcgccgcccgctcggcagggggctcggcaggcgcgggcggcgggtgggggcgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccgagccctcccctgccctcctctgctcctccgtaactcctgagct

SEQ ID NO: 5764 - DNA, 44 bp, Homo sapiens; identical to SEQ ID NO: 1828
  misc_feature 1..44: note = chr1:158150605-158150649
  misc_feature 1..44: note = hyper
  source 1..44: mol_type = genomic DNA

SEQ ID NO: 5765 - DNA, 147 bp, Homo sapiens; identical to SEQ ID NO: 1829
  misc_feature 1..147: note = chr1:158150650-158150797
  misc_feature 1..147: note = hyper
  source 1..147: mol_type = genomic DNA

SEQ ID NO: 5766 - DNA, 104 bp, Homo sapiens; identical to SEQ ID NO: 1830
  misc_feature 1..104: note = chr1:158150798-158150902
  misc_feature 1..104: note = hyper
  source 1..104: mol_type = genomic DNA

SEQ ID NO: 5767 - DNA, 36 bp, Homo sapiens; identical to SEQ ID NO: 1831
  misc_feature 1..36: note = chr1:159158333-159158369
  misc_feature 1..36: note = hyper
  source 1..36: mol_type = genomic DNA

SEQ ID NO: 5768 - DNA, 40 bp, Homo sapiens; identical to SEQ ID NO: 1832
  misc_feature 1..40: note = chr1:159158471-159158511
  misc_feature 1..40: note = hyper
  source 1..40: mol_type = genomic DNA

SEQ ID NO: 5769 - DNA, 30 bp, Homo sapiens
  misc_feature 1..30: note = chr1:161068529-161068559
  misc_feature 1..30: note = hyper
  source 1..30: mol_type = genomic DNA
gtacgattgggagcccggggcagccccccg

SEQ ID NO: 5770 - DNA, 438 bp, Homo sapiens; identical to SEQ ID NO: 1833
  misc_feature 1..438: note = chr1:161275639-161276077
  misc_feature 1..438: note = hyper
  source 1..438: mol_type = genomic DNA

SEQ ID NO: 5771 - DNA, 49 bp, Homo sapiens
  misc_feature 1..49: note = chr1:161409851-161409900
  misc_feature 1..49: note = hyper
  source 1..49: mol_type = genomic DNA
acaccctccaaacaccgcaagcctccttccccggcgcacaggcacgcag

SEQ ID NO: 5772 - DNA, 152 bp, Homo sapiens
  misc_feature 1..152: note = chr1:161494827-161494979
  misc_feature 1..152: note = hyper
  source 1..152: mol_type = genomic DNA
gcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgag

SEQ ID NO: 5773 - DNA, 30 bp, Homo sapiens
  misc_feature 1..30: note = chr1:161591710-161591740
  misc_feature 1..30: note = hyper
  source 1..30: mol_type = genomic DNA
tgccttagtgctgtacgggtaattttgagg

SEQ ID NO: 5774 - DNA, 169 bp, Homo sapiens
  misc_feature 1..169: note = chr1:162792306-162792475
  misc_feature 1..169: note = hyper
  source 1..169: mol_type = genomic DNA
gcgctgggctgggcccgggaggctggcatccctgggtgctccggtgcggtactagggggcgacggctgagccgtgggtggagccgctgggtcagtctcggatagaaataaactgggaaactgctgtggtctctgttgcttgcgtgctcggttttcgtgcttatcacgct

SEQ ID NO: 5775 - DNA, 65 bp, Homo sapiens
  misc_feature 1..65: note = chr1:164290599-164290664
  misc_feature 1..65: note = hyper
  source 1..65: mol_type = genomic DNA
gccagctccgggggccgcgcttccagccacccgcagccggcggggcccgccgggcagcacgggaa

SEQ ID NO: 5776 - DNA, 30 bp, Homo sapiens
  misc_feature 1..30: note = chr1:165204427-165204457
  misc_feature 1..30: note = hyper
  source 1..30: mol_type = genomic DNA
agtacccagaagacccgggagctaggacca

SEQ ID NO: 5777 - DNA, 58 bp, Homo sapiens
  misc_feature 1..58: note = chr1:165204838-165204896
  misc_feature 1..58: note = hyper
  source 1..58: mol_type = genomic DNA
gacgtcacctgggaacgcgcggcggcgcggggcggcgcggacccgggacgacctcgcc

SEQ ID NO: 5778 - DNA, 30 bp, Homo sapiens
  misc_feature 1..30: note = chr1:165321661-165321691
  misc_feature 1..30: note = hyper
  source 1..30: mol_type = genomic DNA
aaaagcccctgcatccgagggttctgcaga

SEQ ID NO: 5779 - DNA, 37 bp, Homo sapiens
  misc_feature 1..37: note = chr1:165324212-165324249
  misc_feature 1..37: note = hyper
  source 1..37: mol_type = genomic DNA
gcgcggtctaatccccgcgctgcgttgcctactggcc

SEQ ID NO: 5780 - DNA, 56 bp, Homo sapiens; identical to SEQ ID NO: 1834
  misc_feature 1..56: note = chr1:165324488-165324544
  misc_feature 1..56: note = hyper
  source 1..56: mol_type = genomic DNA

SEQ ID NO: 5781 - DNA, 66 bp, Homo sapiens
  misc_feature 1..66: note = chr1:165324832-165324898
  misc_feature 1..66: note = hyper
  source 1..66: mol_type = genomic DNA
aaacgatgcgtctgacgtccgtgcccgctgggactcggcgccagcagccaccgcactcctgggaaa

SEQ ID NO: 5782 - DNA, 145 bp, Homo sapiens
  misc_feature 1..145: note = chr1:165325108-165325253
  misc_feature 1..145: note = hyper
  source 1..145: mol_type = genomic DNA
ccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgc

SEQ ID NO: 5783 - DNA, 489 bp, Homo sapiens; identical to SEQ ID NO: 1835
  misc_feature 1..489: note = chr1:165325716-165326205
  misc_feature 1..489: note = hyper
  source 1..489: mol_type = genomic DNA

SEQ ID NO: 5784 - DNA, 173 bp, Homo sapiens; identical to SEQ ID NO: 1836
  misc_feature 1..173: note = chr1:165326296-165326469
  misc_feature 1..173: note = hyper
  source 1..173: mol_type = genomic DNA

SEQ ID NO: 5785 - DNA, 39 bp, Homo sapiens
  misc_feature 1..39: note = chr1:165414376-165414415
  misc_feature 1..39: note = hyper
  source 1..39: mol_type = genomic DNA
cacgcataatgctgccgccgccgccgccgccgccgtcac

SEQ ID NO: 5786 - DNA, 39 bp, Homo sapiens
  misc_feature 1..39: note = chr1:166134243-166134282
  misc_feature 1..39: note = hyper
  source 1..39: mol_type = genomic DNA
taaatataaaagtcccggacgcgaccgcccgtagcctgc

SEQ ID NO: 5787 - DNA, 77 bp, Homo sapiens
  misc_feature 1..77: note = chr1:166134283-166134360
  misc_feature 1..77: note = hyper
  source 1..77: mol_type = genomic DNA
gcccctggcggttgaggagccgcggcgatccttggtcttcaccgcagcagccaagcccggcgcgcaccaaccggcgc

SEQ ID NO: 5788 - DNA, 243 bp, Homo sapiens
  misc_feature 1..243: note = chr1:166134648-166134891
  misc_feature 1..243: note = hyper
  source 1..243: mol_type = genomic DNA
ggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacgg

SEQ ID NO: 5789 - DNA, 645 bp, Homo sapiens
  misc_feature 1..645: note = chr1:166134933-166135578
  misc_feature 1..645: note = hyper
  source 1..645: mol_type = genomic DNA
cgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcg

SEQ ID NO: 5790 - DNA, 55 bp, Homo sapiens
  misc_feature 1..55: note = chr1:166916866-166916921
  misc_feature 1..55: note = hyper
  source 1..55: mol_type = genomic DNA
ggtgccacccactctcgcgcctgcccccagcccccgtttcctcccccgctcgggc

SEQ ID NO: 5791 - DNA, 14 bp, Homo sapiens
  misc_feature 1..14: note = chr1:166916936-166916950
  misc_feature 1..14: note = hyper
  source 1..14: mol_type = genomic DNA
cgactacaatgcag

SEQ ID NO: 5792 - DNA, 636 bp, Homo sapiens; identical to SEQ ID NO: 1837
  misc_feature 1..636: note = chr1:167599216-167599852
  misc_feature 1..636: note = hyper
  source 1..636: mol_type = genomic DNA

SEQ ID NO: 5793 - DNA, 278 bp, Homo sapiens; identical to SEQ ID NO: 101
  misc_feature 1..278: note = chr1:169396357-169396635
  misc_feature 1..278: note = hyper
  source 1..278: mol_type = genomic DNA

SEQ ID NO: 5794 - DNA, 53 bp, Homo sapiens; identical to SEQ ID NO: 102
  misc_feature 1..53: note = chr1:169396636-169396689
  misc_feature 1..53: note = hyper
  source 1..53: mol_type = genomic DNA

SEQ ID NO: 5795 - DNA, 193 bp, Homo sapiens; identical to SEQ ID NO: 103
  misc_feature 1..193: note = chr1:169396730-169396923
  misc_feature 1..193: note = hyper
  source 1..193: mol_type = genomic DNA

SEQ ID NO: 5796 - DNA, 144 bp, Homo sapiens; identical to SEQ ID NO: 104
  misc_feature 1..144: note = chr1:170630458-170630602
  misc_feature 1..144: note = hyper
  source 1..144: mol_type = genomic DNA

SEQ ID NO: 5797 - DNA, 207 bp, Homo sapiens; identical to SEQ ID NO: 105
  misc_feature 1..207: note = chr1:170630603-170630810
  misc_feature 1..207: note = hyper
  source 1..207: mol_type = genomic DNA

SEQ ID NO: 5798 - DNA, 30 bp, Homo sapiens
  misc_feature 1..30: note = chr1:170631084-170631114
  misc_feature 1..30: note = hyper
  source 1..30: mol_type = genomic DNA
ctcttgactataggacgaaaaaaaaaaaaa

SEQ ID NO: 5799 - DNA, 130 bp, Homo sapiens
  misc_feature 1..130: note = chr1:170631315-170631445
  misc_feature 1..130: note = hyper
  source 1..130: mol_type = genomic DNA
gtcaggttagggctccgcagacggacgacagaggattatccgtagacttagatgggggttcctccgcccctctctgtcctcctgccaccacagccaggctggacgcagaaccgcacggaagcctccccaa

SEQ ID NO: 5800 - DNA, 91 bp, Homo sapiens
  misc_feature 1..91: note = chr1:170633906-170633997
  misc_feature 1..91: note = hyper
  source 1..91: mol_type = genomic DNA
tcggttcatcccgcacgcggggcggcggggctgggctgggaaaaggtcttagcggggtgcaaactcagagagccagcgctgtttgggaaag

SEQ ID NO: 5801 - DNA, 30 bp, Homo sapiens
  misc_feature 1..30: note = chr1:170634253-170634283
  misc_feature 1..30: note = hyper
  source 1..30: mol_type = genomic DNA
tggcttgggaaaactcgggccaagcaaagg

SEQ ID NO: 5802 - DNA, 76 bp, Homo sapiens
  misc_feature 1..76: note = chr1:170640549-170640625
  misc_feature 1..76: note = hyper
  source 1..76: mol_type = genomic DNA
cccccaccccatcttcgcagttctcctctctgctgtagcgacgccaggcgctgctttccgccgggtaaattagcgg

SEQ ID NO: 5803 - DNA, 595 bp, Homo sapiens; identical to SEQ ID NO: 106
  misc_feature 1..595: note = chr1:171810200-171810795
  misc_feature 1..595: note = hyper
  source 1..595: mol_type = genomic DNA

SEQ ID NO: 5804 - DNA, 126 bp, Homo sapiens
  misc_feature 1..126: note = chr1:171811091-171811217
  misc_feature 1..126: note = hyper
  source 1..126: mol_type = genomic DNA
tggggggcagagtggcggtgtccgtggggcgggcggggtcctccagctctgggcatcctccgtcccctgccaccccccgcctggtggccctcctgcctgcctttcatcgtgcgatacaaagccatt

SEQ ID NO: 5805 - DNA, 267 bp, Homo sapiens
  misc_feature 1..267: note = chr1:173638672-173638939
  misc_feature 1..267: note = hyper
  source 1..267: mol_type = genomic DNA
tgatccaggaggtcccgcgagggggcaacggacacttcagggcaccagagtttgctcttcggcctgaattccctagggaccttctgcgatcccttgcggctgccggcggggtaggagaccggtgcgcaaagctctggacagaagcagtgtgaggacgctgagattgaagcccactcccctccagccctgcccgagcagcctggagggaagatgtccgtctaccccatcgcactcctccccaagtgcccaccccggcccacagcgcca

SEQ ID NO: 5806 - DNA, 30 bp, Homo sapiens
  misc_feature 1..30: note = chr1:177133445-177133475
  misc_feature 1..30: note = hyper
  source 1..30: mol_type = genomic DNA
agtgggtgtgtagagcgagctggagtgggg

SEQ ID NO: 5807 - DNA, 147 bp, Homo sapiens
  misc_feature 1..147: note = chr1:177133766-177133913
  misc_feature 1..147: note = hyper
  source 1..147: mol_type = genomic DNA
gcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttaggg

SEQ ID NO: 5808 - DNA, 376 bp, Homo sapiens; identical to SEQ ID NO: 1844
  misc_feature 1..376: note = chr1:177140304-177140680
  misc_feature 1..376: note = hyper
  source 1..376: mol_type = genomic DNA

SEQ ID NO: 5809 - DNA, 405 bp, Homo sapiens
  misc_feature 1..405: note = chr1:177150773-177151178
  misc_feature 1..405: note = hyper
  source 1..405: mol_type = genomic DNA
tgccaccccctcactcggtgttcagccatttatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggg

SEQ ID NO: 5810 - DNA, 291 bp, Homo sapiens
  misc_feature 1..291: note = chr1:179544800-179545091
  misc_feature 1..291: note = hyper
  source 1..291: mol_type = genomic DNA
cgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggc

SEQ ID NO: 5811 - DNA, 63 bp, Homo sapiens
  misc_feature 1..63: note = chr1:179545092-179545155
  misc_feature 1..63: note = hyper
  source 1..63: mol_type = genomic DNA
tgcccgggggaccctaaagaccgtcgggtgggggctgagggcgaggggcgggacaccggggcc

SEQ ID NO: 5812 - DNA, 30 bp, Homo sapiens
  misc_feature 1..30: note = chr1:179712006-179712036
  misc_feature 1..30: note = hyper
  source 1..30: mol_type = genomic DNA
ttccagggcacagtgcgggccggaaatagg

SEQ ID NO: 5813 - DNA, 102 bp, Homo sapiens
  misc_feature 1..102: note = chr1:179712632-179712734
  misc_feature 1..102: note = hyper
  source 1..102: mol_type = genomic DNA
gccgggctcgggctccgcgcggggatgtgtctggccaccgcgtactttcgagggcgcctcaacacccgggtaagcgcgccccggctgcctccctctgcccac

SEQ ID NO: 5814 - DNA, 145 bp, Homo sapiens
  misc_feature 1..145: note = chr1:179712830-179712975
  misc_feature 1..145: note = hyper
  source 1..145: mol_type = genomic DNA
cgactcgggggcatctccggcctcgtggccagaccgcgggtggcggtgctcgcgcctcggggccggacttgccgggtccctgcccccgggccgtgccgaaggcgctctactcagcgtgtctgcagcgacccgcttctctgcgctt

SEQ ID NO: 5815 - DNA, 300 bp, Homo sapiens
  misc_feature 1..300: note = chr1:180198156-180198456
  misc_feature 1..300: note = hyper
  source 1..300: mol_type = genomic DNA
gagcgcctgatggagcgtcagaggagacctcgtcccagcgttgggccttctgttgtatttctgccagaaactcgcgttgaggagaatttgttttaagcgtttctctacctgtccatgcatctcgtaaatacagtaagcatggcaagccctttcgctggttaaccccggcgtccgtgtgctcactgccgccctgcacgcacgaggtcgcggatggttcaaagcacccgcggtggcagccggagaggcagagcgggctctagggacctaagacagggccgagctggacgactggtggcaggg

SEQ ID NO: 5816 - DNA, 158 bp, Homo sapiens
  misc_feature 1..158: note = chr1:180202237-180202395
  misc_feature 1..158: note = hyper
  source 1..158: mol_type = genomic DNA
aaatccagcttatttcggcggcagctggactattcctttgcttatttggggatgggtgaggggcataccctttaggaaaacgtttccaaatgatgtaataatttctctctcatctctggtcttgctccagacttggcctcttcctcgccactctgtcc

SEQ ID NO: 5817 - DNA, 499 bp, Homo sapiens; identical to SEQ ID NO: 1845
  misc_feature 1..499: note = chr1:180202658-180203157
  misc_feature 1..499: note = hyper
  source 1..499: mol_type = genomic DNA

SEQ ID NO: 5818 - DNA, 243 bp, Homo sapiens; identical to SEQ ID NO: 1846
  misc_feature 1..243: note = chr1:180203365-180203608
  misc_feature 1..243: note = hyper
  source 1..243: mol_type = genomic DNA

SEQ ID NO: 5819 - DNA, 588 bp, Homo sapiens; identical to SEQ ID NO: 1847
  misc_feature 1..588: note = chr1:180203633-180204221
  misc_feature 1..588: note = hyper
  source 1..588: mol_type = genomic DNA

SEQ ID NO: 5820 - DNA, 398 bp, Homo sapiens; identical to SEQ ID NO: 1848
  misc_feature 1..398: note = chr1:180204222-180204620
  misc_feature 1..398: note = hyper
  source 1..398: mol_type = genomic DNA

SEQ ID NO: 5821 - DNA, 18 bp, Homo sapiens
  misc_feature 1..18: note = chr1:180204897-180204915
  misc_feature 1..18: note = hyper
  source 1..18: mol_type = genomic DNA
cgccggggaaggcgaggt

SEQ ID NO: 5822 - DNA, 30 bp, Homo sapiens
  misc_feature 1..30: note = chr1:180205341-180205371
  misc_feature 1..30: note = hyper
  source 1..30: mol_type = genomic DNA
tgggggtgggagagccgggaaaccagcaaa

SEQ ID NO: 5823 - DNA, 33 bp, Homo sapiens
  misc_feature 1..33: note = chr1:180206330-180206363
  misc_feature 1..33: note = hyper
  source 1..33: mol_type = genomic DNA
cacaggggttttactcggcggggggggcgggga

SEQ ID NO: 5824 - DNA, 118 bp, Homo sapiens
  misc_feature 1..118: note = chr1:180881433-180881551
  misc_feature 1..118: note = hyper
  source 1..118: mol_type = genomic DNA
ggcggcgggcaattccggcaccgcggcagacgggatgcgcggagcgcgttccctccgggtttccctcacgcctctggagagcgggaaccaacgaccttgacctcggaggaaacggctc

SEQ ID NO: 5825 - DNA, 30 bp, Homo sapiens
  misc_feature 1..30: note = chr1:180882303-180882333
  misc_feature 1..30: note = hyper
  source 1..30: mol_type = genomic DNA
ctggaagtccctccccgaacccagcagctg

SEQ ID NO: 5826 - DNA, 201 bp, Homo sapiens
  misc_feature 1..201: note = chr1:181287452-181287653
  misc_feature 1..201: note = hyper
  source 1..201: mol_type = genomic DNA
tgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggag

SEQ ID NO: 5827 - DNA, 64 bp, Homo sapiens; identical to SEQ ID NO: 1850
  misc_feature 1..64: note = chr1:181288138-181288202
  misc_feature 1..64: note = hyper
  source 1..64: mol_type = genomic DNA

SEQ ID NO: 5828 - DNA, 978 bp, Homo sapiens; identical to SEQ ID NO: 1851
  misc_feature 1..978: note = chr1:181451381-181452359
  misc_feature 1..978: note = hyper
  source 1..978: mol_type = genomic DNA

SEQ ID NO: 5829 - DNA, 276 bp, Homo sapiens
  misc_feature 1..276: note = chr1:181452691-181452967
  misc_feature 1..276: note = hyper
  source 1..276: mol_type = genomic DNA
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaaccccc

SEQ ID NO: 5830 - DNA, 34 bp, Homo sapiens
  misc_feature 1..34: note = chr1:181454728-181454762
  misc_feature 1..34: note = hyper
  source 1..34: mol_type = genomic DNA
ctagggtggaggtttcgggcgggggaggggtcgg

SEQ ID NO: 5831 - DNA, 297 bp, Homo sapiens
  misc_feature 1..297: note = chr1:181454977-181455274
  misc_feature 1..297: note = hyper
  source 1..297: mol_type = genomic DNA
cctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgtggtcaccttttttcacgttttctcttccgctgcaaagacaccgcctttccaccaggcgttgcgagcgcgcaaggtgcggctgtgagtctta

SEQ ID NO: 5832 - DNA, 196 bp, Homo sapiens
  misc_feature 1..196: note = chr1:183386107-183386303
  misc_feature 1..196: note = hyper
  source 1..196: mol_type = genomic DNA
tcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaag

SEQ ID NO: 5833 - DNA, 65 bp, Homo sapiens
  misc_feature 1..65: note = chr1:183386598-183386663
  misc_feature 1..65: note = hyper
  source 1..65: mol_type = genomic DNA
cggctccggctcgcgcagggcctcccgcagcctccgcccggccccctccccgtcctaggcagcgg

SEQ ID NO: 5834 - DNA, 334 bp, Homo sapiens; identical to SEQ ID NO: 1852
  misc_feature 1..334: note = chr1:183387266-183387600
  misc_feature 1..334: note = hyper
  source 1..334: mol_type = genomic DNA

SEQ ID NO: 5835 - DNA, 72 bp, Homo sapiens
  misc_feature 1..72: note = chr1:183774357-183774429
  misc_feature 1..72: note = hyper
  source 1..72: mol_type = genomic DNA
gcccagcagacattgcgttggcctccgagcagggcgcatcatgcagcgttcgcgcaccggagagaaaactga

SEQ ID NO: 5836 - DNA, 113 bp, Homo sapiens
  misc_feature 1..113: note = chr1:184005701-184005814
  misc_feature 1..113: note = hyper
  source 1..113: mol_type = genomic DNA
cctggagcaggagcccggcaccggaaagtcagagcagcgcactgcggcgccccagccactgcggagcccctggccaaccgcagttacgttccatctgtcgtatctacatggga

SEQ ID NO: 5837 - DNA, 39 bp, Homo sapiens
  misc_feature 1..39: note = chr1:184006034-184006073
  misc_feature 1..39: note = hyper
  source 1..39: mol_type = genomic DNA
cctccgcagcctgaccgcccgatccgccagccaccggcg

SEQ ID NO: 5838 - DNA, 138 bp, Homo sapiens
  misc_feature 1..138: note = chr1:184006332-184006470
  misc_feature 1..138: note = hyper
  source 1..138: mol_type = genomic DNA
ggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggt

SEQ ID NO: 5839 - DNA, 147 bp, Homo sapiens
  misc_feature 1..147: note = chr1:190444251-190444398
  misc_feature 1..147: note = hyper
  source 1..147: mol_type = genomic DNA
aaaggaaggagtgaccgtcagcaataatactttaacacagagcctaagaagtcattcaacagttctaaaccctacttcgcagtcagacaaggacagtgattagggttttataaagcaggcattctgaggaatcgtcgtttactaacg

SEQ ID NO: 5840 - DNA, 16 bp, Homo sapiens
  misc_feature 1..16: note = chr1:190445181-190445197
  misc_feature 1..16: note = hyper
  source 1..16: mol_type = genomic DNA
cacagtctcaaccccc

SEQ ID NO: 5841 - DNA, 23 bp, Homo sapiens
  misc_feature 1..23: note = chr1:190445198-190445221
  misc_feature 1..23: note = hyper
  source 1..23: mol_type = genomic DNA
ttccctctcggtgggagtcaagg

SEQ ID NO: 5842 - DNA, 71 bp, Homo sapiens
  misc_feature 1..71: note = chr1:190445481-190445552
  misc_feature 1..71: note = hyper
  source 1..71: mol_type = genomic DNA
tttgagggcggggggcggatgttcagagaaaaccctcagtgggtgttaaaaattaccgatacatgcaggtt

SEQ ID NO: 5843 - DNA, 326 bp, Homo sapiens
  misc_feature 1..326: note = chr1:190447388-190447714
  misc_feature 1..326: note = hyper
  source 1..326: mol_type = genomic DNA
cgagtcgctaggcgctttcgggggcgctgtgccggtgaggcttaggcaaggggacggggaaccgtggttagatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatctt

SEQ ID NO: 5844 - DNA, 84 bp, Homo sapiens
  misc_feature 1..84: note = chr1:196578066-196578150
  misc_feature 1..84: note = hyper
  source 1..84: mol_type = genomic DNA
agcatagcacagtgacggcacgggggtgccttggggacaaccaatgggggcgagctaattagcggattgcggggctccagaccc

SEQ ID NO: 5845 - DNA, 62 bp, Homo sapiens; identical to SEQ ID NO: 107
  misc_feature 1..62: note = chr1:197879599-197879661
  misc_feature 1..62: note = hyper
  source 1..62: mol_type = genomic DNA

SEQ ID NO: 5846 - DNA, 508 bp, Homo sapiens; identical to SEQ ID NO: 108
  misc_feature 1..508: note = chr1:197879716-197880224
  misc_feature 1..508: note = hyper
  source 1..508: mol_type = genomic DNA

SEQ ID NO: 5847 - DNA, 111 bp, Homo sapiens
  misc_feature 1..111: note = chr1:197880543-197880654
  misc_feature 1..111: note = hyper
  source 1..111: mol_type = genomic DNA
taacccctgcctgcccgggtccaagtgagggttttctcccggaaggttaatcaccacccccatcccctagccgggtcccgggaggaagagatgccccggctctctcgttga

SEQ ID NO: 5848 - DNA, 90 bp, Homo sapiens
  misc_feature 1..90: note = chr1:197881455-197881545
  misc_feature 1..90: note = hyper
  source 1..90: mol_type = genomic DNA
ttcttgggagcctaccggaggaaggcccggctttgctccaagccgcgtccctacctgaggtctccacgggaggagcggtttggacgcgcc

SEQ ID NO: 5849 - DNA, 68 bp, Homo sapiens
  misc_feature 1..68: note = chr1:197882140-197882208
  misc_feature 1..68: note = hyper
  source 1..68: mol_type = genomic DNA
tcagtcctaacccagcgcagccgtttctgcgcctgatctcagcggacgcagtgcgggacttctccctt

SEQ ID NO: 5850 - DNA, 60 bp, Homo sapiens
  misc_feature 1..60: note = chr1:197885234-197885294
  misc_feature 1..60: note = hyper
  source 1..60: mol_type = genomic DNA
ctctctgggtaaagccgcgttggttcctgccgcagcgctgtgcttcggactcctaggggg

SEQ ID NO: 5851 - DNA, 160 bp, Homo sapiens; identical to SEQ ID NO: 109
  misc_feature 1..160: note = chr1:197886907-197887067
  misc_feature 1..160: note = hyper
  source 1..160: mol_type = genomic DNA

SEQ ID NO: 5852 - DNA, 311 bp, Homo sapiens; identical to SEQ ID NO: 110
  misc_feature 1..311: note = chr1:197887146-197887457
  misc_feature 1..311: note = hyper
  source 1..311: mol_type = genomic DNA

SEQ ID NO: 5853 - DNA, 416 bp, Homo sapiens; identical to SEQ ID NO: 111
  misc_feature 1..416: note = chr1:197887706-197888122
  misc_feature 1..416: note = hyper
  source 1..416: mol_type = genomic DNA

SEQ ID NO: 5854 - DNA, 45 bp, Homo sapiens; identical to SEQ ID NO: 112
  misc_feature 1..45: note = chr1:197888180-197888225
  misc_feature 1..45: note = hyper
  source 1..45: mol_type = genomic DNA

SEQ ID NO: 5855 - DNA, 33 bp, Homo sapiens
  misc_feature 1..33: note = chr1:197888734-197888767
  misc_feature 1..33: note = hyper
  source 1..33: mol_type = genomic DNA
gttttattttgtgtgcgtcgaaaaccacaattt

SEQ ID NO: 5856 - DNA, 67 bp, Homo sapiens
  misc_feature 1..67: note = chr1:197889096-197889163
  misc_feature 1..67: note = hyper
  source 1..67: mol_type = genomic DNA
tgcagggcatgcccccgctcagcccggagaagcccgccctgtgcgccggctgcgggggcaagatctc

SEQ ID NO: 5857 - DNA, 81 bp, Homo sapiens
  misc_feature 1..81: note = chr1:197889549-197889630
  misc_feature 1..81: note = hyper
  source 1..81: mol_type = genomic DNA
tctcagcttggctggcggaacttggggaaatctggggaagagtaaatggacgtggtctccgtctaccgagacttgattggg

SEQ ID NO: 5858 - DNA, 55 bp, Homo sapiens
  misc_feature 1..55: note = chr1:197890716-197890771
  misc_feature 1..55: note = hyper
  source 1..55: mol_type = genomic DNA
accgtgcagaaagggcggccccggaagcggaagagcccagcgctgggagtggaca

SEQ ID NO: 5859 - DNA, 181 bp, Homo sapiens
  misc_feature 1..181: note = chr1:199998199-199998380
  misc_feature 1..181: note = hyper
  source 1..181: mol_type = genomic DNA
agcacacaaccatttcgcatctttttcgtcgggcagaaccgccgcggtgcgcaggcaaggagtccttcccggcagctccgcgcagctccggttccgcgtccggggccgcagctagagcgcgctcgggccggagacgcggactgcgcgcgcacgggggacgcgcgctcgggggctcgcgccc

SEQ ID NO: 5860 - DNA, 30 bp, Homo sapiens
  misc_feature 1..30: note = chr1:199998758-199998788
  misc_feature 1..30: note = hyper
  source 1..30: mol_type = genomic DNA
ctcccctggcctcagcgagactaccccaac

SEQ ID NO: 5861 - DNA, 299 bp, Homo sapiens; identical to SEQ ID NO: 113
  misc_feature 1..299: note = chr1:200009750-200010049
  misc_feature 1..299: note = hyper
  source 1..299: mol_type = genomic DNA

SEQ ID NO: 5862 - DNA, 361 bp, Homo sapiens; identical to SEQ ID NO: 1862
  misc_feature 1..361: note = chr1:200011323-200011684
  misc_feature 1..361: note = hyper
  source 1..361: mol_type = genomic DNA

SEQ ID NO: 5863 - DNA, 383 bp, Homo sapiens; identical to SEQ ID NO: 1863
  misc_feature 1..383: note = chr1:200011685-200012068
  misc_feature 1..383: note = hyper
  source 1..383: mol_type = genomic DNA

SEQ ID NO: 5864 - DNA, 42 bp, Homo sapiens
  misc_feature 1..42: note = chr1:201252751-201252793
  misc_feature 1..42: note = hyper
  source 1..42: mol_type = genomic DNA
gcccgcccgctgcaccgcacctcgcctcgcctctctgctctc

SEQ ID NO: 5865 - DNA, 22 bp, Homo sapiens
  misc_feature 1..22: note = chr1:201437642-201437664
  misc_feature 1..22: note = hyper
  source 1..22: mol_type = genomic DNA
tcttccagggggcagcggaagt

SEQ ID NO: 5866 - DNA, 105 bp, Homo sapiens
  misc_feature 1..105: note = chr1:201437682-201437787
  misc_feature 1..105: note = hyper
  source 1..105: mol_type = genomic DNA
cggtcaccagcgtgaagtagatgtggcgcccggtgctctccacgcactccacggccttgatgcgggcgaagctgagctccttgggccggccgcccgtgcccttgg

SEQ ID NO: 5867 - DNA, 42 bp, Homo sapiens
  misc_feature 1..42: note = chr1:202678998-202679040
  misc_feature 1..42: note = hyper
  source 1..42: mol_type = genomic DNA
gggggctgggctagacgcgagtgggttcgtcccagggaaagg

SEQ ID NO: 5868 - DNA, 68 bp, Homo sapiens
  misc_feature 1..68: note = chr1:202679353-202679421
  misc_feature 1..68: note = hyper
  source 1..68: mol_type = genomic DNA
ccgtgcccccaccggcgggggtatggacttaccggagagcgacccgaaggaggcgggagagatccggg

SEQ ID NO: 5869 - DNA, 33 bp, Homo sapiens
  misc_feature 1..33: note = chr1:202679642-202679675
  misc_feature 1..33: note = hyper
  source 1..33: mol_type = genomic DNA
ggggaggagaccaagcggcgtgggagggcgggg

SEQ ID NO: 5870 - DNA, 136 bp, Homo sapiens
  misc_feature 1..136: note = chr1:202996095-202996231
  misc_feature 1..136: note = hyper
  source 1..136: mol_type = genomic DNA
gagagtcagaaaaagcgcctctcggctccggggccaaccccactcctttggggacgcgattctgatgggctgaggtcttcgctcttcgcgggggtcttaatctttcccgagttgctcatagcacccctgttcctgt

SEQ ID NO: 5871 - DNA, 227 bp, Homo sapiens; identical to SEQ ID NO: 1864
  misc_feature 1..227: note = chr1:204653792-204654019
  misc_feature 1..227: note = hyper
  source 1..227: mol_type = genomic DNA

SEQ ID NO: 5872 - DNA, 104 bp, Homo sapiens
  misc_feature 1..104: note = chr1:204797791-204797895
  misc_feature 1..104: note = hyper
  source 1..104: mol_type = genomic DNA
gtctctgccctaatgcggcggctggcggcgagaggcgctgcaggggacgcgggggaagtggcggcgccggcagcggacagctcggacagcgcccagggccggag

SEQ ID NO: 5873 - DNA, 91 bp, Homo sapiens
  misc_feature 1..91: note = chr1:204798150-204798241
  misc_feature 1..91: note = hyper
  source 1..91: mol_type = genomic DNA
ctatctcgttggccgcgtcccctcccccttcccgcatcctcaaccctttccctttcctctctgtccccgcctcatccgtgagccctgcctg

SEQ ID NO: 5874 - DNA, 376 bp, Homo sapiens; identical to SEQ ID NO: 114
  misc_feature 1..376: note = chr1:205312536-205312912
  misc_feature 1..376: note = hyper
  source 1..376: mol_type = genomic DNA

SEQ ID NO: 5875 - DNA, 416 bp, Homo sapiens
  misc_feature 1..416: note = chr1:205399689-205400105
  misc_feature 1..416: note = hyper
  source 1..416: mol_type = genomic DNA
aaagccgcccatcaccgtggagaaccaggaatggcagaccacgcggacgccaacagtttacgcagctccccagctaggtgcaaagtggccaaaggaagagccggtcttccacacgcacacctccgcgcccacactgccccaggagcttcccactcagccgggggacccccaagcagccggcgaggcgcactgcgcacgcgcactcaggccgcggctccagccgccctccctccgcagtggggcgccccgcccccgcgccgctcagttttaaactcgcagcagacggaactcgacttaaaaataactattttgacagttcagatgtaaatatgtgagtgacgcgtggggctgtttttccttcacacttcccctcacccctcgctccctaccccagctcaattcggctgaggctgaga

SEQ ID NO: 5876 - DNA, 357 bp, Homo sapiens; identical to SEQ ID NO: 1866
  misc_feature 1..357: note = chr1:205424654-205425011
  misc_feature 1..357: note = hyper
  source 1..357: mol_type = genomic DNA

SEQ ID NO: 5877 - DNA, 407 bp, Homo sapiens; identical to SEQ ID NO: 115
  misc_feature 1..407: note = chr1:207669381-207669788
  misc_feature 1..407: note = hyper
  source 1..407: mol_type = genomic DNA

SEQ ID NO: 5878 - DNA, 232 bp, Homo sapiens; identical to SEQ ID NO: 116
  misc_feature 1..232: note = chr1:207669828-207670060
  misc_feature 1..232: note = hyper
  source 1..232: mol_type = genomic DNA

SEQ ID NO: 5879 - DNA, 224 bp, Homo sapiens; identical to SEQ ID NO: 1869
  misc_feature 1..224: note = chr1:208084174-208084398
  misc_feature 1..224: note = hyper
  source 1..224: mol_type = genomic DNA

SEQ ID NO: 5880 - DNA, 39 bp, Homo sapiens
  misc_feature 1..39: note = chr1:209381523-209381562
  misc_feature 1..39: note = hyper
  source 1..39: mol_type = genomic DNA
ccattgccctcagcccgcagttcacggccagccccagtg

SEQ ID NO: 5881 - DNA, 65 bp, Homo sapiens
  misc_feature 1..65: note = chr1:210111357-210111422
  misc_feature 1..65: note = hyper
  source 1..65: mol_type = genomic DNA
aggttggggtgggggcggggtggcgtcacgtgccagcggcggccccgggaaggttccatttcttc

SEQ ID NO: 5882 - DNA, 100 bp, Homo sapiens
  misc_feature 1..100: note = chr1:210111823-210111923
  misc_feature 1..100: note = hyper
  source 1..100: mol_type = genomic DNA
gctcgccccggccttcgtggttttgccggcctcccggcggccgcacgcggggcaaagcgggctggcgggcaggtacagcgtccgggccgccgcctcctgc

SEQ ID NO: 5883 - DNA, 31 bp, Homo sapiens
  misc_feature 1..31: note = chr1:210112036-210112067
  misc_feature 1..31: note = hyper
  source 1..31: mol_type = genomic DNA
cggcaaaccatccttccgcaatacccacctt

SEQ ID NO: 5884 - DNA, 30 bp, Homo sapiens
  misc_feature 1..30: note = chr1:211306755-211306785
  misc_feature 1..30: note = hyper
  source 1..30: mol_type = genomic DNA
ggacctggagttgcccgtctctactgctgg

SEQ ID NO: 5885 - DNA, 30 bp, Homo sapiens
  misc_feature 1..30: note = chr1:211307339-211307369
  misc_feature 1..30: note = hyper
  source 1..30: mol_type = genomic DNA
gcaggaaactggcctcggggcccgcacgca

SEQ ID NO: 5886 - DNA, 110 bp, Homo sapiens
  misc_feature 1..110: note = chr1:213124513-213124623
  misc_feature 1..110: note = hyper
  source 1..110: mol_type = genomic DNA
gcctttctaggtaatcgcagggctggaagcccgtcatcgattctcagggaggctgtcagcgtgcaggggggagcggggagtgtcgtggagacactccgggacccctcact

SEQ ID NO: 5887 - DNA, 317 bp, Homo sapiens
  misc_feature 1..317: note = chr1:213124668-213124985
  misc_feature 1..317: note = hyper
  source 1..317: mol_type = genomic DNA
cgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccac

SEQ ID NO: 5888 - DNA, 53 bp, Homo sapiens
  misc_feature 1..53: note = chr1:214155985-214156038
  misc_feature 1..53: note = hyper
  source 1..53: mol_type = genomic DNA
ttccatcccttcaaacgtgcacgcccctcccgcggtcccgggagggagtcccc

SEQ ID NO: 5889 - DNA, 239 bp, Homo sapiens; identical to SEQ ID NO: 1870
  misc_feature 1..239: note = chr1:214156419-214156658
  misc_feature 1..239: note = hyper
  source 1..239: mol_type = genomic DNA

SEQ ID NO: 5890 - DNA, 35 bp, Homo sapiens
  misc_feature 1..35: note = chr1:214156893-214156928
  misc_feature 1..35: note = hyper
  source 1..35: mol_type = genomic DNA
actccccttgagttgcggcccgagactgcctttgt

SEQ ID NO: 5891 - DNA, 84 bp, Homo sapiens; identical to SEQ ID NO: 1871
  misc_feature 1..84: note = chr1:214158827-214158911
  misc_feature 1..84: note = hyper
  source 1..84: mol_type = genomic DNA

SEQ ID NO: 5892 - DNA, 30 bp, Homo sapiens
  misc_feature 1..30: note = chr1:214160288-214160318
  misc_feature 1..30: note = hyper
  source 1..30: mol_type = genomic DNA
ttattttagagcctgcgatttatgcgtttg

SEQ ID NO: 5893 - DNA, 136 bp, Homo sapiens
  misc_feature 1..136: note = chr1:214162493-214162629
  misc_feature 1..136: note = hyper
  source 1..136: mol_type = genomic DNA
agggaggtgggggggcgctctgttactttcgtctcaaaacgctgtcgaagccgaattgtggaaatccggcttggaggggagcggtgatgggtcccgggaaacgcgcgcggcgcccctcttccgagctcctggaccc

SEQ ID NO: 5894 - DNA, 99 bp, Homo sapiens
  misc_feature 1..99: note = chr1:214360654-214360753
  misc_feature 1..99: note = hyper
  source 1..99: mol_type = genomic DNA
agctaattgcctaatcggagtggggagctggtgcccgctcgccgcggtcgcctcgcgggtcacagacaagagagcggcttgttttctctctgtcacatc

SEQ ID NO: 5895 - DNA, 105 bp, Homo sapiens
  misc_feature 1..105: note = chr1:214360754-214360859
  misc_feature 1..105: note = hyper
  source 1..105: mol_type = genomic DNA
tcgtcttgaaccgtgtggtctgttgcaggggaaggggccgagctggaggagcgagcgggcgggcggcgcttggcacatcccgaagaacgctgcctcggttgcctg

SEQ ID NO: 5896 - DNA, 96 bp, Homo sapiens
  misc_feature 1..96: note = chr1:214360926-214361022
  misc_feature 1..96: note = hyper
  source 1..96: mol_type = genomic DNA
cgcgctctgctcagctctacccggctccgctctcaggcgtgtgctcagaacacaccgagatcctttagaaataaatgtaatcgagactaatctgga

SEQ ID NO: 5897 - DNA, 41 bp, Homo sapiens
  misc_feature 1..41: note = chr1:214387716-214387757
  misc_feature 1..41: note = hyper
  source 1..41: mol_type = genomic DNA
gaactgccccagtggcgtctgcgaggcgtttcctctataaa

SEQ ID NO: 5898 - DNA, 810 bp, Homo sapiens; identical to SEQ ID NO: 117
  misc_feature 1..810: note = chr1:215255060-215255870
  misc_feature 1..810: note = hyper
  source 1..810: mol_type = genomic DNA

SEQ ID NO: 5899 - DNA, 315 bp, Homo sapiens
  misc_feature 1..315: note = chr1:215256457-215256772
  misc_feature 1..315: note = hyper
  source 1..315: mol_type = genomic DNA
gcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcagg

SEQ ID NO: 5900 - DNA, 42 bp, Homo sapiens
  misc_feature 1..42: note = chr1:216896512-216896554
  misc_feature 1..42: note = hyper
  source 1..42: mol_type = genomic DNA
aagatatagtctgtccgcccccacccccgcacccccacgacg

SEQ ID NO: 5901 - DNA, 87 bp, Homo sapiens
  misc_feature 1..87: note = chr1:216896887-216896974
  misc_feature 1..87: note = hyper
  source 1..87: mol_type = genomic DNA
caatcaggagggaggcgacgggaggctgcacggagcgagaggagccaggcaggtaggcagggtgcagagagccgaagggggctggaa

SEQ ID NO: 5902 - DNA, 504 bp, Homo sapiens; identical to SEQ ID NO: 1873
  misc_feature 1..504: note = chr1:217307502-217308006
  misc_feature 1..504: note = hyper
  source 1..504: mol_type = genomic DNA

SEQ ID NO: 5903 - DNA, 75 bp, Homo sapiens
  misc_feature 1..75: note = chr1:217308622-217308697
  misc_feature 1..75: note = hyper
  source 1..75: mol_type = genomic DNA
tttatgaaacacacacgcccaccccgcctcccacgtaaaggccagtcttgactcattttgcgcccagatgcaaac

SEQ ID NO: 5904 - DNA, 30 bp, Homo sapiens
  misc_feature 1..30: note = chr1:217309007-217309037
  misc_feature 1..30: note = hyper
  source 1..30: mol_type = genomic DNA
taccagagggtgtttcggggctccccacgg

SEQ ID NO: 5905 - DNA, 48 bp, Homo sapiens
  misc_feature 1..48: note = chr1:217309258-217309306
  misc_feature 1..48: note = hyper
  source 1..48: mol_type = genomic DNA
ccccttttctggggacgaccttactcccacccccgccccctttgcagt

SEQ ID NO: 5906 - DNA, 109 bp, Homo sapiens
  misc_feature 1..109: note = chr1:217311452-217311561
  misc_feature 1..109: note = hyper
  source 1..109: mol_type = genomic DNA
ggcagaaatgacagacgcacgaacagcgtctctgtggctgtctgcagcgcgaggttcacgtctattgttttatgcctccgggagagctaccccgcgtgatagatctttt

SEQ ID NO: 5907 - DNA, 66 bp, Homo sapiens
  misc_feature 1..66: note = chr1:217311944-217312010
  misc_feature 1..66: note = hyper
  source 1..66: mol_type = genomic DNA
gagaaaagaaaggagcgggaggaaggcacagtgggggcgggggacagtcgtcggacactagttaac

SEQ ID NO: 5908 - DNA, 18 bp, Homo sapiens
  misc_feature 1..18: note = chr1:217313025-217313043
  misc_feature 1..18: note = hyper
  source 1..18: mol_type = genomic DNA
cccctctgcaattgccgg

SEQ ID NO: 5909 - DNA, 679 bp, Homo sapiens
  misc_feature 1..679: note = chr1:217313068-217313747
  misc_feature 1..679: note = hyper
  source 1..679: mol_type = genomic DNA
gcagaggccggggacttcgggcgcttgctaggtcaccgcgccgggcgaccgccgctcgccggctatttaatatacatggggtgggaacggagcgaagcggatctccgagcctgcctgtcctgcagaaaaaaaaaatcaatttgctatttatttttgaaatatatagatttagggaatgttttttccagctcgacccccttcaagaatggcggcccacatttaattacgtcttttaatgacttttcccttatttgccatcgctattccacgttaagggcgggggcggggtggagtttctttggggggttttcaattctggtatcttcaaaaagatttgccttatgtgttaattgcatgctgttaagcacatctgggactgtgtgctgaccaactcagaccaacttttaattaacacattgacccggagaagaagcagccgcccagcctccccctctaaatatgtatattagccacgcggaggcggctcggcccgcgccgccagatgcaagcaaggaattgcctgcgtcgaggggcgggagggggtgcaaattgcaacggttctctctctttctgtgagcgttttttctcgcctcacctctaggaaaacaacaaagaaaaagagtaaatgaccggctcctgaatcaggcttcttacatcctttaggcgtgacttgacccca

SEQ ID NO: 5910 - DNA, 30 bp, Homo sapiens
  misc_feature 1..30: note = chr1:218337322-218337352
  misc_feature 1..30: note = hyper
  source 1..30: mol_type = genomic DNA
acttctaaaacatttcgtggaagagagtag

SEQ ID NO: 5911 - DNA, 30 bp, Homo sapiens
  misc_feature 1..30: note = chr1:218337823-218337853
  misc_feature 1..30: note = hyper
  source 1..30: mol_type = genomic DNA
ggtcatcagcaggaccgagaagactgggtg

SEQ ID NO: 5912 - DNA, 96 bp, Homo sapiens
  misc_feature 1..96: note = chr1:218338074-218338170
  misc_feature 1..96: note = hyper
  source 1..96: mol_type = genomic DNA
cgccggacccctccccgctgcccggggtgcggcggcttccctccgcccaaacggggggtgtctcctccatcacccctgccgcggcttcccagtcgg

SEQ ID NO: 5913 - DNA, 124 bp, Homo sapiens
  misc_feature 1..124: note = chr1:218520127-218520251
  misc_feature 1..124: note = hyper
  source 1..124: mol_type = genomic DNA
atggaccagttcatgcgcaagaggatcgaggcgatccgcgggcagatcctgagcaagctgaagctcaccagtcccccagaagactatcctgagcccgaggaagtccccccggaggtgatttcca

SEQ ID NO: 5914 - DNA, 94 bp, Homo sapiens; identical to SEQ ID NO: 1874
  misc_feature 1..94: note = chr1:220101117-220101211
  misc_feature 1..94: note = hyper
  source 1..94: mol_type = genomic DNA

SEQ ID NO: 5915 - DNA, 239 bp, Homo sapiens; identical to SEQ ID NO: 1875
  misc_feature 1..239: note = chr1:220101370-220101609
  misc_feature 1..239: note = hyper
  source 1..239: mol_type = genomic DNA

SEQ ID NO: 5916 - DNA, 83 bp, Homo sapiens
  misc_feature 1..83: note = chr1:220700814-220700897
  misc_feature 1..83: note = hyper
  source 1..83: mol_type = genomic DNA
gagggtgctgcagggcgcccagagcgagacgtcttccgccggccccattcccgaagaggccgcgccgtcgggggctgagaccc

SEQ ID NO: 5917 - DNA, 200 bp, Homo sapiens
  misc_feature 1..200: note = chr1:220702265-220702465
  misc_feature 1..200: note = hyper
  source 1..200: mol_type = genomic DNA
gatccccacttcacccgcgcttgggccgtcccccgtgcctcggcgcggccacccgcggcagggtctccacctggagcccggcgtgaccctcacccactgctcagccctattcttcattccaaccccatttcgcttgtttcccctcaagggtgagggtagggaaccgtaagtggcgccctctcgctcggaggtggtcctcc

SEQ ID NO: 5918 - DNA, 145 bp, Homo sapiens
  misc_feature 1..145: note = chr1:220921624-220921769
  misc_feature 1..145: note = hyper
  source 1..145: mol_type = genomic DNA
cgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaac

SEQ ID NO: 5919 - DNA, 694 bp, Homo sapiens
  misc_feature 1..694: note = chr1:221052025-221052719
  misc_feature 1..694: note = hyper
  source 1..694: mol_type = genomic DNA
ggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccg

SEQ ID NO: 5920 - DNA, 311 bp, Homo sapiens
  misc_feature 1..311: note = chr1:221053402-221053713
  misc_feature 1..311: note = hyper
  source 1..311: mol_type = genomic DNA
ggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagca

SEQ ID NO: 5921 - DNA, 30 bp, Homo sapiens
  misc_feature 1..30: note = chr1:221067646-221067676
  misc_feature 1..30: note = hyper
  source 1..30: mol_type = genomic DNA
gacctcggagagctgcgccgagcagggcgg

SEQ ID NO: 5922 - DNA, 121 bp, Homo sapiens
  misc_feature 1..121: note = chr1:223302777-223302898
  misc_feature 1..121: note = hyper
  source 1..121: mol_type = genomic DNA
ggaaggccctgctcccgaccgacccggagcgcgctgctgccctctaccggtcatccgtgcggccggacaccgtgtcaggcccgcgaggagggctctgccgcagtcccggggaacagcaccc

SEQ ID NO: 5923 - DNA, 73 bp, Homo sapiens
  misc_feature 1..73: note = chr1:223538158-223538231
  misc_feature 1..73: note = hyper
  source 1..73: mol_type = genomic DNA
agtctcttaatttcccgcgttaacccctccccgctcccatctccgccgaagctctgcgcgtccccagggagcc

SEQ ID NO: 5924 - DNA, 110 bp, Homo sapiens; identical to SEQ ID NO: 118
  misc_feature 1..110: note = chr1:223936643-223936753
  misc_feature 1..110: note = hyper
  source 1..110: mol_type = genomic DNA

SEQ ID NO: 5925 - DNA, 62 bp, Homo sapiens; identical to SEQ ID NO: 119
  misc_feature 1..62: note = chr1:223936995-223937057
  misc_feature 1..62: note = hyper
  source 1..62: mol_type = genomic DNA

SEQ ID NO: 5926 - DNA, 43 bp, Homo sapiens
  misc_feature 1..43: note = chr1:224528801-224528844
  misc_feature 1..43: note = hyper
  source 1..43: mol_type = genomic DNA
gctccacctcctccccgtgccctccccacgaggcctgggagcg

SEQ ID NO: 5927 - DNA, 30 bp, Homo sapiens
  misc_feature 1..30: note = chr1:224803373-224803403
  misc_feature 1..30: note = hyper
  source 1..30: mol_type = genomic DNA
ttgctgcctcttcagcgcagaatagcccac

SEQ ID NO: 5928 - DNA, 185 bp, Homo sapiens
  misc_feature 1..185: note = chr1:224804002-224804187
  misc_feature 1..185: note = hyper
  source 1..185: mol_type = genomic DNA
caccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggtt

SEQ ID NO: 5929 - DNA, 62 bp, Homo sapiens; identical to SEQ ID NO: 120
  misc_feature 1..62: note = chr1:224804625-224804687
  misc_feature 1..62: note = hyper
  source 1..62: mol_type = genomic DNA

SEQ ID NO: 5930 - DNA, 270 bp, Homo sapiens; identical to SEQ ID NO: 121
  misc_feature 1..270: note = chr1:224804846-224805116
  misc_feature 1..270: note = hyper
  source 1..270: mol_type = genomic DNA

SEQ ID NO: 5931 - DNA, 555 bp, Homo sapiens; identical to SEQ ID NO: 122
  misc_feature 1..555: note = chr1:224805197-224805752
  misc_feature 1..555: note = hyper
  source 1..555: mol_type = genomic DNA

SEQ ID NO: 5932 - DNA, 18 bp, Homo sapiens
  misc_feature 1..18: note = chr1:224805848-224805866
  misc_feature 1..18: note = hyper
  source 1..18: mol_type = genomic DNA
cgccggtcctctcaaaga

SEQ ID NO: 5933 - DNA, 100 bp, Homo sapiens
  misc_feature 1..100: note = chr1:225117280-225117380
  misc_feature 1..100: note = hyper
  source 1..100: mol_type = genomic DNA
ccctcctcacctgcccggcacccaggatcccttgcgccgcgttcgggaccccacccccattgtggcctcttcgccagggcgcaggcgtggctcttggtca

SEQ ID NO: 5934 - DNA, 41 bp, Homo sapiens
  misc_feature 1..41: note = chr1:226411183-226411224
  misc_feature 1..41: note = hyper
  source 1..41: mol_type = genomic DNA
ctccctcctgcatcccgcagccggcggaagcgattattccc

SEQ ID NO: 5935 - DNA, 195 bp, Homo sapiens
  misc_feature 1..195: note = chr1:226411246-226411441
  misc_feature 1..195: note = hyper
  source 1..195: mol_type = genomic DNA
cgggctcgcacccggaggagacacgggtctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgta

SEQ ID NO: 5936 - DNA, 147 bp, Homo sapiens
  misc_feature 1..147: note = chr1:226411796-226411943
  misc_feature 1..147: note = hyper
  source 1..147: mol_type = genomic DNA
aagtgcgcgctggagcggaggcgctgcggactctaggtctggactgcgggctcctgaggccacacccgggacgttgcaggcacggtgcttcccctgaggctctgcgtactagactgaaatagggggtgatatcggcacctgctgcat

SEQ ID NO: 5937 - DNA, 106 bp, Homo sapiens
  misc_feature 1..106: note = chr1:226737012-226737118
  misc_feature 1..106: note = hyper
  source 1..106: mol_type = genomic DNA
tctccgacccgcaggcggggccccaaagagccggaaactttgcggccaatgttggagcccgcagcggcggccggaatggctctgccggcttcggagtagggctccc

SEQ ID NO: 5938 - DNA, 644 bp, Homo sapiens
  misc_feature 1..644: note = chr1:226924900-226925544
  misc_feature 1..644: note = hyper
  source 1..644: mol_type = genomic DNA
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcg

SEQ ID NO: 5939 - DNA, 131 bp, Homo sapiens
  misc_feature 1..131: note = chr1:227730464-227730595
  misc_feature 1..131: note = hyper
  source 1..131: mol_type = genomic DNA
gcgaagctgcctccccgcggggggagcggaagtggcccagctgctcgagtgacttactagttaaaaagctggggttggagctgccacgcggggaagtgtggaggcctgcggggctccgcctagactttctg

SEQ ID NO: 5940 - DNA, 33 bp, Homo sapiens
  misc_feature 1..33: note = chr1:228074787-228074820
  misc_feature 1..33: note = hyper
  source 1..33: mol_type = genomic DNA
tgagaacattttttccgacgcagcccgcagcga

SEQ ID NO: 5941 - DNA, 87 bp, Homo sapiens
  misc_feature 1..87: note = chr1:228194270-228194357
  misc_feature 1..87: note = hyper
  source 1..87: mol_type = genomic DNA
gcaagagacggagctcgccacagaccaggagcgagagggggactgcgggtcccaccgtgagcgcagggcgcgcggggctggaaaccc

SEQ ID NO: 5942 - DNA, 1554 bp, Homo sapiens; identical to SEQ ID NO: 124
  misc_feature 1..1554: note = chr1:228194949-228196503
  misc_feature 1..1554: note = hyper
  source 1..1554: mol_type = genomic DNA

SEQ ID NO: 5943 - DNA, 71 bp, Homo sapiens
  misc_feature 1..71: note = chr1:228225753-228225824
  misc_feature 1..71: note = hyper
  source 1..71: mol_type = genomic DNA
ggtcagcacggcgcccggccgcgcgggccgcccggcggtgtcaggggccgtggccgcggtggggcgcgggc

SEQ ID NO: 5944 - DNA, 456 bp, Homo sapiens
  misc_feature 1..456: note = chr1:228463250-228463706
  misc_feature 1..456: note = hyper
  source 1..456: mol_type = genomic DNA
gcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacac

SEQ ID NO: 5945 - DNA, 63 bp, Homo sapiens
  misc_feature 1..63: note = chr1:228603691-228603754
  misc_feature 1..63: note = hyper
  source 1..63: mol_type = genomic DNA
tgcaatctcaacactcgcgaccccacgcagtggagatctacagactttcgcctacgccacggg

SEQ ID NO: 5946 - DNA, 186 bp, Homo sapiens
  misc_feature 1..186: note = chr1:228604123-228604309
  misc_feature 1..186: note = hyper
  source 1..186: mol_type = genomic DNA
ggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggt

SEQ ID NO: 5947 - DNA, 65 bp, Homo sapiens
  misc_feature 1..65: note = chr1:228604515-228604580
  misc_feature 1..65: note = hyper
  source 1..65: mol_type = genomic DNA
gtggaaggctctggacgagccggggacaggcgcagcgggtgctgactgggcggtggggaggatgt

SEQ ID NO: 5948 - DNA, 107 bp, Homo sapiens; identical to SEQ ID NO: 125
  misc_feature 1..107: note = chr1:228633813-228633920
  misc_feature 1..107: note = hyper
  source 1..107: mol_type = genomic DNA

SEQ ID NO: 5949 - DNA, 29 bp, Homo sapiens
  misc_feature 1..29: note = chr1:228633921-228633950
  misc_feature 1..29: note = hyper
  source 1..29: mol_type = genomic DNA
gcttctctgcagctgtacaccctgcactg

SEQ ID NO: 5950 - DNA, 157 bp, Homo sapiens; identical to SEQ ID NO: 127
  misc_feature 1..157: note = chr1:228633983-228634140
  misc_feature 1..157: note = hyper
  source 1..157: mol_type = genomic DNA

SEQ ID NO: 5951 - DNA, 152 bp, Homo sapiens
  misc_feature 1..152: note = chr1:228645092-228645244
  misc_feature 1..152: note = hyper
  source 1..152: mol_type = genomic DNA
ccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcct

SEQ ID NO: 5952 - DNA, 600 bp, Homo sapiens
  misc_feature 1..600: note = chr1:228645306-228645906
  misc_feature 1..600: note = hyper
  source 1..600: mol_type = genomic DNA
gccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaagg

SEQ ID NO: 5953 - DNA, 153 bp, Homo sapiens
  misc_feature 1..153: note = chr1:228646206-228646359
  misc_feature 1..153: note = hyper
  source 1..153: mol_type = genomic DNA
agtgaggcgttcctcggcgtcctgaacccaaaggctcttttcagagccacccacacgatcaagaaagggtttcgaacacggtgaagggttatgtaacctaatgtgtctccatgcaccctagcggttgccgggtgcggccgaatctgagccgtg

SEQ ID NO: 5954 - DNA, 74 bp, Homo sapiens
  misc_feature 1..74: note = chr1:228647217-228647291
  misc_feature 1..74: note = hyper
  source 1..74: mol_type = genomic DNA
caggatgtttgataccgaatcgaagcacggcgtcaaagcagcgtcctgcgcgggggagccggatgtaataagcg

SEQ ID NO: 5955 - DNA, 470 bp, Homo sapiens; identical to SEQ ID NO: 128
  misc_feature 1..470: note = chr1:228651432-228651902
  misc_feature 1..470: note = hyper
  source 1..470: mol_type = genomic DNA

SEQ ID NO: 5956 - DNA, 247 bp, Homo sapiens; identical to SEQ ID NO: 129
  misc_feature 1..247: note = chr1:228652206-228652453
  misc_feature 1..247: note = hyper
  source 1..247: mol_type = genomic DNA

SEQ ID NO: 5957 - DNA, 34 bp, Homo sapiens; identical to SEQ ID NO: 130
  misc_feature 1..34: note = chr1:228652508-228652542
  misc_feature 1..34: note = hyper
  source 1..34: mol_type = genomic DNA

SEQ ID NO: 5958 - DNA, 140 bp, Homo sapiens; identical to SEQ ID NO: 131
  misc_feature 1..140: note = chr1:229542813-229542953
  misc_feature 1..140: note = hyper
  source 1..140: mol_type = genomic DNA

SEQ ID NO: 5959 - DNA, 124 bp, Homo sapiens; identical to SEQ ID NO: 132
  misc_feature 1..124: note = chr1:229543220-229543344
  misc_feature 1..124: note = hyper
  source 1..124: mol_type = genomic DNA

SEQ ID NO: 5960 - DNA, 30 bp, Homo sapiens
  misc_feature 1..30: note = chr1:229566702-229566732
  misc_feature 1..30: note = hyper
  source 1..30: mol_type = genomic DNA
cagcggaggccgccccggcagtgctggcaa

SEQ ID NO: 5961 - DNA, 86 bp, Homo sapiens; identical to SEQ ID NO: 133
  misc_feature 1..86: note = chr1:229567191-229567277
  misc_feature 1..86: note = hyper
  source 1..86: mol_type = genomic DNA

SEQ ID NO: 5962 - DNA, 624 bp, Homo sapiens; identical to SEQ ID NO: 134
  misc_feature 1..624: note = chr1:229567369-229567993
  misc_feature 1..624: note = hyper
  source 1..624: mol_type = genomic DNA

SEQ ID NO: 5963 - DNA, 193 bp, Homo sapiens; identical to SEQ ID NO: 135
  misc_feature 1..193: note = chr1:229568157-229568350
  misc_feature 1..193: note = hyper
  source 1..193: mol_type = genomic DNA

SEQ ID NO: 5964 - DNA, 46 bp, Homo sapiens
  misc_feature 1..46: note = chr1:229570083-229570129
  misc_feature 1..46: note = hyper
  source 1..46: mol_type = genomic DNA
ttgcccctcctgacccgacccagttgcccgccggaggggatggggt

SEQ ID NO: 5965 - DNA, 33 bp, Homo sapiens
  misc_feature 1..33: note = chr1:229570479-229570512
  misc_feature 1..33: note = hyper
  source 1..33: mol_type = genomic DNA
caaaaagctgagccacgtcgaccccttccccca

SEQ ID NO: 5966 - DNA, 30 bp, Homo sapiens
  misc_feature 1..30: note = chr1:230561556-230561586
  misc_feature 1..30: note = hyper
  source 1..30: mol_type = genomic DNA
tgtccgggccggactcgccgaacacgtcgt

SEQ ID NO: 5967 - DNA, 15 bp, Homo sapiens
  misc_feature 1..15: note = chr1:231296817-231296832
  misc_feature 1..15: note = hyper
  source 1..15: mol_type = genomic DNA
cgctacgactccggt

SEQ ID NO: 5968 - DNA, 59 bp, Homo sapiens; identical to SEQ ID NO: 1894
  misc_feature 1..59: note = chr1:231297044-231297103
  misc_feature 1..59: note = hyper
  source 1..59: mol_type = genomic DNA

SEQ ID NO: 5969 - DNA, 29 bp, Homo sapiens
  misc_feature 1..29: note = chr1:231297104-231297133
  misc_feature 1..29: note = hyper
  source 1..29: mol_type = genomic DNA
cagctcgtggctggcgttggagaatgtgg

SEQ ID NO: 5970 - DNA, 364 bp, Homo sapiens
  misc_feature 1..364: note = chr1:231298191-231298555
  misc_feature 1..364: note = hyper
  source 1..364: mol_type = genomic DNA
agccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggac

SEQ ID NO: 5971 - DNA, 30 bp, Homo sapiens
  misc_feature 1..30: note = chr1:231299494-231299524
  misc_feature 1..30: note = hyper
  source 1..30: mol_type = genomic DNA
cgccgaggcagcctccgggcccactggcac

SEQ ID NO: 5972 - DNA, 36 bp, Homo sapiens
  misc_feature 1..36: note = chr1:234040283-234040319
  misc_feature 1..36: note = hyper
  source 1..36: mol_type = genomic DNA
agaagggtggaggagcgcgtccggtgccccaaggct

SEQ ID NO: 5973 - skipped

SEQ ID NO: 5974 - DNA, 213 bp, Homo sapiens; identical to SEQ ID NO: 1897
  misc_feature 1..213: note = chr1:234041148-234041361
  misc_feature 1..213: note = hyper
  source 1..213: mol_type = genomic DNA

SEQ ID NO: 5975 - DNA, 55 bp, Homo sapiens; identical to SEQ ID NO: 1898
  misc_feature 1..55: note = chr1:234041415-234041470
  misc_feature 1..55: note = hyper
  source 1..55: mol_type = genomic DNA

SEQ ID NO: 5976 - DNA, 68 bp, Homo sapiens
  misc_feature 1..68: note = chr1:234349983-234350051
  misc_feature 1..68: note = hyper
  source 1..68: mol_type = genomic DNA
aagtaggaggctgtgcgcgcgtgtgtgtggagtggctgcgcggccggggaggatgtgcgctgcagggc

SEQ ID NO: 5977 - DNA, 141 bp, Homo sapiens
  misc_feature 1..141: note = chr1:234350052-234350193
  misc_feature 1..141: note = hyper
  source 1..141: mol_type = genomic DNA
gccgccgcagtgagcaacgcggcaaccggagcccggcgggcagccggggaggccgggactgagaggggcgagccgctggtgctccccggcggcagagggccgcgtcggccacgggcccgggagagacgcgctccagccggc

SEQ ID NO: 5978 - DNA, 279 bp, Homo sapiens
  misc_feature 1..279: note = chr1:235812015-235812294
  misc_feature 1..279: note = hyper
  source 1..279: mol_type = genomic DNA
tccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggc

SEQ ID NO: 5979 - DNA, 47 bp, Homo sapiens
  misc_feature 1..47: note = chr1:235812947-235812994
  misc_feature 1..47: note = hyper
  source 1..47: mol_type = genomic DNA
gggcgcccacttacccggagcgggatcacgcgcgggcttcgtctgca

SEQ ID NO: 5980 - DNA, 130 bp, Homo sapiens; identical to SEQ ID NO: 1899
  misc_feature 1..130: note = chr1:235813667-235813797
  misc_feature 1..130: note = hyper
  source 1..130: mol_type = genomic DNA

SEQ ID NO: 5981 - DNA, 26 bp, Homo sapiens
  misc_feature 1..26: note = chr1:235814009-235814035
  misc_feature 1..26: note = hyper
  source 1..26: mol_type = genomic DNA
ggttctaggagcgactgctctccagg

SEQ ID NO: 5982 - DNA, 79 bp, Homo sapiens; identical to SEQ ID NO: 1901
  misc_feature 1..79: note = chr1:236227842-236227921
  misc_feature 1..79: note = hyper
  source 1..79: mol_type = genomic DNA

SEQ ID NO: 5983 - DNA, 187 bp, Homo sapiens; identical to SEQ ID NO: 1902
  misc_feature 1..187: note = chr1:236228021-236228208
  misc_feature 1..187: note = hyper
  source 1..187: mol_type = genomic DNA

SEQ ID NO: 5984 - DNA, 18 bp, Homo sapiens
  misc_feature 1..18: note = chr1:236228606-236228624
  misc_feature 1..18: note = hyper
  source 1..18: mol_type = genomic DNA
acctcccgccttgggcgc

SEQ ID NO: 5985 - DNA, 50 bp, Homo sapiens; identical to SEQ ID NO: 1904
  misc_feature 1..50: note = chr1:236228705-236228755
  misc_feature 1..50: note = hyper
  source 1..50: mol_type = genomic DNA

SEQ ID NO: 5986 - DNA, 31 bp, Homo sapiens
  misc_feature 1..31: note = chr1:236558486-236558517
  misc_feature 1..31: note = hyper
  source 1..31: mol_type = genomic DNA
ggccagtccttcgctcgcagtctgtcccggg

SEQ ID NO: 5987 - skipped

SEQ ID NO: 5988 - DNA, 42 bp, Homo sapiens
  misc_feature 1..42: note = chr1:236558782-236558824
  misc_feature 1..42: note = hyper
  source 1..42: mol_type = genomic DNA
ggaggagggcaggggcgcgcagagccacggtttgctccaggc

SEQ ID NO: 5989 - DNA, 80 bp, Homo sapiens
  misc_feature 1..80: note = chr1:236559127-236559207
  misc_feature 1..80: note = hyper
  source 1..80: mol_type = genomic DNA
ctcccagtccagccccgcgagcggctgctgaccgcccctcccgcgctcgccagggcccctgccccgcgtcagccaccgcg

SEQ ID NO: 5990 - DNA, 112 bp, Homo sapiens
  misc_feature 1..112: note = chr1:236559256-236559368
  misc_feature 1..112: note = hyper
  source 1..112: mol_type = genomic DNA
cgggatgccaggttgagacacgtcctgcaaacctctggcagaaatgggcgcaagggggtggatttcgttttcgcctcccgggctttttctttctccccgctcacatgccttc

SEQ ID NO: 5991 - DNA, 49 bp, Homo sapiens; identical to SEQ ID NO: 136
  misc_feature 1..49: note = chr1:236849457-236849506
  misc_feature 1..49: note = hyper
  source 1..49: mol_type = genomic DNA

SEQ ID NO: 5992 - DNA, 224 bp, Homo sapiens; identical to SEQ ID NO: 137
  misc_feature 1..224: note = chr1:237206511-237206735
  misc_feature 1..224: note = hyper
  source 1..224: mol_type = genomic DNA

SEQ ID NO: 5993 - DNA, 313 bp, Homo sapiens
  misc_feature 1..313: note = chr1:239550788-239551101
  misc_feature 1..313: note = hyper
  source 1..313: mol_type = genomic DNA
ggcactcaagtgccccgaaagggacgggaatcatgcgagcggtggccgggagagagtcggggacgtcccaccccgctctccctcgcttcgattctctcttcgccactgccggatctgaggctccaaagtgcccgagcatgaggagctactgggctccgggtgtgtttgtgagcgcactcgtgtgttgagcgtttgtctcccatctccccatttggtttcctgtcatttctaagaaggctaaagctggcacccgccaacctcgcagtggggccgcaagttcggattgcatttcagggggcgagaaggcaaattt

SEQ ID NO: 5994 - DNA, 52 bp, Homo sapiens
  misc_feature 1..52: note = chr1:240161034-240161086
  misc_feature 1..52: note = hyper
  source 1..52: mol_type = genomic DNA
cggccacaccctccccgcgacacccgcgatcgccccccaggactggcggccc

SEQ ID NO: 5995 - DNA, 259 bp, Homo sapiens
  misc_feature 1..259: note = chr1:240161122-240161381
  misc_feature 1..259: note = hyper
  source 1..259: mol_type = genomic DNA
cgtcctgctcaggcaattcctcccgcgcgccccgtcggggaccgggcggggacgggagaaggaaaagggcccctggctccgggaccagggctccggagggtgccgggcggggagcggaacagggaacgggctggtggcggccccaagcgggagggacggaccgacacgcggccccctggcggccttgcgactcgccgacctgcggaacctcgtcgccgccctcacagccccgcggccaccgccgacccgggccggtccc

SEQ ID NO: 5996 - DNA, 626 bp, Homo sapiens; identical to SEQ ID NO: 138
  misc_feature 1..626: note = chr1:240254860-240255486
  misc_feature 1..626: note = hyper
  source 1..626: mol_type = genomic DNA

SEQ ID NO: 5997 - DNA, 672 bp, Homo sapiens; identical to SEQ ID NO: 139
  misc_feature 1..672: note = chr1:240255487-240256159
  misc_feature 1..672: note = hyper
  source 1..672: mol_type = genomic DNA

SEQ ID NO: 5998 - DNA, 117 bp, Homo sapiens; identical to SEQ ID NO: 1909
  misc_feature 1..117: note = chr1:240256663-240256780
  misc_feature 1..117: note = hyper
  source 1..117: mol_type = genomic DNA

SEQ ID NO: 5999 - DNA, 26 bp, Homo sapiens
  misc_feature 1..26: note = chr1:240775287-240775313
  misc_feature 1..26: note = hyper
  source 1..26: mol_type = genomic DNA
ttggtctcccgccgccgctttcagtt

SEQ ID NO: 6000 - DNA, 77 bp, Homo sapiens
  misc_feature 1..77: note = chr1:240775378-240775455
  misc_feature 1..77: note = hyper
  source 1..77: mol_type = genomic DNA
cgagagcgcgccccgcgccgcgcggtcccaggctggctgctcctgcagatgtgaaaggagcccggagacttagctct

SEQ ID NO: 6001 - DNA, 57 bp, Homo sapiens
  misc_feature 1..57: note = chr1:241520455-241520512
  misc_feature 1..57: note = hyper
  source 1..57: mol_type = genomic DNA
ctccgcttcttctcccggggactgggaccagccgagcgcgcgcgggagtcgagacgc

SEQ ID NO: 6002 - DNA, 87 bp, Homo sapiens
  misc_feature 1..87: note = chr1:241587106-241587193
  misc_feature 1..87: note = hyper
  source 1..87: mol_type = genomic DNA
gcaggcagtcctgagcggccgctgccatcgcgccggctgcagcggaaaggtacaagcggtggcggcaggagccgctgtgggagcagc

SEQ ID NO: 6003 - DNA, 63 bp, Homo sapiens; identical to SEQ ID NO: 1910
  misc_feature 1..63: note = chr1:241587546-241587609
  misc_feature 1..63: note = hyper
  source 1..63: mol_type = genomic DNA

SEQ ID NO: 6004 - DNA, 268 bp, Homo sapiens; identical to SEQ ID NO: 1911
  misc_feature 1..268: note = chr1:241587610-241587878
  misc_feature 1..268: note = hyper
  source 1..268: mol_type = genomic DNA

SEQ ID NO: 6005 - DNA, 530 bp, Homo sapiens; identical to SEQ ID NO: 1912
  misc_feature 1..530: note = chr1:242686734-242687264
  misc_feature 1..530: note = hyper
  source 1..530: mol_type = genomic DNA

SEQ ID NO: 6006 - DNA, 114 bp, Homo sapiens; identical to SEQ ID NO: 1913
  misc_feature 1..114: note = chr1:242687574-242687688
  misc_feature 1..114: note = hyper
  source 1..114: mol_type = genomic DNA

SEQ ID NO: 6007 - DNA, 150 bp, Homo sapiens; identical to SEQ ID NO: 1914
  misc_feature 1..150: note = chr1:242688094-242688244
  misc_feature 1..150: note = hyper
  source 1..150: mol_type = genomic DNA

SEQ ID NO: 6008 - DNA, 119 bp, Homo sapiens; identical to SEQ ID NO: 1915
  misc_feature 1..119: note = chr1:242688277-242688396
  misc_feature 1..119: note = hyper
  source 1..119: mol_type = genomic DNA

SEQ ID NO: 6009 - DNA, 30 bp, Homo sapiens
  misc_feature 1..30: note = chr1:243053994-243054024
  misc_feature 1..30: note = hyper
  source 1..30: mol_type = genomic DNA
tgccgctgatgggggcgggcagggcggaat

SEQ ID NO: 6010 - DNA, 30 bp, Homo sapiens
  misc_feature 1..30: note = chr1:244014641-244014671
  misc_feature 1..30: note = hyper
  source 1..30: mol_type = genomic DNA
actttgggaaagccacgaggtactacattt

SEQ ID NO: 6011 - DNA, 325 bp, Homo sapiens
  misc_feature 1..325: note = chr1:244080470-244080795
  misc_feature 1..325: note = hyper
  source 1..325: mol_type = genomic DNA
aacagcagcctgatccgtcttgcttttcccttttctccatgcagccagcacttttccttctcactctccccgcacgcccacgcccacccgcttctgcaccgagaacctcgaggcgcgcacgcacgtggaggtgacgccaagcccagcggcgaggtcggggctgggggtggggggagccggcgtcccgcgggcccccgaggccggggagctccgccagcgcattgtgcgagcgagctgaatgcagccgaggggcgagcgcgcgggctcgcacggattagccgtgctttcccatgagccacaaaagaatgcccgaatctgggacatc

SEQ ID NO: 6012 - DNA, 44 bp, Homo sapiens
  misc_feature 1..44: note = chr1:244893555-244893599
  misc_feature 1..44: note = hyper
  source 1..44: mol_type = genomic DNA
gctgcgaggaggacgcggctcgtttagctcgctgcgaacctcaa

SEQ ID NO: 6013 - DNA, 32 bp, Homo sapiens
  misc_feature 1..32: note = chr1:247171029-247171061
  misc_feature 1..32: note = hyper
  source 1..32: mol_type = genomic DNA
cccggcccccacctgcgcgggacgggactgag

SEQ ID NO: 6014 - DNA, 52 bp, Homo sapiens
  misc_feature 1..52: note = chr1:247171365-247171417
  misc_feature 1..52: note = hyper
  source 1..52: mol_type = genomic DNA
ccagatccccaaggccgccccttcctctctggctgcacgcctgattggacag

SEQ ID NO: 6015 - DNA, 23 bp, Homo sapiens
  misc_feature 1..23: note = chr1:247274349-247274372
  misc_feature 1..23: note = hyper
  source 1..23: mol_type = genomic DNA
cggggccgcgagcaagcctccga

SEQ ID NO: 6016 - DNA, 116 bp, Homo sapiens; identical to SEQ ID NO: 140
  misc_feature 1..116: note = chr1:248020515-248020631
  misc_feature 1..116: note = hyper
  source 1..116: mol_type = genomic DNA

SEQ ID NO: 6017 - DNA, 341 bp, Homo sapiens; identical to SEQ ID NO: 141
  misc_feature 1..341: note = chr1:248020956-248021297
  misc_feature 1..341: note = hyper
  source 1..341: mol_type = genomic DNA

SEQ ID NO: 6018 - DNA, 30 bp, Homo sapiens
  misc_feature 1..30: note = chr2:287500-287530
  misc_feature 1..30: note = hyper
  source 1..30: mol_type = genomic DNA
tgtctctttttgaaacgtgtttctcaaaga

SEQ ID NO: 6019 - DNA, 127 bp, Homo sapiens; identical to SEQ ID NO: 1918
  misc_feature 1..127: note = chr2:288404-288531
  misc_feature 1..127: note = hyper
  source 1..127: mol_type = genomic DNA

SEQ ID NO: 6020 - DNA, 61 bp, Homo sapiens
  misc_feature 1..61: note = chr2:288738-288799
  misc_feature 1..61: note = hyper
  source 1..61: mol_type = genomic DNA
tatccccgcgcccgccgacgtcaggcgggtccccaagggctccgagcggggctttaattag

SEQ ID NO: 6021 - DNA, 30 bp, Homo sapiens
  misc_feature 1..30: note = chr2:289223-289253
  misc_feature 1..30: note = hyper
  source 1..30: mol_type = genomic DNA
caattagagtccatccgttttggagggatc

SEQ ID NO: 6022 - DNA, 235 bp, Homo sapiens
  misc_feature 1..235: note = chr2:290038-290273
  misc_feature 1..235: note = hyper
  source 1..235: mol_type = genomic DNA
agatatgaaatgtgccggttccggaccccgccccacacccttgggatctgcgttctctccgctcccttgaaaaacagatggtttgatttcacagcgaggcttttctttttctttttgcaagctacatgactgaaatgtgaacatttctgctaaaatacactcaggaaaaagtaaaattttatgtcaaacagaccttaggcacataaaaggaggcatttttcgtttctctctttcc

SEQ ID NO: 6023 - DNA, 249 bp, Homo sapiens; identical to SEQ ID NO: 142
  misc_feature 1..249: note = chr2:468423-468672
  misc_feature 1..249: note = hyper
  source 1..249: mol_type = genomic DNA

SEQ ID NO: 6024 - DNA, 165 bp, Homo sapiens; identical to SEQ ID NO: 1920
  misc_feature 1..165: note = chr2:945845-946010
  misc_feature 1..165: note = hyper
  source 1..165: mol_type = genomic DNA

SEQ ID NO: 6025 - DNA, 207 bp, Homo sapiens; identical to SEQ ID NO: 1921
  misc_feature 1..207: note = chr2:946011-946218
  misc_feature 1..207: note = hyper
  source 1..207: mol_type = genomic DNA

SEQ ID NO: 6026 - DNA, 115 bp, Homo sapiens; identical to SEQ ID NO: 1922
  misc_feature 1..115: note = chr2:946289-946404
  misc_feature 1..115: note = hyper
  source 1..115: mol_type = genomic DNA

SEQ ID NO: 6027 - DNA, 51 bp, Homo sapiens
  misc_feature 1..51: note = chr2:947126-947177
  misc_feature 1..51: note = hyper
  source 1..51: mol_type = genomic DNA
cggtggctcggaccggagcgtcccccctgcagccttcgggcgcccaggcca

SEQ ID NO: 6028 - DNA, 466 bp, Homo sapiens; identical to SEQ ID NO: 1923
  misc_feature 1..466: note = chr2:1746567-1747033
  misc_feature 1..466: note = hyper
  source 1..466: mol_type = genomic DNA

SEQ ID NO: 6029 - DNA, 338 bp, Homo sapiens
  misc_feature 1..338: note = chr2:1747670-1748008
  misc_feature 1..338: note = hyper
  source 1..338: mol_type = genomic DNA
gagcatgagagggggcggcgggaggcgagcggggggagccccggaggctccaacaacttcccagtcctgcggggattccgagttccgaacaaaggcggctacgaaggccgcgcgcacagcgctctgttccgcccctcggcgtctcccgcagggcgaacaaaggcccagcgggtccccgcgcccaggtccccccacgtcccccttcggaggttcccttctgcgtcccaagtccccaggccccccgcgcgcccgatgccccctccaccctccgcgccccccacctccgatcacccctgcgctcccggatctccacgaagccccggaccccgcgcccccgg

SEQ ID NO: 6030 - DNA, 94 bp, Homo sapiens
  misc_feature 1..94: note = chr2:1748454-1748548
  misc_feature 1..94: note = hyper
  source 1..94: mol_type = genomic DNA
cccgcatggccaaggcgagcgctcgggggcgcggaggagagcattggcacccctgattctgcgctcgagactcggggctcgggaccctggggcc

SEQ ID NO: 6031 - DNA, 43 bp, Homo sapiens
  misc_feature 1..43: note = chr2:5831358-5831401
  misc_feature 1..43: note = hyper
  source 1..43: mol_type = genomic DNA
tagctcacaatcgcacgatttcaggacgaggctgccggagaag

SEQ ID NO: 6032 - DNA, 259 bp, Homo sapiens; identical to SEQ ID NO: 1924
  misc_feature 1..259: note = chr2:5831789-5832048
  misc_feature 1..259: note = hyper
  source 1..259: mol_type = genomic DNA

SEQ ID NO: 6033 - DNA, 116 bp, Homo sapiens; identical to SEQ ID NO: 1925
  misc_feature 1..116: note = chr2:5832731-5832847
  misc_feature 1..116: note = hyper
  source 1..116: mol_type = genomic DNA

SEQ ID NO: 6034 - DNA, 151 bp, Homo sapiens; identical to SEQ ID NO: 1926
  misc_feature 1..151: note = chr2:5833282-5833433
  misc_feature 1..151: note = hyper
  source 1..151: mol_type = genomic DNA

SEQ ID NO: 6035 - DNA, 141 bp, Homo sapiens; identical to SEQ ID NO: 1927
  misc_feature 1..141: note = chr2:5833499-5833640
  misc_feature 1..141: note = hyper
  source 1..141: mol_type = genomic DNA

SEQ ID NO: 6036 - DNA, 75 bp, Homo sapiens; identical to SEQ ID NO: 1928
  misc_feature 1..75: note = chr2:5833953-5834028
  misc_feature 1..75: note = hyper
  source 1..75: mol_type = genomic DNA

SEQ ID NO: 6037 - DNA, 87 bp, Homo sapiens; identical to SEQ ID NO: 1929
  misc_feature 1..87: note = chr2:5836085-5836172
  misc_feature 1..87: note = hyper
  source 1..87: mol_type = genomic DNA

SEQ ID NO: 6038 - DNA, 78 bp, Homo sapiens
  misc_feature 1..78: note = chr2:5836497-5836575
  misc_feature 1..78: note = hyper
  source 1..78: mol_type = genomic DNA
agggggcgcggggcgcggcgggacccaggctacgagcgggagggaggcgggagtcgggggaagacgcggcaggccggc

SEQ ID NO: 6039 - DNA, 125 bp, Homo sapiens
  misc_feature 1..125: note = chr2:5836851-5836976
  misc_feature 1..125: note = hyper
  source 1..125: mol_type = genomic DNA
cggggagggaagcctcggggctgcggggtgagaggaagaaagcaaacccggggagcaggcggctgccgcacccgcgcaccccgggccctcaccacgccctccccgcgcgccggctcaggggctgc

SEQ ID NO: 6040 - DNA, 116 bp, Homo sapiens
  misc_feature 1..116: note = chr2:5837352-5837468
  misc_feature 1..116: note = hyper
  source 1..116: mol_type = genomic DNA
cggaggaggttttcagtggctgattgaaactcactgcaaaatcaccacgactctttcacctactgagatgattgaccgaggtttggccttccatttttactgagatttggcgagac

SEQ ID NO: 6041 - DNA, 104 bp, Homo sapiens; identical to SEQ ID NO: 1930
  misc_feature 1..104: note = chr2:5866074-5866178
  misc_feature 1..104: note = hyper
  source 1..104: mol_type = genomic DNA

SEQ ID NO: 6042 - DNA, 53 bp, Homo sapiens
  misc_feature 1..53: note = chr2:7058223-7058276
  misc_feature 1..53: note = hyper
  source 1..53: mol_type = genomic DNA
aggtctgggaaaggacgacgcgtccggggcatcgccaccggcggggaaggtcg

SEQ ID NO: 6043 - DNA, 30 bp, Homo sapiens
  misc_feature 1..30: note = chr2:7571320-7571350
  misc_feature 1..30: note = hyper
  source 1..30: mol_type = genomic DNA
tacatttcaaatgctcgacagctgggccaa

SEQ ID NO: 6044 - DNA, 45 bp, Homo sapiens
  misc_feature 1..45: note = chr2:7571610-7571655
  misc_feature 1..45: note = hyper
  source 1..45: mol_type = genomic DNA
caggtgtgcactccgcgcgcgcactcagctcgctttggtgtttct

SEQ ID NO: 6045 - DNA, 206 bp, Homo sapiens
  misc_feature 1..206: note = chr2:10182790-10182996
  misc_feature 1..206: note = hyper
  source 1..206: mol_type = genomic DNA
agagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccaga

SEQ ID NO: 6046 - DNA, 118 bp, Homo sapiens
  misc_feature 1..118: note = chr2:10220823-10220941
  misc_feature 1..118: note = hyper
  source 1..118: mol_type = genomic DNA
gggcccgtgggaggccgcgggagcttggggggacttcccaaagcctgagccccctagcgatgcgcggggtgggcgggggaaagaccctgagggctgcgcgcgctgcgttcgcgaggtc

SEQ ID NO: 6047 - DNA, 15 bp, Homo sapiens
  misc_feature 1..15: note = chr2:10220958-10220973
  misc_feature 1..15: note = hyper
  source 1..15: mol_type = genomic DNA
cgacctttcagtgtc

SEQ ID NO: 6048 - DNA, 30 bp, Homo sapiens
  misc_feature 1..30: note = chr2:10688849-10688879
  misc_feature 1..30: note = hyper
  source 1..30: mol_type = genomic DNA
tctgctgggatgacccggtcctgttgcccc

SEQ ID NO: 6049 - DNA, 30 bp, Homo sapiens
  misc_feature 1..30: note = chr2:11052420-11052450
  misc_feature 1..30: note = hyper
  source 1..30: mol_type = genomic DNA
cccgcaggcgggcgccggccaggctctccc

SEQ ID NO: 6050 - DNA, 157 bp, Homo sapiens
  misc_feature 1..157: note = chr2:11622808-11622965
  misc_feature 1..157: note = hyper
  source 1..157: mol_type = genomic DNA
gccaagcccaccgcccggccctcctccgcggccgtcccgaagacccggagaagtggaccacagggggcggccagtgtcaggggtcgagtcctccgcgctggccgcggttccggagatccgggctttgccgagcgccccgcgccgtggccggggccgg

SEQ ID NO: 6051 - DNA, 91 bp, Homo sapiens
  misc_feature 1..91: note = chr2:12858539-12858630
  misc_feature 1..91: note = hyper
  source 1..91: mol_type = genomic DNA
gccagagtttcagcccgaacctcggctccccgagcccgcccgagactccgaacttgtcgcattgcgtttcttgtatcgggaaatacttatt

SEQ ID NO: 6052 - DNA, 30 bp, Homo sapiens
  misc_feature 1..30: note = chr2:14773957-14773987
  misc_feature 1..30: note = hyper
  source 1..30: mol_type = genomic DNA
ggcacgtaagctagccggcaggtcccaggg

SEQ ID NO: 6053 - DNA, 516 bp, Homo sapiens
  misc_feature 1..516: note = chr2:16082386-16082902
  misc_feature 1..516: note = hyper
  source 1..516: mol_type = genomic DNA
cgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgccc

SEQ ID NO: 6054 - DNA, 71 bp, Homo sapiens
  misc_feature 1..71: note = chr2:17720246-17720317
  misc_feature 1..71: note = hyper
  source 1..71: mol_type = genomic DNA
gcagcccgccggggccgcgcgccgtggtccgcgcgactccgcgctccgggtttccgcggtcaccagcactg

SEQ ID NO: 6055 - DNA, 56 bp, Homo sapiens
  misc_feature 1..56: note = chr2:17721623-17721679
  misc_feature 1..56: note = hyper
  source 1..56: mol_type = genomic DNA
aaccactgggcgtggcgagtccgggtaacccgcagtccctcgcgcccgtccaggtg

SEQ ID NO: 6056 - DNA, 74 bp, Homo sapiens
  misc_feature 1..74: note = chr2:17721750-17721824
  misc_feature 1..74: note = hyper
  source 1..74: mol_type = genomic DNA
cgtggaatccacccgcggaaactccgagcccctccgactgagcatgcgccatcgccaggcggcttttggtcaca

SEQ ID NO: 6057 - DNA, 126 bp, Homo sapiens
  misc_feature 1..126: note = chr2:18011883-18012009
  misc_feature 1..126: note = hyper
  source 1..126: mol_type = genomic DNA
actggctgcagatcccgcaaccctcgggtgttcaagtgcgcggggtggtgcgggcgctcccgcagtccgcgcttggctcgtgggaggcctcgggcgccccctccaggattccgtgctaactgcaaa

SEQ ID NO: 6058 - DNA, 584 bp, Homo sapiens
  misc_feature 1..584: note = chr2:18058949-18059533
  misc_feature 1..584: note = hyper
  source 1..584: mol_type = genomic DNA
ccagggaacactgggcgccttagcttggagcagctggctccgaggaattgttccacgtctgcacaacttaaaaatctgcagtttgggggcgggagggggagcgcgggggtgggtcccgaagcgtcccatttctcctcctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccg

SEQ ID NO: 6059 - DNA, 30 bp, Homo sapiens
  misc_feature 1..30: note = chr2:18060088-18060118
  misc_feature 1..30: note = hyper
  source 1..30: mol_type = genomic DNA
ccccacctccctgcgcgctccggagacttc

SEQ ID NO: 6060 - DNA, 43 bp, Homo sapiens
  misc_feature 1..43: note = chr2:19551406-19551449
  misc_feature 1..43: note = hyper
  source 1..43: mol_type = genomic DNA
tgcagaccccaggcccgaggtccccgtcccgctctcctagtcc

SEQ ID NO: 6061 - DNA, 254 bp, Homo sapiens
  misc_feature 1..254: note = chr2:19556346-19556600
  misc_feature 1..254: note = hyper
  source 1..254: mol_type = genomic DNA
tccggtttcccagaccgcggaaccccagggcgaatactttcgatctttaaacacaggatggaaaacccttccccaggctaggcacccattcctcaaacagcttgggcctcaggacctgcgggaaagaataaggggacccgaccacgcacagcagacgcaattcgcgctcgggatcccgagtccctgcgcagtgcgggcactcgcgtccctcgcgcggtggagcgccaatcccaggtctgcggccagtcctatgc

SEQ ID NO: 6062 - DNA, 156 bp, Homo sapiens
  misc_feature 1..156: note = chr2:19558809-19558965
  misc_feature 1..156: note = hyper
  source 1..156: mol_type = genomic DNA
cggcttgggtttcaacgcactttggcgcctgacagagtcgcatctcctcccagaatctctttccagaggcggcagaccccgagtgtggagcagctcctggctatccaagcgtgctcggggccagggtgttaacccaggcagcgctggttaattcct

SEQ ID NO: 6063 - DNA, 32 bp, Homo sapiens
  misc_feature 1..32: note = chr2:19561263-19561295
  misc_feature 1..32: note = hyper
  source 1..32: mol_type = genomic DNA
agcgcactccgccaccgcggctgcagcttctg

SEQ ID NO: 6064 - DNA, 52 bp, Homo sapiens
  misc_feature 1..52: note = chr2:19561523-19561575
  misc_feature 1..52: note = hyper
  source 1..52: mol_type = genomic DNA
cgatccctccgtctgcccgggcttccgggctgtggaccgcactgaacccagt

SEQ ID NO: 6065 - DNA, 30 bp, Homo sapiens
  misc_feature 1..30: note = chr2:20068798-20068828
  misc_feature 1..30: note = hyper
  source 1..30: mol_type = genomic DNA
cttctctaactgacccgaaccgacccgggc

SEQ ID NO: 6066 - DNA, 133 bp, Homo sapiens; identical to SEQ ID NO: 1931
  misc_feature 1..133: note = chr2:20865714-20865847
  misc_feature 1..133: note = hyper
  source 1..133: mol_type = genomic DNA

SEQ ID NO: 6067 - DNA, 232 bp, Homo sapiens; identical to SEQ ID NO: 1932
  misc_feature 1..232: note = chr2:20865848-20866080
  misc_feature 1..232: note = hyper
  source 1..232: mol_type = genomic DNA

SEQ ID NO: 6068 - DNA, 65 bp, Homo sapiens
  misc_feature 1..65: note = chr2:21022991-21023056
  misc_feature 1..65: note = hyper
  source 1..65: mol_type = genomic DNA
cctcttggagggtgtcggggttttcctttctttttcatttgaattttatccgccttttattttct

SEQ ID NO: 6069 - DNA, 41 bp, Homo sapiens
  misc_feature 1..41: note = chr2:23609527-23609568
  misc_feature 1..41: note = hyper
  source 1..41: mol_type = genomic DNA
ctccgtggcctggagcgggctgagagcgctagggttatctg

SEQ ID NO: 6070 - DNA, 16 bp, Homo sapiens
  misc_feature 1..16: note = chr2:24232773-24232789
  misc_feature 1..16: note = hyper
  source 1..16: mol_type = genomic DNA
gtcctgagggcctgcc

SEQ ID NO: 6071 - DNA, 89 bp, Homo sapiens
  misc_feature 1..89: note = chr2:24233349-24233438
  misc_feature 1..89: note = hyper
  source 1..89: mol_type = genomic DNA
gcaggtcctcccggggtccccgagctctgggcaggcagggctttctgaagcgcctggggaggctgcgtccttcccgacctcaggcagct

SEQ ID NO: 6072 - DNA, 30 bp, Homo sapiens
  misc_feature 1..30: note = chr2:24273201-24273231
  misc_feature 1..30: note = hyper
  source 1..30: mol_type = genomic DNA
tcggtcgcttccctgcgggccgggctgtga

SEQ ID NO: 6073 - DNA, 42 bp, Homo sapiens
  misc_feature 1..42: note = chr2:25354748-25354790
  misc_feature 1..42: note = hyper
  source 1..42: mol_type = genomic DNA
catgttccaggaggccgtcatcaagaccgtgggtgcggcgcg

SEQ ID NO: 6074 - DNA, 676 bp, Homo sapiens; identical to SEQ ID NO: 1933
  misc_feature 1..676: note = chr2:25391058-25391734
  misc_feature 1..676: note = hyper
  source 1..676: mol_type = genomic DNA

SEQ ID NO: 6075 - DNA, 37 bp, Homo sapiens; identical to SEQ ID NO: 143
  misc_feature 1..37: note = chr2:25438835-25438872
  misc_feature 1..37: note = hyper
  source 1..37: mol_type = genomic DNA

SEQ ID NO: 6076 - DNA, 222 bp, Homo sapiens; identical to SEQ ID NO: 144
  misc_feature 1..222: note = chr2:25439138-25439360
  misc_feature 1..222: note = hyper
  source 1..222: mol_type = genomic DNA

SEQ ID NO: 6077 - DNA, 249 bp, Homo sapiens
  misc_feature 1..249: note = chr2:26401931-26402180
  misc_feature 1..249: note = hyper
  source 1..249: mol_type = genomic DNA
gtggagggaggaggacggcgactcgcgccgggtggggctgaaggcactgcggggtgactcggtctccaggctgcggcgctctgctccgggagtcagggagacctggcctggccccgtactgtcccccgtcccagcccccgcccctggccctgcgggaggggccaggcgtcttccctgagcatggtgccacttccccagtgttggccttgtttcctgctcagcatttggcagatgcgcctctggcccaac

SEQ ID NO: 6078 - DNA, 179 bp, Homo sapiens; identical to SEQ ID NO: 145
  misc_feature 1..179: note = chr2:26407743-26407922
  misc_feature 1..179: note = hyper
  source 1..179: mol_type = genomic DNA

SEQ ID NO: 6079 - DNA, 103 bp, Homo sapiens; identical to SEQ ID NO: 1937
  misc_feature 1..103: note = chr2:26522016-26522119
  misc_feature 1..103: note = hyper
  source 1..103: mol_type = genomic DNA

SEQ ID NO: 6080 - DNA, 372 bp, Homo sapiens
  misc_feature 1..372: note = chr2:26915695-26916067
  misc_feature 1..372: note = hyper
  source 1..372: mol_type = genomic DNA
ggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggtaacggctcgccgggcggggggcgggaacccagggctggg

SEQ ID NO: 6081 - DNA, 89 bp, Homo sapiens
  misc_feature 1..89: note = chr2:26916088-26916177
  misc_feature 1..89: note = hyper
  source 1..89: mol_type = genomic DNA
cggggccggctggggctgggggcgggggctcccccgagaggggctgggcgccgaaccctgcgctcgcagaaacccgagttcagcctggc

SEQ ID NO: 6082 - DNA, 806 bp, Homo sapiens; identical to SEQ ID NO: 1938
  misc_feature 1..806: note = chr2:27070324-27071130
  misc_feature 1..806: note = hyper
  source 1..806: mol_type = genomic DNA

SEQ ID NO: 6083 - DNA, 97 bp, Homo sapiens
  misc_feature 1..97: note = chr2:27071758-27071855
  misc_feature 1..97: note = hyper
  source 1..97: mol_type = genomic DNA
ccgagccgggtccctcggctggagcccagcgcgggagcccgccttgcagcatcgatctcagcgggcaccgacgtcgacgccccgggcctggggacgg

SEQ ID NO: 6084 - DNA, 70 bp, Homo sapiens
  misc_feature 1..70: note = chr2:27072945-27073015
  misc_feature 1..70: note = hyper
  source 1..70: mol_type = genomic DNA
tttctcagggggagccgtaagggctggtgcggattgtggtcaaattgcggagaagcgggtggaaatgatc

SEQ ID NO: 6085 - DNA, 30 bp, Homo sapiens
  misc_feature 1..30: note = chr2:27473328-27473358
  misc_feature 1..30: note = hyper
  source 1..30: mol_type = genomic DNA
tcctcttgaccctgccggctgggccctggg

SEQ ID NO: 6086 - DNA, 159 bp, Homo sapiens
  misc_feature 1..159: note = chr2:27484899-27485058
  misc_feature 1..159: note = hyper
  source 1..159: mol_type = genomic DNA
agacaagatggcccacgggggtgggcagggaggtcggacggccgctcagaggggcaggtggacggtggcggcaggcgcgggggccggcggggcgcgttggcggttctcctgccacccccggcccgctgtcccggccgctccgcgcgcctcatttcacac

SEQ ID NO: 6087 - DNA, 86 bp, Homo sapiens
  misc_feature 1..86: note = chr2:27938325-27938411
  misc_feature 1..86: note = hyper
  source 1..86: mol_type = genomic DNA
gggggcaggcctggccgagtggctccgtgaagacgcaggcgcggccggagggcgcggggctcgggcaggatcgcgccgccgggccg

SEQ ID NO: 6088 - DNA, 170 bp, Homo sapiens; identical to SEQ ID NO: 1939
  misc_feature 1..170: note = chr2:29033528-29033698
  misc_feature 1..170: note = hyper
  source 1..170: mol_type = genomic DNA

SEQ ID NO: 6089 - DNA, 590 bp, Homo sapiens; identical to SEQ ID NO: 1940
  misc_feature 1..590: note = chr2:29338158-29338748
  misc_feature 1..590: note = hyper
  source 1..590: mol_type = genomic DNA

SEQ ID NO: 6090 - DNA, 281 bp, Homo sapiens; identical to SEQ ID NO: 1941
  misc_feature 1..281: note = chr2:29338809-29339090
  misc_feature 1..281: note = hyper
  source 1..281: mol_type = genomic DNA

SEQ ID NO: 6091 - DNA, 47 bp, Homo sapiens
  misc_feature 1..47: note = chr2:30143276-30143323
  misc_feature 1..47: note = hyper
  source 1..47: mol_type = genomic DNA
gccagccttcagctccgaggaggatggtggcagcagtaggtcccggg

SEQ ID NO: 6092 - DNA, 82 bp, Homo sapiens
  misc_feature 1..82: note = chr2:30143382-30143464
  misc_feature 1..82: note = hyper
  source 1..82: mol_type = genomic DNA
cgcgagtagctgagtggctcccggggctgcagcggcggccccgcagctggggagcccgcgcgctggccggtccccatcccgg

SEQ ID NO: 6093 - DNA, 201 bp, Homo sapiens
  misc_feature 1..201: note = chr2:30144378-30144579
  misc_feature 1..201: note = hyper
  source 1..201: mol_type = genomic DNA
ccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctc

SEQ ID NO: 6094 - DNA, 279 bp, Homo sapiens; identical to SEQ ID NO: 146
  misc_feature 1..279: note = chr2:30453784-30454063
  misc_feature 1..279: note = hyper
  source 1..279: mol_type = genomic DNA

SEQ ID NO: 6095 - DNA, 381 bp, Homo sapiens
  misc_feature 1..381: note = chr2:31360209-31360590
  misc_feature 1..381: note = hyper
  source 1..381: mol_type = genomic DNA
ccgccaataccaaggcgtctgtttttacaggctctttcgtggtgttctgggcacattcaacttccaatgcagctgagagggtcgggaacagttagagaacaggggtggcagccgcccgggaggctgcaaggcgctcgcccgcaacgcacaggcgcgcgcggcgcacccggcctccggcctccccaggtcgggcctggcagctgcgggaaggaggtcagcgcagccgccacacttcgcccgggcgctggcccgacccgaccgccggcgactctctggcagcgcccggagaccgccagcccctgggccgcccgtccgcagagccccctccgccccgggaccctcgcgcgcagctcaagttgggagccccgctccgcaggcgag

SEQ ID NO: 6096 - DNA, 63 bp, Homo sapiens
  misc_feature 1..63: note = chr2:31360630-31360693
  misc_feature 1..63: note = hyper
  source 1..63: mol_type = genomic DNA
cgcgggtccggagatgcccccgagcgttttaaaatccagaaacatcacatggtagccacatcc

SEQ ID NO: 6097 - DNA, 62 bp, Homo sapiens
  misc_feature 1..62: note = chr2:31360694-31360756
  misc_feature 1..62: note = hyper
  source 1..62: mol_type = genomic DNA
gcggctgttacctgctcgcagcacccagaccctcgccctggtttcccgggagcccgcaaacc

SEQ ID NO: 6098 - DNA, 176 bp, Homo sapiens
  misc_feature 1..176: note = chr2:31360803-31360979
  misc_feature 1..176: note = hyper
  source 1..176: mol_type = genomic DNA
cgcgccggcaagccgcctaccttaggggtctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcg

SEQ ID NO: 6099 - DNA, 73 bp, Homo sapiens
  misc_feature 1..73: note = chr2:31361425-31361498
  misc_feature 1..73: note = hyper
  source 1..73: mol_type = genomic DNA
ccaggtgggagtgagcggggctctgagagggggcgctaccgccgcccgccgaccgaaacgctcggtgctgttg

SEQ ID NO: 6100 - DNA, 185 bp, Homo sapiens
  misc_feature 1..185: note = chr2:31456872-31457057
  misc_feature 1..185: note = hyper
  source 1..185: mol_type = genomic DNA
tgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgt

SEQ ID NO: 6101 - DNA, 45 bp, Homo sapiens
  misc_feature 1..45: note = chr2:37571852-37571897
  misc_feature 1..45: note = hyper
  source 1..45: mol_type = genomic DNA
gctcccagacagactcggagagatggcaggcggaagacaccggcg

SEQ ID NO: 6102 - DNA, 99 bp, Homo sapiens
  misc_feature 1..99: note = chr2:38301762-38301861
  misc_feature 1..99: note = hyper
  source 1..99: mol_type = genomic DNA
cggtgcgcaccgggttggggaagtactgcagccagggcatcacgtccaccaggctgcccgcgcccaccgtgcgcccgaactcttcgttgtggctgagca

SEQ ID NO: 6103 - DNA, 158 bp, Homo sapiens; identical to SEQ ID NO: 147
  misc_feature 1..158: note = chr2:38302718-38302876
  misc_feature 1..158: note = hyper
  source 1..158: mol_type = genomic DNA

SEQ ID NO: 6104 - DNA, 47 bp, Homo sapiens
  misc_feature 1..47: note = chr2:38755384-38755431
  misc_feature 1..47: note = hyper
  source 1..47: mol_type = genomic DNA
gccgctgtgattgggcgaaagatggcgctgggcggatggaaatccta

SEQ ID NO: 6105 - DNA, 38 bp, Homo sapiens; identical to SEQ ID NO: 148
  misc_feature 1..38: note = chr2:39187200-39187238
  misc_feature 1..38: note = hyper
  source 1..38: mol_type = genomic DNA

SEQ ID NO: 6106 - DNA, 63 bp, Homo sapiens; identical to SEQ ID NO: 149
  misc_feature 1..63: note = chr2:39187544-39187607
  misc_feature 1..63: note = hyper
  source 1..63: mol_type = genomic DNA

SEQ ID NO: 6107 - DNA, 781 bp, Homo sapiens
  misc_feature 1..781: note = chr2:39893060-39893841
  misc_feature 1..781: note = hyper
  source 1..781: mol_type = genomic DNA
tgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcct

SEQ ID NO: 6108 - DNA, 392 bp, Homo sapiens; identical to SEQ ID NO: 150
  misc_feature 1..392: note = chr2:40678497-40678889
  misc_feature 1..392: note = hyper
  source 1..392: mol_type = genomic DNA

SEQ ID NO: 6109 - DNA, 137 bp, Homo sapiens; identical to SEQ ID NO: 151
  misc_feature 1..137: note = chr2:40678949-40679086
  misc_feature 1..137: note = hyper
  source 1..137: mol_type = genomic DNA

SEQ ID NO: 6110 - DNA, 432 bp, Homo sapiens; identical to SEQ ID NO: 152
  misc_feature 1..432: note = chr2:40679087-40679519
  misc_feature 1..432: note = hyper
  source 1..432: mol_type = genomic DNA

SEQ ID NO: 6111 - DNA, 85 bp, Homo sapiens; identical to SEQ ID NO: 153
  misc_feature 1..85: note = chr2:40679520-40679605
  misc_feature 1..85: note = hyper
  source 1..85: mol_type = genomic DNA

SEQ ID NO: 6112 - DNA, 68 bp, Homo sapiens
  misc_feature 1..68: note = chr2:42329377-42329445
  misc_feature 1..68: note = hyper
  source 1..68: mol_type = genomic DNA
gtctgcagatggggccggccaccacgtgctctctgagttctctttccaagtacagatccctccggaga

SEQ ID NO: 6113 - DNA, 31 bp, Homo sapiens
  misc_feature 1..31: note = chr2:42329493-42329524
  misc_feature 1..31: note = hyper
  source 1..31: mol_type = genomic DNA
cgtgagaaccggagcccggggtgacttgcgg

SEQ ID NO: 6114 - DNA, 86 bp, Homo sapiens
  misc_feature 1..86: note = chr2:42329751-42329837
  misc_feature 1..86: note = hyper
  source 1..86: mol_type = genomic DNA
ccttgcagcgagatccgcgcccccccccaccccaccccgcctcattctccacaggcgccacagccacaggccgcataaataaatcc

SEQ ID NO: 6115 - DNA, 177 bp, Homo sapiens; identical to SEQ ID NO: 1950
  misc_feature 1..177: note = chr2:42720270-42720447
  misc_feature 1..177: note = hyper
  source 1..177: mol_type = genomic DNA

SEQ ID NO: 6116 - DNA, 73 bp, Homo sapiens
  misc_feature 1..73: note = chr2:42720975-42721048
  misc_feature 1..73: note = hyper
  source 1..73: mol_type = genomic DNA
ccctctcccaagccgcggggccgaccccctgagggctgcgggcgccgaatggagccgccggggcggaatagct

SEQ ID NO: 6117 - DNA, 84 bp, Homo sapiens
  misc_feature 1..84: note = chr2:43019673-43019757
  misc_feature 1..84: note = hyper
  source 1..84: mol_type = genomic DNA
catgactgtcccgggcgcctcctcgcagcgctgtcctcccgccgtcggaggcccgcagctccgcccagccgcctttttaaccag

SEQ ID NO: 6118 - DNA, 212 bp, Homo sapiens
  misc_feature 1..212: note = chr2:43020113-43020325
  misc_feature 1..212: note = hyper
  source 1..212: mol_type = genomic DNA
ctacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactc

SEQ ID NO: 6119 - DNA, 30 bp, Homo sapiens
  misc_feature 1..30: note = chr2:43451091-43451121
  misc_feature 1..30: note = hyper
  source 1..30: mol_type = genomic DNA
aagtcccaaactcatcggagtcctaacaaa

SEQ ID NO: 6120 - DNA, 265 bp, Homo sapiens
  misc_feature 1..265: note = chr2:43452060-43452325
  misc_feature 1..265: note = hyper
  source 1..265: mol_type = genomic DNA
agagcaggagggcggcggcggcgtgcgcgacgtggggctgtcgagcagcagcggcgactcgaggccgcccgggggctgatggtggcccgacgggaagcccgagaagctgaggctgtggtgcaacttgggccgcggctcccgcgggaagcccaggtgcaacgcatcgcgcgtgccaaaggcacgcaggtccccggaggcgccccccgacggcgcgggccgccgctcgtccgcgttgtggatgaagtggcagcgcggcccatagggg

SEQ ID NO: 6121 - DNA, 119 bp, Homo sapiens; identical to SEQ ID NO: 154
  misc_feature 1..119: note = chr2:45028940-45029059
  misc_feature 1..119: note = hyper
  source 1..119: mol_type = genomic DNA

SEQ ID NO: 6122 - DNA, 184 bp, Homo sapiens; identical to SEQ ID NO: 155
  misc_feature 1..184: note = chr2:45029183-45029367
  misc_feature 1..184: note = hyper
  source 1..184: mol_type = genomic DNA

SEQ ID NO: 6123 - DNA, 86 bp, Homo sapiens; identical to SEQ ID NO: 156
  misc_feature 1..86: note = chr2:45155125-45155211
  misc_feature 1..86: note = hyper
  source 1..86: mol_type = genomic DNA

SEQ ID NO: 6124 - DNA, 636 bp, Homo sapiens; identical to SEQ ID NO: 157
  misc_feature 1..636: note = chr2:45155355-45155991
  misc_feature 1..636: note = hyper
  source 1..636: mol_type = genomic DNA

SEQ ID NO: 6125 - DNA, 820 bp, Homo sapiens; identical to SEQ ID NO: 158
  misc_feature 1..820: note = chr2:45155992-45156812
  misc_feature 1..820: note = hyper
  source 1..820: mol_type = genomic DNA

SEQ ID NO: 6126 - DNA, 89 bp, Homo sapiens; identical to SEQ ID NO: 159
  misc_feature 1..89: note = chr2:45156832-45156921
  misc_feature 1..89: note = hyper
  source 1..89: mol_type = genomic DNA

SEQ ID NO: 6127 - DNA, 96 bp, Homo sapiens; identical to SEQ ID NO: 160
  misc_feature 1..96: note = chr2:45157254-45157350
  misc_feature 1..96: note = hyper
  source 1..96: mol_type = genomic DNA

SEQ ID NO: 6128 - DNA, 84 bp, Homo sapiens
  misc_feature 1..84: note = chr2:45157562-45157646
  misc_feature 1..84: note = hyper
  source 1..84: mol_type = genomic DNA
ttctgctgaggaaggcgcaggcaaccctagtcggcttagagagagacaaccgcacgcgatcaccgagcacgatttctcccaaca

SEQ ID NO: 6129 - DNA, 214 bp, Homo sapiens
  misc_feature 1..214: note = chr2:45159704-45159918
  misc_feature 1..214: note = hyper
  source 1..214: mol_type = genomic DNA
gagtctgagctcaaacgtgcgcgaccccctgggtctgcatggggagaaggaggtgtgcacgtgcaaacgcgggactttgggtggagtgtgaggttgatagggctttcggccccagggccctctaggcctcttttaaataccttcatctgcccaatttcttaacctttcaggacaaggagggagaccctccgcgatcctgcgccttgccaccctt

SEQ ID NO: 6130 - DNA, 64 bp, Homo sapiens
  misc_feature 1..64: note = chr2:45160203-45160267
  misc_feature 1..64: note = hyper
  source 1..64: mol_type = genomic DNA
gctcctacctcaacacgcagcgctcagcgggctgccagagtgagcttcccggaccacccccaag

SEQ ID NO: 6131 - DNA, 38 bp, Homo sapiens; identical to SEQ ID NO: 1958
  misc_feature 1..38: note = chr2:45160596-45160634
  misc_feature 1..38: note = hyper
  source 1..38: mol_type = genomic DNA

SEQ ID NO: 6132 - DNA, 30 bp, Homo sapiens
  misc_feature 1..30: note = chr2:45160939-45160969
  misc_feature 1..30: note = hyper
  source 1..30: mol_type = genomic DNA
gatccgtattggcagcgacgaggaagggag

SEQ ID NO: 6133 - DNA, 34 bp, Homo sapiens
  misc_feature 1..34: note = chr2:45161221-45161255
  misc_feature 1..34: note = hyper
  source 1..34: mol_type = genomic DNA
gagaggatggggaaacgcgcgccccaagagcaaa

SEQ ID NO: 6134 - DNA, 313 bp, Homo sapiens
  misc_feature 1..313: note = chr2:45161723-45162036
  misc_feature 1..313: note = hyper
  source 1..313: mol_type = genomic DNA
gtgtttgtgtgtgtgcgagagagagacagagagactatgcgcccgcaagcgcgcgcgcgcgcctgtttgtggcgcgctctggaaacattttccgacttttcactcggacgccctggatttctcgcctttgcctttctctgcttcccctccctcttctctcgccctcccctcccccacccaggtctaccccaccctaccccactcctaccccggctgctgaggcgctcttctgccggctattgtacggctggcgcgggctccccctggccacatcccgggcctctcacacaagaagaatagttctgtttccgcc

SEQ ID NO: 6135 - DNA, 124 bp, Homo sapiens
  misc_feature 1..124: note = chr2:45162037-45162161
  misc_feature 1..124: note = hyper
  source 1..124: mol_type = genomic DNA
taaacccccacacaaaggctgcccggccaccgggtcccctgtcccccttcccggggacttcggcttttgaggtgctgctgcgcgttctttctccctccccctctcagggcgccagggcccagac

SEQ ID NO: 6136 - DNA, 30 bp, Homo sapiens
  misc_feature 1..30: note = chr2:45162908-45162938
  misc_feature 1..30: note = hyper
  source 1..30: mol_type = genomic DNA
gcctctcctgccagccgtgtggctcttaaa

SEQ ID NO: 6137 - DNA, 205 bp, Homo sapiens
  misc_feature 1..205: note = chr2:45164939-45165144
  misc_feature 1..205: note = hyper
  source 1..205: mol_type = genomic DNA
gtccttgaagggcttcgcggcctccccgcctgcgtgctgcgctcccctgcgccctccctggccgcccgcgccaagcgcctcagtttgcagcttgcggggaggcccagactacgggccacccggccagcctccgcctcccgacatcctgggagccggaaggggcgttgcccccacagggcaaaccttcccccggcctcctggtcgg

SEQ ID NO: 6138 - DNA, 30 bp, Homo sapiens
  misc_feature 1..30: note = chr2:45165564-45165594
  misc_feature 1..30: note = hyper
  source 1..30: mol_type = genomic DNA
gctgacctatccacccgagactctccgctc

SEQ ID NO: 6139 - DNA, 61 bp, Homo sapiens
  misc_feature 1..61: note = chr2:45168959-45169020
  misc_feature 1..61: note = hyper
  source 1..61: mol_type = genomic DNA
tctccctctctgtctcgggttctctctctgcgcgcgcgcaccgggccgctctcctacctcc

SEQ ID NO: 6140 - DNA, 88 bp, Homo sapiens
  misc_feature 1..88: note = chr2:45169316-45169404
  misc_feature 1..88: note = hyper
  source 1..88: mol_type = genomic DNA
gctccatacttctggcgagtagcggcggcgggaacggtgcgggaggcggcggcggcgcgggaggcggcagcggcggcgggaacggtgc

SEQ ID NO: 6141 - DNA, 341 bp, Homo sapiens
  misc_feature 1..341: note = chr2:45169782-45170123
  misc_feature 1..341: note = hyper
  source 1..341: mol_type = genomic DNA
gcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggttagtggcggggcccgcggcctggctacagcctcagaggcctgggaaggggagaggggttgagatggggctag

SEQ ID NO: 6142 - DNA, 240 bp, Homo sapiens; identical to SEQ ID NO: 161
  misc_feature 1..240: note = chr2:45171324-45171564
  misc_feature 1..240: note = hyper
  source 1..240: mol_type = genomic DNA

SEQ ID NO: 6143 - DNA, 43 bp, Homo sapiens; identical to SEQ ID NO: 162
  misc_feature 1..43: note = chr2:45171836-45171879
  misc_feature 1..43: note = hyper
  source 1..43: mol_type = genomic DNA

SEQ ID NO: 6144 - DNA, 400 bp, Homo sapiens
  misc_feature 1..400: note = chr2:45176601-45177001
  misc_feature 1..400: note = hyper
  source 1..400: mol_type = genomic DNA
ctttgggcggggagacggttcagtgaggcagcgggaaggcccttgcctgggcttgccgagggggctgtgatggtggagtggcccccaggttcttctgcaaggagaataggacagcctggtacattctcgacccagcgcatcacccgggaccccggagctcgaagtccattcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacg

SEQ ID NO: 6145 - DNA, 622 bp, Homo sapiens
  misc_feature 1..622: note = chr2:45179362-45179984
  misc_feature 1..622: note = hyper
  source 1..622: mol_type = genomic DNA
tccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccggcctgtggctgggcccgcactgcctttggtttgttggattttgcgatatttaccataataattaatttgccgccattcaacagaatatcttagcaaggccccttaacgactggaagcgctgctaattccctgcgtatgcgcctctccctctgcagcccgggacaggcgcagccgccttttgcctgcccctacctcgcccgggacacactggcgccgcctggccaggcccgactgggaggaaggacagaggaccgacggacacttgtacatgtgcgggcgcacggaacccaggccccggccaccgctgcctttcccctgtgtgtctgagctgaagcggctacgcttataccgggaggtgaaacgg

SEQ ID NO: 6146 - DNA, 152 bp, Homo sapiens; identical to SEQ ID NO: 1961
  misc_feature 1..152: note = chr2:45181520-45181672
  misc_feature 1..152: note = hyper
  source 1..152: mol_type = genomic DNA

SEQ ID NO: 6147 - DNA, 88 bp, Homo sapiens
  misc_feature 1..88: note = chr2:45181913-45182001
  misc_feature 1..88: note = hyper
  source 1..88: mol_type = genomic DNA
agtggaagcgtggcccgtgagaagggtaccgagggtcagaagtgtcgcaagggacccaggacgcgcgcgcctccgaacccctgagtct

SEQ ID NO: 6148 - DNA, 15 bp, Homo sapiens
  misc_feature 1..15: note = chr2:45231136-45231151
  misc_feature 1..15: note = hyper
  source 1..15: mol_type = genomic DNA
attctgattttatcc

SEQ ID NO: 6149 - DNA, 76 bp, Homo sapiens
  misc_feature 1..76: note = chr2:45231244-45231320
  misc_feature 1..76: note = hyper
  source 1..76: mol_type = genomic DNA
cgcccggccgcggtgccctggtcgctgagggacgcggtcagtacctaccgccactgcgacccgagaagggaaagcc

SEQ ID NO: 6150 - DNA, 143 bp, Homo sapiens
  misc_feature 1..143: note = chr2:45231852-45231995
  misc_feature 1..143: note = hyper
  source 1..143: mol_type = genomic DNA
gtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtaccc

SEQ ID NO: 6151 - DNA, 30 bp, Homo sapiens
  misc_feature 1..30: note = chr2:45233569-45233599
  misc_feature 1..30: note = hyper
  source 1..30: mol_type = genomic DNA
gccgctgccattcagcgggttgtggctgtt

SEQ ID NO: 6152 - DNA, 397 bp, Homo sapiens
  misc_feature 1..397: note = chr2:45235529-45235926
  misc_feature 1..397: note = hyper
  source 1..397: mol_type = genomic DNA
gaaaggcctaagcatcgtccaagtcaggccgggctgccgctgggctgtggccgggcctgggggcccagtttaggcctctccgggggaccggcagaagccctgcgaacccctcccttgggccccggggagctggcgccgaagaaggtctacttactcgtacctttccttggcctcggccgcccggtcgcgctgccgccggttcttgaaccagttgctgacctgtgtggtggtgaggcccgtggcctccgccagctcacgcttctcgcggggtgaagggtaggggttgtgcgcgtaccactcgcgcagcacgctgcgactcttttccttgaagcagtagctggtctcctcgccgtcccagatggagcgcggcagcgggaatttgcggcgcacgcggtat

SEQ ID NO: 6153 - DNA, 38 bp, Homo sapiens
  misc_feature 1..38: note = chr2:45236204-45236242
  misc_feature 1..38: note = hyper
  source 1..38: mol_type = genomic DNA
cgccacttgctcctgcgtgaagccgaaggtgggcagca

SEQ ID NO: 6154 - DNA, 64 bp, Homo sapiens
  misc_feature 1..64: note = chr2:45236460-45236524
  misc_feature 1..64: note = hyper
  source 1..64: mol_type = genomic DNA
cctggcccaagccctcgcccaagcccgggggccgcccggggcgccgctccgcatgctccgcgcc

SEQ ID NO: 6155 - DNA, 27 bp, Homo sapiens
  misc_feature 1..27: note = chr2:45237662-45237689
  misc_feature 1..27: note = hyper
  source 1..27: mol_type = genomic DNA
gtggtggggcttccccggtgggtggtc

SEQ ID NO: 6156 - skipped

SEQ ID NO: 6157 - DNA, 15 bp, Homo sapiens
  misc_feature 1..15: note = chr2:45240616-45240631
  misc_feature 1..15: note = hyper
  source 1..15: mol_type = genomic DNA
cggtctgtcgggtcc

SEQ ID NO: 6158 - DNA, 406 bp, Homo sapiens; identical to SEQ ID NO: 1963
  misc_feature 1..406: note = chr2:45240763-45241169
  misc_feature 1..406: note = hyper
  source 1..406: mol_type = genomic DNA

SEQ ID NO: 6159 - DNA, 215 bp, Homo sapiens; identical to SEQ ID NO: 1964
  misc_feature 1..215: note = chr2:45241232-45241447
  misc_feature 1..215: note = hyper
  source 1..215: mol_type = genomic DNA

SEQ ID NO: 6160 - DNA, 30 bp, Homo sapiens
  misc_feature 1..30: note = chr2:45241753-45241783
  misc_feature 1..30: note = hyper
  source 1..30: mol_type = genomic DNA
agctgggaagtgacccggccaataggagaa

SEQ ID NO: 6161 - DNA, 66 bp, Homo sapiens
  misc_feature 1..66: note = chr2:45395854-45395920
  misc_feature 1..66: note = hyper
  source 1..66: mol_type = genomic DNA
ttgtattttgagaaccgctccctttcccgcacacgcattgctgcctcctctcgggcttggttaatg

SEQ ID NO: 6162 - DNA, 209 bp, Homo sapiens
  misc_feature 1..209: note = chr2:45396160-45396369
  misc_feature 1..209: note = hyper
  source 1..209: mol_type = genomic DNA
gctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaaaccatggcagcattgcggctccggcgggcgggctctgcgcggggccccaccgag

SEQ ID NO: 6163 - DNA, 268 bp, Homo sapiens
  misc_feature 1..268: note = chr2:45396672-45396940
  misc_feature 1..268: note = hyper
  source 1..268: mol_type = genomic DNA
ccgccaccctctgggcgaacggaatggcacccgcggagacgggcggggacgggcgaaagcgggtttgctccgacccgaagctgagcccgggttggagggcgagaccgtaggcgagaatggccgcgcgggctgggagacccgggccggtatggagtgagtggagccgcccgaggtagggtagttggggatggtagttgtgaagacagtcggagtctagctccgggcagacgaaacaccggggcgcgccagggtccgtttcctccttctc

SEQ ID NO: 6164 - DNA, 33 bp, Homo sapiens
  misc_feature 1..33: note = chr2:45397223-45397256
  misc_feature 1..33: note = hyper
  source 1..33: mol_type = genomic DNA
gcgattcccggctgtcggcggtggggctaggcc

SEQ ID NO: 6165 - DNA, 259 bp, Homo sapiens
  misc_feature 1..259: note = chr2:47748235-47748494
  misc_feature 1..259: note = hyper
  source 1..259: mol_type = genomic DNA
agctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaaga

SEQ ID NO: 6166 - DNA, 723 bp, Homo sapiens; identical to SEQ ID NO: 1965
  misc_feature 1..723: note = chr2:47796765-47797488
  misc_feature 1..723: note = hyper
  source 1..723: mol_type = genomic DNA

SEQ ID NO: 6167 - DNA, 474 bp, Homo sapiens; identical to SEQ ID NO: 1966
  misc_feature 1..474: note = chr2:47797489-47797963
  misc_feature 1..474: note = hyper
  source 1..474: mol_type = genomic DNA

SEQ ID NO: 6168 - DNA, 1069 bp, Homo sapiens; identical to SEQ ID NO: 1967
  misc_feature 1..1069: note = chr2:47797964-47799033
  misc_feature 1..1069: note = hyper
  source 1..1069: mol_type = genomic DNA

SEQ ID NO: 6169 - DNA, 56 bp, Homo sapiens; identical to SEQ ID NO: 1968
  misc_feature 1..56: note = chr2:47799123-47799179
  misc_feature 1..56: note = hyper
  source 1..56: mol_type = genomic DNA

SEQ ID NO: 6170 - DNA, 119 bp, Homo sapiens
  misc_feature 1..119: note = chr2:48982582-48982701
  misc_feature 1..119: note = hyper
  source 1..119: mol_type = genomic DNA
gaaggtggcatagagcgatggagggtcctgcatcaagggcgccgcgacgggagcgctgtgtactcacagtcgagtgagaccggccgtggggccggggcagcgcagggcgccgtcgggca

SEQ ID NO: 6171 - DNA, 113 bp, Homo sapiens
  misc_feature 1..113: note = chr2:48982753-48982866
  misc_feature 1..113: note = hyper
  source 1..113: mol_type = genomic DNA
cggctgcagcagcagcagcagcttcagcagctgcagcgccgagaaccgctgcttcatggccggcgaactgggcttctgcggcttgccagtgtcttggacggcctctgagtgcg

SEQ ID NO: 6172 - DNA, 132 bp, Homo sapiens; identical to SEQ ID NO: 1969
  misc_feature 1..132: note = chr2:50573507-50573639
  misc_feature 1..132: note = hyper
  source 1..132: mol_type = genomic DNA

SEQ ID NO: 6173 - DNA, 87 bp, Homo sapiens; identical to SEQ ID NO: 1970
  misc_feature 1..87: note = chr2:50573691-50573778
  misc_feature 1..87: note = hyper
  source 1..87: mol_type = genomic DNA

SEQ ID NO: 6174 - DNA, 95 bp, Homo sapiens; identical to SEQ ID NO: 1971
  misc_feature 1..95: note = chr2:50574218-50574313
  misc_feature 1..95: note = hyper
  source 1..95: mol_type = genomic DNA

SEQ ID NO: 6175 - DNA, 54 bp, Homo sapiens; identical to SEQ ID NO: 163
  misc_feature 1..54: note = chr2:50574631-50574685
  misc_feature 1..54: note = hyper
  source 1..54: mol_type = genomic DNA

SEQ ID NO: 6176 - DNA, 121 bp, Homo sapiens; identical to SEQ ID NO: 164
  misc_feature 1..121: note = chr2:50574738-50574859
  misc_feature 1..121: note = hyper
  source 1..121: mol_type = genomic DNA

SEQ ID NO: 6177 - DNA, 71 bp, Homo sapiens
  misc_feature 1..71: note = chr2:56149951-56150022
  misc_feature 1..71: note = hyper
  source 1..71: mol_type = genomic DNA
cccagtcccacaccccgggggatggaggtggggctgcaaaactctgttctctagaacgttaaggctttccc

SEQ ID NO: 6178 - DNA, 128 bp, Homo sapiens
  misc_feature 1..128: note = chr2:56150227-56150355
  misc_feature 1..128: note = hyper
  source 1..128: mol_type = genomic DNA
aaagtggcatttccacgcctttctctgcgcacagctttgtttaaaagtcccaggttgtgtggaggggcagcccaaagcgactgattctcttttgtcttatcagtctgggtccccgacacgctaccttc

SEQ ID NO: 6179 - DNA, 36 bp, Homo sapiens
  misc_feature 1..36: note = chr2:56150770-56150806
  misc_feature 1..36: note = hyper
  source 1..36: mol_type = genomic DNA
cccacctcactctcccgcgcgcggcccagtgagtac

SEQ ID NO: 6180 - DNA, 63 bp, Homo sapiens
  misc_feature 1..63: note = chr2:56411703-56411766
  misc_feature 1..63: note = hyper
  source 1..63: mol_type = genomic DNA
cttcgggagtcgcctcgcctcttccacccacttgcacctgccaccccgcggataccatgtcga

SEQ ID NO: 6181 - DNA, 34 bp, Homo sapiens
  misc_feature 1..34: note = chr2:58655503-58655537
  misc_feature 1..34: note = hyper
  source 1..34: mol_type = genomic DNA
gtttacatttggcagcgcccgggctgcgccgacc

SEQ ID NO: 6182 - DNA, 199 bp, Homo sapiens
  misc_feature 1..199: note = chr2:58655998-58656197
  misc_feature 1..199: note = hyper
  source 1..199: mol_type = genomic DNA
gcgcgccactcagcccgggaggtggggccgggcagtgaccccgcgcgaagtgccagtgcggagggcgggggtggttaccgaaagatgtaatcccaggaggggccgccgccttcgctgtcccctacctgtaccctctctttatcctaccctccattccccgacccttttctccctctcttctccccgttcttttctactc

SEQ ID NO: 6183 - DNA, 264 bp, Homo sapiens
  misc_feature 1..264: note = chr2:60797078-60797342
  misc_feature 1..264: note = hyper
  source 1..264: mol_type = genomic DNA
cttgtgtagagcctccggtgccctccacctaaccctgccccaatgcctcgggtcttttttgaactaatgctgtgcgtctccgcaatctgcaattactttggatatttctcaggagctaaacgcagcctgaatttcgtggcgcgtgcaaaaaaaaaaaaaaaggcgaaattaacaaaaccccaccaccgcgctgttgtttttttctggagtttttttttttttttttttttagttcggttcagaagcaaacgctacctagtttct

SEQ ID NO: 6184 - DNA, 276 bp, Homo sapiens
  misc_feature 1..276: note = chr2:60962755-60963031
  misc_feature 1..276: note = hyper
  source 1..276: mol_type = genomic DNA
cagctcttggcggtgcgccacaggaactctccggtggtcgggttgtagatgaagagcttccactcggcgaggctctggttgagggactccttcttcatcgtgtgcgcgcggacgacgaggggagcggcggccgcggggacggaggcggcgagggcagcggggacgggggcggcgagggcagcggggacggaggaggcgagggcagcggaggcgcgtcccggctccggcggcgcagcccggcgacggcaggggagggtgggacgaccgagaacacct

SEQ ID NO: 6185 - DNA, 30 bp, Homo sapiens
  misc_feature 1..30: note = chr2:62798382-62798412
  misc_feature 1..30: note = hyper
  source 1..30: mol_type = genomic DNA
gccgcgtgactcacccgtgtccctcgctct

SEQ ID NO: 6186 - DNA, 147 bp, Homo sapiens; identical to SEQ ID NO: 165
  misc_feature 1..147: note = chr2:63275877-63276024
  misc_feature 1..147: note = hyper
  source 1..147: mol_type = genomic DNA

SEQ ID NO: 6187 - DNA, 67 bp, Homo sapiens
  misc_feature 1..67: note = chr2:63276425-63276492
  misc_feature 1..67: note = hyper
  source 1..67: mol_type = genomic DNA
gatcaacaaaagaaccgaccaaagccttattaaaggtcctaagaagatctcccgggtcctttgagaa

SEQ ID NO: 6188 - DNA, 291 bp, Homo sapiens
  misc_feature 1..291: note = chr2:63278731-63279022
  misc_feature 1..291: note = hyper
  source 1..291: mol_type = genomic DNA
agtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggccccaggcccagtttccagcgcccctccctgacccctgagagtggcaccccgggttcccggcag

SEQ ID NO: 6189 - DNA, 699 bp, Homo sapiens; identical to SEQ ID NO: 166
  misc_feature 1..699: note = chr2:63280952-63281651
  misc_feature 1..699: note = hyper
  source 1..699: mol_type = genomic DNA

SEQ ID NO: 6190 - DNA, 91 bp, Homo sapiens
  misc_feature 1..91: note = chr2:63284752-63284843
  misc_feature 1..91: note = hyper
  source 1..91: mol_type = genomic DNA
tttttagtgcaccttcgttctccgaaatctgcggagagcccgcgcgcctgtgtatcaattttggctttggccgcttcgtccagtaggtggg

SEQ ID NO: 6191 - DNA, 493 bp, Homo sapiens; identical to SEQ ID NO: 167
  misc_feature 1..493: note = chr2:63285117-63285610
  misc_feature 1..493: note = hyper
  source 1..493: mol_type = genomic DNA

SEQ ID NO: 6192 - DNA, 227 bp, Homo sapiens; identical to SEQ ID NO: 168
  misc_feature 1..227: note = chr2:63286358-63286585
  misc_feature 1..227: note = hyper
  source 1..227: mol_type = genomic DNA

SEQ ID NO: 6193 - DNA, 55 bp, Homo sapiens; identical to SEQ ID NO: 169
  misc_feature 1..55: note = chr2:63286693-63286748
  misc_feature 1..55: note = hyper
  source 1..55: mol_type = genomic DNA

SEQ ID NO: 6194 - DNA, 236 bp, Homo sapiens; identical to SEQ ID NO: 170
  misc_feature 1..236: note = chr2:63287082-63287318
  misc_feature 1..236: note = hyper
  source 1..236: mol_type = genomic DNA

SEQ ID NO: 6195 - DNA, 163 bp, Homo sapiens
  misc_feature 1..163: note = chr2:64836470-64836633
  misc_feature 1..163: note = hyper
  source 1..163: mol_type = genomic DNA
cggccgctcccccggagccacgcgagccggtcgtggcggctggacccgagcctgggagcctgcaggcggccgcgccgcgctgcgctgccgaaccgcccggagccgcaggtccgccgcccgcccgctcgggggcgccccagcttccggcctccggcggcttccg

SEQ ID NO: 6196 - DNA, 37 bp, Homo sapiens
  misc_feature 1..37: note = chr2:66653429-66653466
  misc_feature 1..37: note = hyper
  source 1..37: mol_type = genomic DNA
ctcggaggagatgagcgcaccccggggctcattgctg

SEQ ID NO: 6197 - DNA, 92 bp, Homo sapiens
  misc_feature 1..92: note = chr2:66653842-66653934
  misc_feature 1..92: note = hyper
  source 1..92: mol_type = genomic DNA
agtcccccaaacctacgtccctgcgccaaaccaggtgcgagcaaactccgcggaccccgcagctggaagtgcatcctgccgggacccccacc

SEQ ID NO: 6198 - DNA, 176 bp, Homo sapiens
  misc_feature 1..176: note = chr2:66659986-66660162
  misc_feature 1..176: note = hyper
  source 1..176: mol_type = genomic DNA
aaggttttgggagaacgtgtgtcagcccttcaggcacacagggtgccagtacggagttgggggcggggaagggtgcagtgcaggcggctgggaaggctcatctgctcggctttatggaaacgctccactgttgggggcaaccaaccccgcgttgactcctgcgaagtgctaaagga

SEQ ID NO: 6199 - DNA, 76 bp, Homo sapiens
  misc_feature 1..76: note = chr2:66660603-66660679
  misc_feature 1..76: note = hyper
  source 1..76: mol_type = genomic DNA
ataattgattttccccgcagccaatgcgcggcggcctgggcgggggcgcctcctgattggccgagcactcctccac

SEQ ID NO: 6200 - DNA, 66 bp, Homo sapiens
  misc_feature 1..66: note = chr2:66802875-66802941
  misc_feature 1..66: note = hyper
  source 1..66: mol_type = genomic DNA
ttgaagtgagccaggcgggcgagtttcgccccggggaaaagagcccccagccgagcccgggggcaa

SEQ ID NO: 6201 - DNA, 58 bp, Homo sapiens; identical to SEQ ID NO: 171
  misc_feature 1..58: note = chr2:66808576-66808634
  misc_feature 1..58: note = hyper
  source 1..58: mol_type = genomic DNA

SEQ ID NO: 6202 - DNA, 665 bp, Homo sapiens; identical to SEQ ID NO: 172
  misc_feature 1..665: note = chr2:66808726-66809391
  misc_feature 1..665: note = hyper
  source 1..665: mol_type = genomic DNA

SEQ ID NO: 6203 - DNA, 268 bp, Homo sapiens; identical to SEQ ID NO: 173
  misc_feature 1..268: note = chr2:68546249-68546517
  misc_feature 1..268: note = hyper
  source 1..268: mol_type = genomic DNA

SEQ ID NO: 6204 - DNA, 361 bp, Homo sapiens; identical to SEQ ID NO: 174
  misc_feature 1..361: note = chr2:68546552-68546913
  misc_feature 1..361: note = hyper
  source 1..361: mol_type = genomic DNA

SEQ ID NO: 6205 - DNA, 67 bp, Homo sapiens
  misc_feature 1..67: note = chr2:68870366-68870433
  misc_feature 1..67: note = hyper
  source 1..67: mol_type = genomic DNA
ggtcctttgcaagctcgcggctgagcggggccgtgtccgtccactccgacggcgctgggctgccaag

SEQ ID NO: 6206 - DNA, 121 bp, Homo sapiens
  misc_feature 1..121: note = chr2:68870917-68871038
  misc_feature 1..121: note = hyper
  source 1..121: mol_type = genomic DNA
ctcctgatccggccccggaataagaaacccggaccttgcctgccgggctccgcgatgccgcaggtacagagcgcgccctcccggggaggatgctccagggaccccgcgctgcactggctgc

SEQ ID NO: 6207 - DNA, 105 bp, Homo sapiens
  misc_feature 1..105: note = chr2:69240500-69240605
  misc_feature 1..105: note = hyper
  source 1..105: mol_type = genomic DNA
ggagttgcgagggagcgagggggaataaaggacccgcgaggaagggcccgcggatggcgcgtccctgagggtcgtggcgagttcgcggagcgtgggaaggagcgg

SEQ ID NO: 6208 - DNA, 64 bp, Homo sapiens
  misc_feature 1..64: note = chr2:69533671-69533735
  misc_feature 1..64: note = hyper
  source 1..64: mol_type = genomic DNA
cacgcccacctggggcggtggtccagccgccaggaacccgcttcccagccgctccccctcacgc

SEQ ID NO: 6209 - DNA, 856 bp, Homo sapiens; identical to SEQ ID NO: 1984
  misc_feature 1..856: note = chr2:71503452-71504308
  misc_feature 1..856: note = hyper
  source 1..856: mol_type = genomic DNA

SEQ ID NO: 6210 - DNA, 146 bp, Homo sapiens
  misc_feature 1..146: note = chr2:71681047-71681193
  misc_feature 1..146: note = hyper
  source 1..146: mol_type = genomic DNA
ccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgc

SEQ ID NO: 6211 - DNA, 30 bp, Homo sapiens
  misc_feature 1..30: note = chr2:71694331-71694361
  misc_feature 1..30: note = hyper
  source 1..30: mol_type = genomic DNA
agaggaaataaagtccgagcttttactggg

SEQ ID NO: 6212 - DNA, 127 bp, Homo sapiens
  misc_feature 1..127: note = chr2:72374563-72374690
  misc_feature 1..127: note = hyper
  source 1..127: mol_type = genomic DNA
cgggcgccagtggtcccggaaccgcgctgccggcgggctggggaagcccgggctgctgcggcagagaggagggaaggggcggggcggggaccagtgccttcaggctcccggcgccccctggccggcc

SEQ ID NO: 6213 - DNA, 52 bp, Homo sapiens
  misc_feature 1..52: note = chr2:72374713-72374765
  misc_feature 1..52: note = hyper
  source 1..52: mol_type = genomic DNA
cgcagctagcggaccccggagtgcagcggagcgagcgcgcccttacctgcag

SEQ ID NO: 6214 - DNA, 58 bp, Homo sapiens
  misc_feature 1..58: note = chr2:73142033-73142091
  misc_feature 1..58: note = hyper
  source 1..58: mol_type = genomic DNA
actcctatcacccagcgcattccagcaccccctccccctcccccgggaagtctgcgac

SEQ ID NO: 6215 - DNA, 30 bp, Homo sapiens
  misc_feature 1..30: note = chr2:73143902-73143932
  misc_feature 1..30: note = hyper
  source 1..30: mol_type = genomic DNA
gagcctcagagaaggcgagggggtggatct

SEQ ID NO: 6216 - DNA, 139 bp, Homo sapiens
  misc_feature 1..139: note = chr2:73145555-73145694
  misc_feature 1..139: note = hyper
  source 1..139: mol_type = genomic DNA
gatgcgggggaggctcgggggcgcgcggggctgtttagaagttactgccgggaaggctgcaggtccgcggaggtagattcccaggcagggaagagctgtgcggcatccacccgcgccttcgccgcgtaggtctccctcc

SEQ ID NO: 6217 - DNA, 30 bp, Homo sapiens
  misc_feature 1..30: note = chr2:73146224-73146254
  misc_feature 1..30: note = hyper
  source 1..30: mol_type = genomic DNA
gagggcttttaaggtcgtagccagtccgaa

SEQ ID NO: 6218 - DNA, 139 bp, Homo sapiens; identical to SEQ ID NO: 175
  misc_feature 1..139: note = chr2:73147389-73147528
  misc_feature 1..139: note = hyper
  source 1..139: mol_type = genomic DNA

SEQ ID NO: 6219 - DNA, 101 bp, Homo sapiens; identical to SEQ ID NO: 176
  misc_feature 1..101: note = chr2:73147966-73148067
  misc_feature 1..101: note = hyper
  source 1..101: mol_type = genomic DNA

SEQ ID NO: 6220 - DNA, 19 bp, Homo sapiens
  misc_feature 1..19: note = chr2:73148174-73148193
  misc_feature 1..19: note = hyper
  source 1..19: mol_type = genomic DNA
cgtccggccctgagcccct

SEQ ID NO: 6221 - DNA, 616 bp, Homo sapiens; identical to SEQ ID NO: 1988
  misc_feature 1..616: note = chr2:73151215-73151831
  misc_feature 1..616: note = hyper
  source 1..616: mol_type = genomic DNA

SEQ ID NO: 6222 - DNA, 53 bp, Homo sapiens
  misc_feature 1..53: note = chr2:73152398-73152451
  misc_feature 1..53: note = hyper
  source 1..53: mol_type = genomic DNA
gaaattaacaattaccgtgtagtgtttttgtaactgatcgttaatttaaggga

SEQ ID NO: 6223 - DNA, 15 bp, Homo sapiens
  misc_feature 1..15: note = chr2:73152739-73152754
  misc_feature 1..15: note = hyper
  source 1..15: mol_type = genomic DNA
cgaccctactacacc

SEQ ID NO: 6224 - DNA, 36 bp, Homo sapiens
  misc_feature 1..36: note = chr2:73152959-73152995
  misc_feature 1..36: note = hyper
  source 1..36: mol_type = genomic DNA
acttaatctacaaatcgctcacgggtcggaggcagg

SEQ ID NO: 6225 - DNA, 43 bp, Homo sapiens
  misc_feature 1..43: note = chr2:73429571-73429614
  misc_feature 1..43: note = hyper
  source 1..43: mol_type = genomic DNA
gtgcccaccttgcctcgcacagagcgggcgctcacaggctttg

SEQ ID NO: 6226 - DNA, 23 bp, Homo sapiens
  misc_feature 1..23: note = chr2:73429976-73429999
  misc_feature 1..23: note = hyper
  source 1..23: mol_type = genomic DNA
cgcgccggcggcctcccagccgt

SEQ ID NO: 6227 - DNA, 271 bp, Homo sapiens; identical to SEQ ID NO: 178
  misc_feature 1..271: note = chr2:73430485-73430756
  misc_feature 1..271: note = hyper
  source 1..271: mol_type = genomic DNA

SEQ ID NO: 6228 - DNA, 32 bp, Homo sapiens
  misc_feature 1..32: note = chr2:73512107-73512139
  misc_feature 1..32: note = hyper
  source 1..32: mol_type = genomic DNA
cattcctagggaacccgcggaactgctgctgg

SEQ ID NO: 6229 - DNA, 731 bp, Homo sapiens; identical to SEQ ID NO: 179
  misc_feature 1..731: note = chr2:73518261-73518992
  misc_feature 1..731: note = hyper
  source 1..731: mol_type = genomic DNA

SEQ ID NO: 6230 - DNA, 59 bp, Homo sapiens
  misc_feature 1..59: note = chr2:73519211-73519270
  misc_feature 1..59: note = hyper
  source 1..59: mol_type = genomic DNA
ctcccctaagtcacccggggccagcgggaaagcgtcataggccccgctgggatagagtc

SEQ ID NO: 6231 - DNA, 252 bp, Homo sapiens; identical to SEQ ID NO: 1991
  misc_feature 1..252: note = chr2:73519523-73519775
  misc_feature 1..252: note = hyper
  source 1..252: mol_type = genomic DNA

SEQ ID NO: 6232 - DNA, 151 bp, Homo sapiens
  misc_feature 1..151: note = chr2:73520242-73520393
  misc_feature 1..151: note = hyper
  source 1..151: mol_type = genomic DNA
ttctcaggtatggtgcgcccccgcgctgcgccgtcgtcgtctgagcacccctgctcgccctccttacctccagggtagccggtggccgcgggagcgtccctggcaggcagccggggcaattcagcgctgggttcggcgcaacagccttcag

SEQ ID NO: 6233 - DNA, 44 bp, Homo sapiens
  misc_feature 1..44: note = chr2:74726199-74726243
  misc_feature 1..44: note = hyper
  source 1..44: mol_type = genomic DNA
aacagagcaacaggtcgctcagttggcgacggtctgcccttttc

SEQ ID NO: 6234 - DNA, 257 bp, Homo sapiens; identical to SEQ ID NO: 1992
  misc_feature 1..257: note = chr2:74740879-74741136
  misc_feature 1..257: note = hyper
  source 1..257: mol_type = genomic DNA

SEQ ID NO: 6235 - DNA, 339 bp, Homo sapiens; identical to SEQ ID NO: 1993
  misc_feature 1..339: note = chr2:74741137-74741476
  misc_feature 1..339: note = hyper
  source 1..339: mol_type = genomic DNA

SEQ ID NO: 6236 - DNA, 70 bp, Homo sapiens; identical to SEQ ID NO: 1994
  misc_feature 1..70: note = chr2:74741775-74741845
  misc_feature 1..70: note = hyper
  source 1..70: mol_type = genomic DNA

SEQ ID NO: 6237 - DNA, 83 bp, Homo sapiens; identical to SEQ ID NO: 1995
  misc_feature 1..83: note = chr2:74741872-74741955
  misc_feature 1..83: note = hyper
  source 1..83: mol_type = genomic DNA

SEQ ID NO: 6238 - DNA, 324 bp, Homo sapiens; identical to SEQ ID NO: 180
  misc_feature 1..324: note = chr2:74742324-74742648
  misc_feature 1..324: note = hyper
  source 1..324: mol_type = genomic DNA

SEQ ID NO: 6239 - DNA, 452 bp, Homo sapiens; identical to SEQ ID NO: 181
  misc_feature 1..452: note = chr2:74742693-74743145
  misc_feature 1..452: note = hyper
  source 1..452: mol_type = genomic DNA

SEQ ID NO: 6240 - skipped

SEQ ID NO: 6241 - DNA, 15 bp, Homo sapiens
  misc_feature 1..15: note = chr2:74782073-74782088
  misc_feature 1..15: note = hyper
  source 1..15: mol_type = genomic DNA
tgctttgcacactcc

SEQ ID NO: 6242 - DNA, 53 bp, Homo sapiens
  misc_feature 1..53: note = chr2:74782218-74782271
  misc_feature 1..53: note = hyper
  source 1..53: mol_type = genomic DNA
cgtcgggacccgggccgcctgcgcacgccactccctctcgagcactctctctc

SEQ ID NO: 6243 - DNA, 67 bp, Homo sapiens
  misc_feature 1..67: note = chr2:75426808-75426875
  misc_feature 1..67: note = hyper
  source 1..67: mol_type = genomic DNA
ctgcttgctacttgccgtgggagtctgcgagccgggagccccacgcactccgcgagggggcagtagg

SEQ ID NO: 6244 - DNA, 229 bp, Homo sapiens
  misc_feature 1..229: note = chr2:75427814-75428043
  misc_feature 1..229: note = hyper
  source 1..229: mol_type = genomic DNA
ctgcaggcagagttccgcggaaaactgaaccccgggagtcctcaggggcccatctaccccggtgcaccgccccctcctttcactgcggggactcggagctgtgggactggagcgcgcaccggcagacttgcgcgcaggttggagttggcgcacacccgcgccagccggggagcggcgtttacgcactggtaccgcgagcgctcaaagcatctctcgggaagtgctttaa

SEQ ID NO: 6245 - DNA, 264 bp, Homo sapiens
  misc_feature 1..264: note = chr2:75787807-75788071
  misc_feature 1..264: note = hyper
  source 1..264: mol_type = genomic DNA
ttgctggggccccggcgcgcacttccggggactgcgcttggggcgcgcggggccgagcagggggacccggagctgatcactgaggggcggacacgacaaagcgctgcccgggtcttgggccggcaccagtacctcggaaaggaatcccggcggaggggccgccggggtcagggctggcctggggatgtggggtcccggcctgggtgctcacggacggcggcgccaagccccgcagaagctgcaggagcccgagtcagtgggagg

SEQ ID NO: 6246 - DNA, 136 bp, Homo sapiens
  misc_feature 1..136: note = chr2:79740169-79740305
  misc_feature 1..136: note = hyper
  source 1..136: mol_type = genomic DNA
ggcgggcagagcaggcggcaccgcacctcggccagaggcggctgcagcagctgctgcccttgtccctgccgccgcctctccagtcccttctgtgattaccactccagctgctgggaacgggcgagaaagaggagga

SEQ ID NO: 6247 - DNA, 270 bp, Homo sapiens; identical to SEQ ID NO: 1999
  misc_feature 1..270: note = chr2:80529985-80530255
  misc_feature 1..270: note = hyper
  source 1..270: mol_type = genomic DNA

SEQ ID NO: 6248 - DNA, 66 bp, Homo sapiens; identical to SEQ ID NO: 2000
  misc_feature 1..66: note = chr2:80530256-80530322
  misc_feature 1..66: note = hyper
  source 1..66: mol_type = genomic DNA

SEQ ID NO: 6249 - DNA, 15 bp, Homo sapiens
  misc_feature 1..15: note = chr2:80530572-80530587
  misc_feature 1..15: note = hyper
  source 1..15: mol_type = genomic DNA
ctggttggaactcag

SEQ ID NO: 6250 - DNA, 39 bp, Homo sapiens
  misc_feature 1..39: note = chr2:80531574-80531613
  misc_feature 1..39: note = hyper
  source 1..39: mol_type = genomic DNA
aaaaaactccaaactcggggctcgcgactccccaggatc

SEQ ID NO: 6251 - DNA, 192 bp, Homo sapiens
  misc_feature 1..192: note = chr2:80531821-80532013
  misc_feature 1..192: note = hyper
  source 1..192: mol_type = genomic DNA
ccaccaggcagtgtgcggcgcgagcttgcacaggcacctactgctcactgagtgtcgtaagctgctcacgattgtgcgtcttccccgagcacctcagacatgggcagattgaaaaggggtgggcataaaaccaacattttaccgaaccactaaagtaatatatgttttttgatgaaacggaaaacactttca

SEQ ID NO: 6252 - DNA, 148 bp, Homo sapiens
  misc_feature 1..148: note = chr2:80549571-80549719
  misc_feature 1..148: note = hyper
  source 1..148: mol_type = genomic DNA
cacaattcgggcccacgtagacttaatcccgagaggcaattgttcccttgcttgggcggctacgctccccgcggggctgcctgcagcccccgggcccttgcagctccgggacggcgcgcggcggcggaggccgcggggccccaagcgc

SEQ ID NO: 6253 - DNA, 52 bp, Homo sapiens; identical to SEQ ID NO: 2001
  misc_feature 1..52: note = chr2:85107454-85107506
  misc_feature 1..52: note = hyper
  source 1..52: mol_type = genomic DNA

SEQ ID NO: 6254 - DNA, 15 bp, Homo sapiens
  misc_feature 1..15: note = chr2:85361295-85361310
  misc_feature 1..15: note = hyper
  source 1..15: mol_type = genomic DNA
cgcacccttgccctc

SEQ ID NO: 6255 - DNA, 63 bp, Homo sapiens
  misc_feature 1..63: note = chr2:85361466-85361529
  misc_feature 1..63: note = hyper
  source 1..63: mol_type = genomic DNA
cgttctttaaaggacccccgtaccctgggtaccccttcctgatgatcccggacctgagcagcc

SEQ ID NO: 6256 - DNA, 187 bp, Homo sapiens; identical to SEQ ID NO: 2002
  misc_feature 1..187: note = chr2:87016593-87016780
  misc_feature 1..187: note = hyper
  source 1..187: mol_type = genomic DNA

SEQ ID NO: 6257 - DNA, 451 bp, Homo sapiens; identical to SEQ ID NO: 2003
  misc_feature 1..451: note = chr2:87017729-87018180
  misc_feature 1..451: note = hyper
  source 1..451: mol_type = genomic DNA

SEQ ID NO: 6258 - DNA, 302 bp, Homo sapiens
  misc_feature 1..302: note = chr2:87088727-87089029
  misc_feature 1..302: note = hyper
  source 1..302: mol_type = genomic DNA
agtccaggggctctccggtcccccggggtaatgcgatatgggggtattttatttccacccttagggaccgtgcctgccaagctgcctcccgggcgccccgccaccgcgggctcgacgctgcaccctgccaggaccagggccaggacagccacttatcacctccccgctcaggccccgggagcgcagacccttgggtagcccgcgcgccgccgccttacctgtcagctgcgcggccaagaggagccacagccgcggccgcatcgtggcgcgcccgggacacctggccccgggggctcggcgga

SEQ ID NO: 6259 - DNA, 139 bp, Homo sapiens; identical to SEQ ID NO: 2004
  misc_feature 1..139: note = chr2:88751281-88751420
  misc_feature 1..139: note = hyper
  source 1..139: mol_type = genomic DNA

SEQ ID NO: 6260 - DNA, 356 bp, Homo sapiens; identical to SEQ ID NO: 2005
  misc_feature 1..356: note = chr2:88751460-88751816
  misc_feature 1..356: note = hyper
  source 1..356: mol_type = genomic DNA

SEQ ID NO: 6261 - DNA, 498 bp, Homo sapiens; identical to SEQ ID NO: 2006
  misc_feature 1..498: note = chr2:88751942-88752440
  misc_feature 1..498: note = hyper
  source 1..498: mol_type = genomic DNA

SEQ ID NO: 6262 - DNA, 69 bp, Homo sapiens; identical to SEQ ID NO: 183
  misc_feature 1..69: note = chr2:88752716-88752785
  misc_feature 1..69: note = hyper
  source 1..69: mol_type = genomic DNA

SEQ ID NO: 6263 - DNA, 171 bp, Homo sapiens; identical to SEQ ID NO: 184
  misc_feature 1..171: note = chr2:89064805-89064976
  misc_feature 1..171: note = hyper
  source 1..171: mol_type = genomic DNA

SEQ ID NO: 6264 - DNA, 350 bp, Homo sapiens; identical to SEQ ID NO: 185
  misc_feature 1..350: note = chr2:89065128-89065478
  misc_feature 1..350: note = hyper
  source 1..350: mol_type = genomic DNA

SEQ ID NO: 6265 - DNA, 146 bp, Homo sapiens
  misc_feature 1..146: note = chr2:91635198-91635344
  misc_feature 1..146: note = hyper
  source 1..146: mol_type = genomic DNA
gccgctttttgcccccgccgccgcgggtttttgcccccgcccccgttgctttttacccccgccgccgcggctttctgcccctgccgacgagggtttttgcggctttatatccccgctgtcatggctttttgcggccgtggcttttt

SEQ ID NO: 6266 - DNA, 30 bp, Homo sapiens
  misc_feature 1..30: note = chr2:95664061-95664091
  misc_feature 1..30: note = hyper
  source 1..30: mol_type = genomic DNA
ccttgaaggcacctgcgcagggggacccgc

SEQ ID NO: 6267 - DNA, 30 bp, Homo sapiens
  misc_feature 1..30: note = chr2:95690763-95690793
  misc_feature 1..30: note = hyper
  source 1..30: mol_type = genomic DNA
gcatggattcaaggccgacctgccccagca

SEQ ID NO: 6268 - DNA, 474 bp, Homo sapiens; identical to SEQ ID NO: 2010
  misc_feature 1..474: note = chr2:95691026-95691500
  misc_feature 1..474: note = hyper
  source 1..474: mol_type = genomic DNA

SEQ ID NO: 6269 - DNA, 218 bp, Homo sapiens; identical to SEQ ID NO: 2011
  misc_feature 1..218: note = chr2:95691501-95691719
  misc_feature 1..218: note = hyper
  source 1..218: mol_type = genomic DNA

SEQ ID NO: 6270 - DNA, 290 bp, Homo sapiens
  misc_feature 1..290: note = chr2:95692020-95692310
  misc_feature 1..290: note = hyper
  source 1..290: mol_type = genomic DNA
caagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggc

SEQ ID NO: 6271 - DNA, 59 bp, Homo sapiens
  misc_feature 1..59: note = chr2:96012452-96012511
  misc_feature 1..59: note = hyper
  source 1..59: mol_type = genomic DNA
tggccgtccgcgctgcgtttcgcgccgccgccgccgccgcgcctcgaagtttgccggct

SEQ ID NO: 6272 - DNA, 44 bp, Homo sapiens
  misc_feature 1..44: note = chr2:96781940-96781984
  misc_feature 1..44: note = hyper
  source 1..44: mol_type = genomic DNA
gacgacagcgctgcccggctcggctagacaagagcgtcgcccct

SEQ ID NO: 6273 - DNA, 137 bp, Homo sapiens
  misc_feature 1..137: note = chr2:96782022-96782159
  misc_feature 1..137: note = hyper
  source 1..137: mol_type = genomic DNA
cgagcggggcctaggaggtcgggaacacccaggaccagcagccgccctcctacatcctcctccaccggtgcccggggtccctgccgtccgccccagagaagtttcccaagttgtcccgccgccgtccccgtcccgcc

SEQ ID NO: 6274 - DNA, 418 bp, Homo sapiens; identical to SEQ ID NO: 2012
  misc_feature 1..418: note = chr2:96990898-96991316
  misc_feature 1..418: note = hyper
  source 1..418: mol_type = genomic DNA

SEQ ID NO: 6275 - DNA, 15 bp, Homo sapiens
  misc_feature 1..15: note = chr2:97193049-97193064
  misc_feature 1..15: note = hyper
  source 1..15: mol_type = genomic DNA
cggcagcagagcctg

SEQ ID NO: 6276 - DNA, 386 bp, Homo sapiens; identical to SEQ ID NO: 187
  misc_feature 1..386: note = chr2:97193251-97193637
  misc_feature 1..386: note = hyper
  source 1..386: mol_type = genomic DNA

SEQ ID NO: 6277 - DNA, 71 bp, Homo sapiens; identical to SEQ ID NO: 188
  misc_feature 1..71: note = chr2:98963337-98963408
  misc_feature 1..71: note = hyper
  source 1..71: mol_type = genomic DNA

SEQ ID NO: 6278 - DNA, 417 bp, Homo sapiens; identical to SEQ ID NO: 189
  misc_feature 1..417: note = chr2:98963409-98963826
  misc_feature 1..417: note = hyper
  source 1..417: mol_type = genomic DNA

SEQ ID NO: 6279 - DNA, 325 bp, Homo sapiens; identical to SEQ ID NO: 190
  misc_feature 1..325: note = chr2:98963868-98964193
  misc_feature 1..325: note = hyper
  source 1..325: mol_type = genomic DNA

SEQ ID NO: 6280 - DNA, 84 bp, Homo sapiens
  misc_feature 1..84: note = chr2:98964634-98964718
  misc_feature 1..84: note = hyper
  source 1..84: mol_type = genomic DNA
cttcctcttcagcctcggttcagccacagagaggggcctcctcctgtgtagatgcccggaggggaggagcggtggttcttgggg

SEQ ID NO: 6281 - DNA, 139 bp, Homo sapiens; identical to SEQ ID NO: 191
  misc_feature 1..139: note = chr2:99439368-99439507
  misc_feature 1..139: note = hyper
  source 1..139: mol_type = genomic DNA

SEQ ID NO: 6282 - DNA, 62 bp, Homo sapiens
  misc_feature 1..62: note = chr2:99553419-99553481
  misc_feature 1..62: note = hyper
  source 1..62: mol_type = genomic DNA
gctgccttgggtggtcgcccagcgaatctcctccggagcccgagccgcggctttggtctgcg

SEQ ID NO: 6283 - DNA, 136 bp, Homo sapiens
  misc_feature 1..136: note = chr2:100720916-100721052
  misc_feature 1..136: note = hyper
  source 1..136: mol_type = genomic DNA
ggtgggaggtgtcagcgtcgccgccgccgctaccgccgccgccgaggctcgggccgcccgcgcgctgcaacgaaaggcgccgctcaaggtgcatcccagccgcgccagagcggccgccgcccgcccaccgcccacc

SEQ ID NO: 6284 - DNA, 374 bp, Homo sapiens
  misc_feature 1..374: note = chr2:100937836-100938210
  misc_feature 1..374: note = hyper
  source 1..374: mol_type = genomic DNA
caggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctc

SEQ ID NO: 6285 - DNA, 216 bp, Homo sapiens
  misc_feature 1..216: note = chr2:100938329-100938545
  misc_feature 1..216: note = hyper
  source 1..216: mol_type = genomic DNA
cggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggct

SEQ ID NO: 6286 - DNA, 225 bp, Homo sapiens
  misc_feature 1..225: note = chr2:100938574-100938799
  misc_feature 1..225: note = hyper
  source 1..225: mol_type = genomic DNA
cgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggcc

SEQ ID NO: 6287 - DNA, 10 bp, Homo sapiens
  misc_feature 1..10: note = chr2:100938800-100938810
  misc_feature 1..10: note = hyper
  source 1..10: mol_type = genomic DNA
ggacaggcac

SEQ ID NO: 6288 - DNA, 178 bp, Homo sapiens
  misc_feature 1..178: note = chr2:100938984-100939162
  misc_feature 1..178: note = hyper
  source 1..178: mol_type = genomic DNA
cgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatcacgcatctctagcttc

SEQ ID NO: 6289 - DNA, 170 bp, Homo sapiens
  misc_feature 1..170: note = chr2:101034025-101034195
  misc_feature 1..170: note = hyper
  source 1..170: mol_type = genomic DNA
cggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtgggga

SEQ ID NO: 6290 - DNA, 30 bp, Homo sapiens
  misc_feature 1..30: note = chr2:102090404-102090434
  misc_feature 1..30: note = hyper
  source 1..30: mol_type = genomic DNA
cgggaagggtgacaacggggaagtcacaga

SEQ ID NO: 6291 - DNA, 53 bp, Homo sapiens
  misc_feature 1..53: note = chr2:102090961-102091014
  misc_feature 1..53: note = hyper
  source 1..53: mol_type = genomic DNA
gccccgccgaggatgcgcggaccccgccctgcatcctgcggtgtgggctggag

SEQ ID NO: 6292 - DNA, 178 bp, Homo sapiens; identical to SEQ ID NO: 192
  misc_feature 1..178: note = chr2:105458974-105459152
  misc_feature 1..178: note = hyper
  source 1..178: mol_type = genomic DNA

SEQ ID NO: 6293 - DNA, 361 bp, Homo sapiens; identical to SEQ ID NO: 193
  misc_feature 1..361: note = chr2:105459902-105460263
  misc_feature 1..361: note = hyper
  source 1..361: mol_type = genomic DNA

SEQ ID NO: 6294 - DNA, 247 bp, Homo sapiens; identical to SEQ ID NO: 194
  misc_feature 1..247: note = chr2:105460264-105460511
  misc_feature 1..247: note = hyper
  source 1..247: mol_type = genomic DNA

SEQ ID NO: 6295 - DNA, 30 bp, Homo sapiens
  misc_feature 1..30: note = chr2:105460921-105460951
  misc_feature 1..30: note = hyper
  source 1..30: mol_type = genomic DNA
ggagagggtgatacacgttcacacaccgct

SEQ ID NO: 6296 - DNA, 108 bp, Homo sapiens
  misc_feature 1..108: note = chr2:105461166-105461274
  misc_feature 1..108: note = hyper
  source 1..108: mol_type = genomic DNA
ccggtgggcagccctcgacccggggcgcgtccacagcgcccacccgcggcccccaaacacctcgagagcagatcttaggggttaaccaggcaccgacctgaggcgccc

SEQ ID NO: 6297 - DNA, 113 bp, Homo sapiens; identical to SEQ ID NO: 2022
  misc_feature 1..113: note = chr2:105461555-105461668
  misc_feature 1..113: note = hyper
  source 1..113: mol_type = genomic DNA

SEQ ID NO: 6298 - DNA, 84 bp, Homo sapiens; identical to SEQ ID NO: 2023
  misc_feature 1..84: note = chr2:105461699-105461783
  misc_feature 1..84: note = hyper
  source 1..84: mol_type = genomic DNA

SEQ ID NO: 6299 - DNA, 30 bp, Homo sapiens
  misc_feature 1..30: note = chr2:105468569-105468599
  misc_feature 1..30: note = hyper
  source 1..30: mol_type = genomic DNA
atacatatacgcatacgtaaatataaaaag

SEQ ID NO: 6300 - DNA, 195 bp, Homo sapiens
  misc_feature 1..195: note = chr2:105468836-105469031
  misc_feature 1..195: note = hyper
  source 1..195: mol_type = genomic DNA
gagttcacttaactgcgctcggcagaggcacgatacagcgggagagaagggcaggcccgttcacattttaatcggagcgcaccggcggccgctcctcggctgcgtcctgggctgccgctcgggctcgggactgccagatgcaggctctggctgggggcggcgggcgcaagcgggcgcacccgcagctaggggtgc

SEQ ID NO: 6301 - DNA, 212 bp, Homo sapiens; identical to SEQ ID NO: 2024
  misc_feature 1..212: note = chr2:105469645-105469857
  misc_feature 1..212: note = hyper
  source 1..212: mol_type = genomic DNA

SEQ ID NO: 6302 - DNA, 681 bp, Homo sapiens; identical to SEQ ID NO: 2025
  misc_feature 1..681: note = chr2:105469880-105470561
  misc_feature 1..681: note = hyper
  source 1..681: mol_type = genomic DNA

SEQ ID NO: 6303 - DNA, 246 bp, Homo sapiens; identical to SEQ ID NO: 2026
  misc_feature 1..246: note = chr2:105470562-105470808
  misc_feature 1..246: note = hyper
  source 1..246: mol_type = genomic DNA

SEQ ID NO: 6304 - DNA, 167 bp, Homo sapiens
  misc_feature 1..167: note = chr2:105471573-105471740
  misc_feature 1..167: note = hyper
  source 1..167: mol_type = genomic DNA
gccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgc

SEQ ID NO: 6305 - DNA, 204 bp, Homo sapiens
  misc_feature 1..204: note = chr2:105472057-105472261
  misc_feature 1..204: note = hyper
  source 1..204: mol_type = genomic DNA
cggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggt

SEQ ID NO: 6306 - DNA, 756 bp, Homo sapiens
  misc_feature 1..756: note = chr2:105472783-105473539
  misc_feature 1..756: note = hyper
  source 1..756: mol_type = genomic DNA
ccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgcc

SEQ ID NO: 6307 - DNA, 215 bp, Homo sapiens
  misc_feature 1..215: note = chr2:105473599-105473814
  misc_feature 1..215: note = hyper
  source 1..215: mol_type = genomic DNA
ctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagg

SEQ ID NO: 6308 - DNA, 292 bp, Homo sapiens; identical to SEQ ID NO: 2027
  misc_feature 1..292: note = chr2:105478762-105479054
  misc_feature 1..292: note = hyper
  source 1..292: mol_type = genomic DNA

SEQ ID NO: 6309 - DNA, 47 bp, Homo sapiens; identical to SEQ ID NO: 2028
  misc_feature 1..47: note = chr2:105479055-105479102
  misc_feature 1..47: note = hyper
  source 1..47: mol_type = genomic DNA

SEQ ID NO: 6310 - DNA, 951 bp, Homo sapiens
  misc_feature 1..951: note = chr2:105488281-105489232
  misc_feature 1..951: note = hyper
  source 1..951: mol_type = genomic DNA
actcaatgctcaatgcgaacgcagaaagaactcaacaactgaaccgccagtggaatccagtatctgggcaagttcactttattccttcgcaggaagagggtcagcgacggccagcgaaagtttcccccgctctttgaagagggaggtgacaagacctgccagaccttcccacgcgcgggccgcctgggttctggggctttcgtgacgtcttccctcatcgcgctccccacccccgaacacacacacacagacacacacacacacacactcttccttgctcgggaaacttggcttcaacctggctccccctttcaaaaccccctggagaacttcccctgcagggatgccctgcgcccgccggctgcgccctccctctcctcagccctgctcctcctgtccgctccccggcgttctggactcacccggcacggtccttccattccacatacagacaggaaaccggcctcttcgggacaacatttgaaaccacattttatcaacatcatcaaagaccagagcacacacttcgggctctgagctctggagcccgcttcttgcagaaaaccgggtatgggggaagggctgcaggggcgagaaatcctgcttccaactgcgatttcagctttcttatggaaatgaacgcgacggcccgttcgccccgagcctccctcccgttcccagcccctcttcagcttaccctttcctcccgctaacccccgccctcccggtccccgagttcccgcggcggccaggctggtggggacgcactcgctctgcgcccgggtctcggcgcgcgcggaaacccaggccgcgggctcccctccgccccgccggcccgcgtgcagcattaaatattcatagggatgctactttcttaaaggagaacctaccgcgcgggaaagttcacagccaaggagaggcacaaaagaaggtctccgcgctggttctcaa

SEQ ID NO: 6311 - DNA, 139 bp, Homo sapiens
  misc_feature 1..139: note = chr2:105760945-105761084
  misc_feature 1..139: note = hyper
  source 1..139: mol_type = genomic DNA
gaggccacgcggggacggaggaggcagagaggacgggctgtgatggagaaacgggagaggagccggccaggcgccaccgtcaccaccatcaccaaccaccaccaccatcaccatcactgactgtcgcccatcccagctc

SEQ ID NO: 6312 - DNA, 95 bp, Homo sapiens
  misc_feature 1..95: note = chr2:106014945-106015040
  misc_feature 1..95: note = hyper
  source 1..95: mol_type = genomic DNA
acagcgtcacctccccgcagccgccggctgggacccgcggccagcctttacccaggctcgcccggtccctgcccgcatggcggtgccccacctgg

SEQ ID NO: 6313 - DNA, 212 bp, Homo sapiens
  misc_feature 1..212: note = chr2:107103854-107104066
  misc_feature 1..212: note = hyper
  source 1..212: mol_type = genomic DNA
cggggccaggtgtcccgggcgcgccccgatgcggccgcggctgtggctcctcctggccgcgcagctgacaggtaaggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttgg

SEQ ID NO: 6314 - DNA, 111 bp, Homo sapiens; identical to SEQ ID NO: 2029
  misc_feature 1..111: note = chr2:107502619-107502730
  misc_feature 1..111: note = hyper
  source 1..111: mol_type = genomic DNA

SEQ ID NO: 6315 - DNA, 43 bp, Homo sapiens; identical to SEQ ID NO: 2030
  misc_feature 1..43: note = chr2:107502865-107502908
  misc_feature 1..43: note = hyper
  source 1..43: mol_type = genomic DNA

SEQ ID NO: 6316 - DNA, 222 bp, Homo sapiens
  misc_feature 1..222: note = chr2:107503670-107503892
  misc_feature 1..222: note = hyper
  source 1..222: mol_type = genomic DNA
gcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccccaacccca

SEQ ID NO: 6317 - DNA, 73 bp, Homo sapiens
  misc_feature 1..73: note = chr2:108603211-108603284
  misc_feature 1..73: note = hyper
  source 1..73: mol_type = genomic DNA
cactccaggtaggagcggagcgggcattcctgcgcctacgggcccgcaccctcggaaacgccttgggcaccga

SEQ ID NO: 6318 - DNA, 154 bp, Homo sapiens
  misc_feature 1..154: note = chr2:109648119-109648273
  misc_feature 1..154: note = hyper
  source 1..154: mol_type = genomic DNA
agagcgccgcttcagcgtcggccacgtgggccgggctctgccggtggcaacctggacgcgctgcgggcgccggcgagacctgcgccaacgcctacctccgggccacaggcgggataaagctgccccactttgcccccagcgaagagaaccctcc

SEQ ID NO: 6319 - DNA, 30 bp, Homo sapiens
  misc_feature 1..30: note = chr2:109744973-109745003
  misc_feature 1..30: note = hyper
  source 1..30: mol_type = genomic DNA
ccccttcaactggagcgccttcccctcctg

SEQ ID NO: 6320 - DNA, 45 bp, Homo sapiens
  misc_feature 1..45: note = chr2:109745234-109745279
  misc_feature 1..45: note = hyper
  source 1..45: mol_type = genomic DNA
aggctcacgaaaagccgaaaaagactcggacgcttggaggaggca

SEQ ID NO: 6321 - DNA, 300 bp, Homo sapiens
  misc_feature 1..300: note = chr2:109745500-109745800
  misc_feature 1..300: note = hyper
  source 1..300: mol_type = genomic DNA
cgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgc

SEQ ID NO: 6322 - DNA, 61 bp, Homo sapiens
  misc_feature 1..61: note = chr2:109746018-109746079
  misc_feature 1..61: note = hyper
  source 1..61: mol_type = genomic DNA
tgtgcgcatccaaggcggccgccgctgctgcgcagagcgagggcgacgaggacaggccagg

SEQ ID NO: 6323 - DNA, 99 bp, Homo sapiens
  misc_feature 1..99: note = chr2:109746289-109746388
  misc_feature 1..99: note = hyper
  source 1..99: mol_type = genomic DNA
catcctggtgggctgcggcgtggacgaactgcccgccaacatcttgctggtgcgactgctggacggcatccgtcagcggccccgcgcgggcaccagccc

SEQ ID NO: 6324 - DNA, 96 bp, Homo sapiens
  misc_feature 1..96: note = chr2:111490570-111490666
  misc_feature 1..96: note = hyper
  source 1..96: mol_type = genomic DNA
ggtgccctctcctcccgagctccctcccccacgaagagtcgggtgcagggctgggccccgcggtgacaggcgcggtgtctacgaagaccgtgtggc

SEQ ID NO: 6325 - DNA, 30 bp, Homo sapiens
  misc_feature 1..30: note = chr2:111875387-111875417
  misc_feature 1..30: note = hyper
  source 1..30: mol_type = genomic DNA
ctctaacgggtgtggcgggaagtgtggtgg

SEQ ID NO: 6326 - DNA, 77 bp, Homo sapiens
  misc_feature 1..77: note = chr2:112656725-112656802
  misc_feature 1..77: note = hyper
  source 1..77: mol_type = genomic DNA
gtctggtctgggatgcgacgagaactttccactagagttgcatggtggggccccgctctggccggagtcccgggggc

SEQ ID NO: 6327 - DNA, 53 bp, Homo sapiens
  misc_feature 1..53: note = chr2:112657039-112657092
  misc_feature 1..53: note = hyper
  source 1..53: mol_type = genomic DNA
tacagtgctcggcagcgtttacgtttatctggattcagcgaagtgttgttaca

SEQ ID NO: 6328 - DNA, 234 bp, Homo sapiens; identical to SEQ ID NO: 2031
  misc_feature 1..234: note = chr2:114256954-114257188
  misc_feature 1..234: note = hyper
  source 1..234: mol_type = genomic DNA

SEQ ID NO: 6329 - DNA, 54 bp, Homo sapiens
  misc_feature 1..54: note = chr2:114260999-114261053
  misc_feature 1..54: note = hyper
  source 1..54: mol_type = genomic DNA
tcctcccggcctctgcgccaccgcccccggtgcaggacgcgctttgctctcgcc

SEQ ID NO: 6330 - DNA, 184 bp, Homo sapiens; identical to SEQ ID NO: 2032
  misc_feature 1..184: note = chr2:114261280-114261464
  misc_feature 1..184: note = hyper
  source 1..184: mol_type = genomic DNA

SEQ ID NO: 6331 - DNA, 37 bp, Homo sapiens
  misc_feature 1..37: note = chr2:115918847-115918884
  misc_feature 1..37: note = hyper
  source 1..37: mol_type = genomic DNA
ggggctccgggaccccggtccccgggctgccccctgc

SEQ ID NO: 6332 - DNA, 88 bp, Homo sapiens
  misc_feature 1..88: note = chr2:115919337-115919425
  misc_feature 1..88: note = hyper
  source 1..88: mol_type = genomic DNA
cgagggagggaccctacgacggggagcccgcccggtgccgctcttcttcccctccccgcccctccgctccccccaccccgtcccttcc

SEQ ID NO: 6333 - DNA, 44 bp, Homo sapiens
  misc_feature 1..44: note = chr2:115920177-115920221
  misc_feature 1..44: note = hyper
  source 1..44: mol_type = genomic DNA
acggagcttggggagcggcgaggcattaacgattaagtggagcc

SEQ ID NO: 6334 - DNA, 113 bp, Homo sapiens
  misc_feature 1..113: note = chr2:115920421-115920534
  misc_feature 1..113: note = hyper
  source 1..113: mol_type = genomic DNA
gggtgattgggacttcggtgtcgctctttttccaaagttggagggtcgggagcgccgagacaccctggcgaggaggaggaggaggaggagggaggctgcgctgagccgggtgc

SEQ ID NO: 6335 - DNA, 683 bp, Homo sapiens; identical to SEQ ID NO: 195
  misc_feature 1..683: note = chr2:118981174-118981857
  misc_feature 1..683: note = hyper
  source 1..683: mol_type = genomic DNA

SEQ ID NO: 6336 - DNA, 203 bp, Homo sapiens; identical to SEQ ID NO: 196
  misc_feature 1..203: note = chr2:118981945-118982148
  misc_feature 1..203: note = hyper
  source 1..203: mol_type = genomic DNA

SEQ ID NO: 6337 - DNA, 244 bp, Homo sapiens; identical to SEQ ID NO: 197
  misc_feature 1..244: note = chr2:118982253-118982497
  misc_feature 1..244: note = hyper
  source 1..244: mol_type = genomic DNA

SEQ ID NO: 6338 - DNA, 402 bp, Homo sapiens; identical to SEQ ID NO: 2036
  misc_feature 1..402: note = chr2:119067695-119068097
  misc_feature 1..402: note = hyper
  source 1..402: mol_type = genomic DNA

SEQ ID NO: 6339 - DNA, 101 bp, Homo sapiens
  misc_feature 1..101: note = chr2:119532154-119532255
  misc_feature 1..101: note = hyper
  source 1..101: mol_type = genomic DNA
ccgggaggtggaaggcggagagcggcgagggctccggctccggacccagccgagcgcgcagcgtgaagcggagaacgccgggttagcgccaggctgaatcc

SEQ ID NO: 6340 - DNA, 30 bp, Homo sapiens
  misc_feature 1..30: note = chr2:119591351-119591381
  misc_feature 1..30: note = hyper
  source 1..30: mol_type = genomic DNA
ggtccctaccccacccggggtagcgggagg

SEQ ID NO: 6341 - DNA, 141 bp, Homo sapiens; identical to SEQ ID NO: 2037
  misc_feature 1..141: note = chr2:119592997-119593138
  misc_feature 1..141: note = hyper
  source 1..141: mol_type = genomic DNA

SEQ ID NO: 6342 - DNA, 93 bp, Homo sapiens
  misc_feature 1..93: note = chr2:119593865-119593958
  misc_feature 1..93: note = hyper
  source 1..93: mol_type = genomic DNA
aaactgctgattgtgcggggataggggcatcttaatctgggaaaagatcggaatctcttgggacgctaatctgagacccgggtcggaggtgta

SEQ ID NO: 6343 - DNA, 53 bp, Homo sapiens
  misc_feature 1..53: note = chr2:119599978-119600031
  misc_feature 1..53: note = hyper
  source 1..53: mol_type = genomic DNA
cagagaaaccagggccggcgatgcgggtcgggaggcaccggagaagcaatgac

SEQ ID NO: 6344 - DNA, 367 bp, Homo sapiens
  misc_feature 1..367: note = chr2:119600471-119600838
  misc_feature 1..367: note = hyper
  source 1..367: mol_type = genomic DNA
ggtgccgggagggggcgcgggcgcggccccggcctgtggcggctactcgctctcgtctttgtcctggaccgtggtggtggagtggttgtacagtccctgggccatgaggtgcagcgccaggccgttcttgatgcctgtggctttcttgatcttggcgcgcttgttctggaaccagatcttgatctgggactcgttgaggctgagttcctgggccagggtctgccgccgctgctccgtgatgtagcggtttgcctggaactccgccttgagtctctgcagctgctcggccgtgaacgcggtccgcggccgcttgtcctccttctcgttcttcttcttcttcagcttcctggtgcgcggacctgcagcg

SEQ ID NO: 6345 - DNA, 29 bp, Homo sapiens
  misc_feature 1..29: note = chr2:119602601-119602630
  misc_feature 1..29: note = hyper
  source 1..29: mol_type = genomic DNA
ctcttgtaataaaatcgttcctagtctcc

SEQ ID NO: 6346 - DNA, 81 bp, Homo sapiens; identical to SEQ ID NO: 2038
  misc_feature 1..81: note = chr2:119603030-119603111
  misc_feature 1..81: note = hyper
  source 1..81: mol_type = genomic DNA

SEQ ID NO: 6347 - DNA, 159 bp, Homo sapiens
  misc_feature 1..159: note = chr2:119604037-119604196
  misc_feature 1..159: note = hyper
  source 1..159: mol_type = genomic DNA
cggggctccccgcgccgcctccactgccgccgccaccggtgtccgagggcttggctgctgcggccgccgccgccgccgccactgccgccgcggccgccgccgccgccgcagccgggttcccagctttagacgcgcccgcgccggcggcggctggctggg

SEQ ID NO: 6348 - DNA, 254 bp, Homo sapiens
  misc_feature 1..254: note = chr2:119604426-119604680
  misc_feature 1..254: note = hyper
  source 1..254: mol_type = genomic DNA
aaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgc

SEQ ID NO: 6349 - DNA, 162 bp, Homo sapiens
  misc_feature 1..162: note = chr2:119604689-119604851
  misc_feature 1..162: note = hyper
  source 1..162: mol_type = genomic DNA
cgcgccgagggccgagtcgcgctgacttttaggttccggctgctgttcttccatgctcggccgccccgccgccccggccgccgcgccggcccccgcccccaccgcctcgctccccaccccactttgccagcggcccgtgggggtgcgcggaggaaggaggca

SEQ ID NO: 6350 - DNA, 30 bp, Homo sapiens
  misc_feature 1..30: note = chr2:119606783-119606813
  misc_feature 1..30: note = hyper
  source 1..30: mol_type = genomic DNA
atcttagagctccagcggacctcctcgccc

SEQ ID NO: 6351 - DNA, 182 bp, Homo sapiens; identical to SEQ ID NO: 2039
  misc_feature 1..182: note = chr2:119607442-119607624
  misc_feature 1..182: note = hyper
  source 1..182: mol_type = genomic DNA

SEQ ID NO: 6352 - skipped

SEQ ID NO: 6353 - DNA, 71 bp, Homo sapiens
  misc_feature 1..71: note = chr2:119610540-119610611
  misc_feature 1..71: note = hyper
  source 1..71: mol_type = genomic DNA
cgctgggactgtatcacacagccagacaggcctctggagctgagaattttagacttcgctgctccgggaag

SEQ ID NO: 6354 - DNA, 44 bp, Homo sapiens
  misc_feature 1..44: note = chr2:119611687-119611731
  misc_feature 1..44: note = hyper
  source 1..44: mol_type = genomic DNA
aagctgggaggggaacgagtgtgtagccccgcgcgtgcgtgttt

SEQ ID NO: 6355 - DNA, 30 bp, Homo sapiens
  misc_feature 1..30: note = chr2:119613184-119613214
  misc_feature 1..30: note = hyper
  source 1..30: mol_type = genomic DNA
cttaaacagtggaaccgtgaggccgctcta

SEQ ID NO: 6356 - DNA, 949 bp, Homo sapiens
  misc_feature 1..949: note = chr2:119614622-119615571
  misc_feature 1..949: note = hyper
  source 1..949: mol_type = genomic DNA
ctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactggagaccctctgctttcgggatagatgggacgtttctgctctgtccttcttggagtcccggaatcgttctggggccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccgggccctccgtgtggtcgagagtttgcgcccgctcccgctagggcagcgaggtcccacttgcggccggctggggcatggtggcaccggttgtctactccccacttgtgacaccgacagcttccaactcctcagacccaccccgtggaattctggactttgtgagggccgccggggtcctggccctggggtcagctgccatctgactaagccaggacggcggagctccaggccttgctccagcactgccggtgcgtcggggcccgcggagagcccagggcgggagctgtgggctgagccgggtggccgcgtggacacagatgcccggccggactgagcggcagccaagactctccgtccatcccgccgctggactcgactctcccagacccgccacggaacccagatttgagcacgcaagataaagacgccagaggcgagtgcgcggcggagaactggccgcgacacgggaagcttctggggcgcagaacgctggctccgactcgcgcggcgcagacc

SEQ ID NO: 6357 - DNA, 142 bp, Homo sapiens; identical to SEQ ID NO: 198
  misc_feature 1..142: note = chr2:119616141-119616283
  misc_feature 1..142: note = hyper
  source 1..142: mol_type = genomic DNA

SEQ ID NO: 6358 - DNA, 35 bp, Homo sapiens
  misc_feature 1..35: note = chr2:119616517-119616552
  misc_feature 1..35: note = hyper
  source 1..35: mol_type = genomic DNA
gacatctcagggtcccgggcctccaagctcatggc

SEQ ID NO: 6359 - DNA, 150 bp, Homo sapiens
  misc_feature 1..150: note = chr2:119769161-119769311
  misc_feature 1..150: note = hyper
  source 1..150: mol_type = genomic DNA
ttgctttctctctcccggcacgcggggtcgctgcaggccgtgctcagccctccaggagccggccggtgtccgcgctcgcgggcggctctgggaccgggagaggctgcggctccccgctaaggctcctgcggccggcgcctcctggaccca

SEQ ID NO: 6360 - DNA, 202 bp, Homo sapiens
  misc_feature 1..202: note = chr2:119914553-119914755
  misc_feature 1..202: note = hyper
  source 1..202: mol_type = genomic DNA
ggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccaggtcccccctcctcctcgcgccgacgagtctgggaa

SEQ ID NO: 6361 - DNA, 440 bp, Homo sapiens
  misc_feature 1..440: note = chr2:119915167-119915607
  misc_feature 1..440: note = hyper
  source 1..440: mol_type = genomic DNA
gttcttgcagaggtccgcccacatgctggtgccgtcgccgccgcgcatgaggatgtggtaggtgaagaagtagatgccgcgtacctggcagctgaacttgcccgtggtggggtcatagtgattgccgaggttggtgaccacgtcatcgaacttcagcacctcatagccttcgtgggggctcttgagacccacatagaaggcgatcttggggccgctgaaggtggcgctcagcgcactggtcacttcaccctcggaatcgccacctaccccggccccgccgcccaccaccccgacgccgctggccgtgcccgccgtcagttgcagccctggcagcccgggccgccccgagtcgcccttctctcccggagggcccctgggtccaggcgggcccggctctccagggggcccccgcggccctggcttgcccggtcgccccgggt

SEQ ID NO: 6362 - skipped

SEQ ID NO: 6363 - DNA, 39 bp, Homo sapiens
  misc_feature 1..39: note = chr2:120190272-120190311
  misc_feature 1..39: note = hyper
  source 1..39: mol_type = genomic DNA
aggattagagaggcccgttgacttcgtgtacaaacgctc

SEQ ID NO: 6364 - DNA, 178 bp, Homo sapiens
  misc_feature 1..178: note = chr2:121104414-121104592
  misc_feature 1..178: note = hyper
  source 1..178: mol_type = genomic DNA
gctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggctta

SEQ ID NO: 6365 - DNA, 155 bp, Homo sapiens
  misc_feature 1..155: note = chr2:121104793-121104948
  misc_feature 1..155: note = hyper
  source 1..155: mol_type = genomic DNA
tgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagg

SEQ ID NO: 6366 - DNA, 75 bp, Homo sapiens
  misc_feature 1..75: note = chr2:121344942-121345017
  misc_feature 1..75: note = hyper
  source 1..75: mol_type = genomic DNA
gccgctttgtgcccgcggccggcggaggtgggggccgcgcgtccccggatccccctgccccggcccggcccgcgg

SEQ ID NO: 6367 - DNA, 40 bp, Homo sapiens
  misc_feature 1..40: note = chr2:121493902-121493942
  misc_feature 1..40: note = hyper
  source 1..40: mol_type = genomic DNA
aagcgcctcccacctcggccaagcgcgggccgactgggat

SEQ ID NO: 6368 - DNA, 73 bp, Homo sapiens
  misc_feature 1..73: note = chr2:124782333-124782406
  misc_feature 1..73: note = hyper
  source 1..73: mol_type = genomic DNA
ctgcaagcaggggagcgcgcacaacgttaaaccttgaaaccagaaatcccgatcctatcgagacccatcagct

SEQ ID NO: 6369 - DNA, 481 bp, Homo sapiens; identical to SEQ ID NO: 2043
  misc_feature 1..481: note = chr2:124782692-124783173
  misc_feature 1..481: note = hyper
  source 1..481: mol_type = genomic DNA

SEQ ID NO: 6370 - DNA, 30 bp, Homo sapiens
  misc_feature 1..30: note = chr2:124783375-124783405
  misc_feature 1..30: note = hyper
  source 1..30: mol_type = genomic DNA
ctatctaagcgtactcgattgtgtctgctt

SEQ ID NO: 6371 - DNA, 125 bp, Homo sapiens; identical to SEQ ID NO: 2044
  misc_feature 1..125: note = chr2:127783043-127783168
  misc_feature 1..125: note = hyper
  source 1..125: mol_type = genomic DNA

SEQ ID NO: 6372 - DNA, 412 bp, Homo sapiens; identical to SEQ ID NO: 2045
  misc_feature 1..412: note = chr2:127783169-127783581
  misc_feature 1..412: note = hyper
  source 1..412: mol_type = genomic DNA

SEQ ID NO: 6373 - DNA, 30 bp, Homo sapiens
  misc_feature 1..30: note = chr2:127863640-127863670
  misc_feature 1..30: note = hyper
  source 1..30: mol_type = genomic DNA
tccgcgaggaggggtcgggtttcctgtggc

SEQ ID NO: 6374 - DNA, 366 bp, Homo sapiens
  misc_feature 1..366: note = chr2:127976392-127976758
  misc_feature 1..366: note = hyper
  source 1..366: mol_type = genomic DNA
gctgggccgggcacccggggaggcggacgatgggcgaaggcatcggagggcgccgccgcggctcgggtgcagtgcccctgccacgaagggcgcaacggaggtgggcgtgggaaggacagcactcaggctccaagtgggaagcgtgcggaattcgccggccccaacgccctagcgggtggctgggacccctgggttcctcccacgtccctgcctccagtcccggcgcgaactccaggtgtcgcccccaactccggcttagagcctacggcaccccgagcctccgagcctccgtcccctcttcccccgccattacaaaatacaaaaaggactagaaatgaatacacacggtctcggccacctaaggac

SEQ ID NO: 6375 - DNA, 28 bp, Homo sapiens
  misc_feature 1..28: note = chr2:128421822-128421850
  misc_feature 1..28: note = hyper
  source 1..28: mol_type = genomic DNA
gccgccgcagctttccggccattgtccc

SEQ ID NO: 6376 - DNA, 57 bp, Homo sapiens
  misc_feature 1..57: note = chr2:128421890-128421947
  misc_feature 1..57: note = hyper
  source 1..57: mol_type = genomic DNA
cggcgggctctgccggtgctggcgccgccggtacagccccgacgcggccagcgcacc

SEQ ID NO: 6377 - DNA, 91 bp, Homo sapiens
  misc_feature 1..91: note = chr2:128433386-128433477
  misc_feature 1..91: note = hyper
  source 1..91: mol_type = genomic DNA
cagggaggctaaagccgagaggcgtccctcttcagtcgcaaagctgctttccccgggaaattccgatttcatcccccgttgcgggccatcg

SEQ ID NO: 6378 - DNA, 15 bp, Homo sapiens
  misc_feature 1..15: note = chr2:130737190-130737205
  misc_feature 1..15: note = hyper
  source 1..15: mol_type = genomic DNA
aaaactgtgttgagg

SEQ ID NO: 6379 - DNA, 162 bp, Homo sapiens; identical to SEQ ID NO: 2046
  misc_feature 1..162: note = chr2:130737475-130737637
  misc_feature 1..162: note = hyper
  source 1..162: mol_type = genomic DNA

SEQ ID NO: 6380 - DNA, 91 bp, Homo sapiens
  misc_feature 1..91: note = chr2:130763551-130763642
  misc_feature 1..91: note = hyper
  source 1..91: mol_type = genomic DNA
cctccgccaggcctgcgctgcctcgccccgggagaggaagactgagcccggctcaggcggctggagcgcgcgggcccgtttcctttcagcg

SEQ ID NO: 6381 - DNA, 30 bp, Homo sapiens
  misc_feature 1..30: note = chr2:130971230-130971260
  misc_feature 1..30: note = hyper
  source 1..30: mol_type = genomic DNA
gcggcgggcccggggcgctgccgccgcggc

SEQ ID NO: 6382 - DNA, 198 bp, Homo sapiens
  misc_feature 1..198: note = chr2:131484889-131485087
  misc_feature 1..198: note = hyper
  source 1..198: mol_type = genomic DNA
cagcagagagaggctcggccttggccctcagccctgcagcacacagggcacccgcgcagagagcgtggcctgcgaatggctctgctgcctctcccggcctggggccgattagaccggtcagagcatctgtaaagtacaaggggcccctagggagtgcaggccagggcagctggggcagggaggcggggtccgccccat

SEQ ID NO: 6383 - DNA, 89 bp, Homo sapiens
  misc_feature 1..89: note = chr2:131485343-131485432
  misc_feature 1..89: note = hyper
  source 1..89: mol_type = genomic DNA
tggtgggcgtggccccgggctgcggcgggcgtggtccccgggctgcggcggacgtggtcaggggcggttctgggcgtggtccctgggct

SEQ ID NO: 6384 - DNA, 301 bp, Homo sapiens
  misc_feature 1..301: note = chr2:131513559-131513860
  misc_feature 1..301: note = hyper
  source 1..301: mol_type = genomic DNA
aggcgcagccgcaaccgggtgggaggcagagacacccagaaacagagacggggcgatacgaacagacaaagccggctcgagcgcggcccgagcggcggcgcagggaggcggcagcctggcggagcagcccccaccgcggccggcgcgccccctcgccacccctgcgcgccagcgccggcccgcccctcccgctggcctctggcggcttaaccctcgcctgcccgaccccgcggggcccctggagccgcggtgggtgggtgcgggcgccgggcctccccctcccggccgcggcgcgcggcgc

SEQ ID NO: 6385 - DNA, 54 bp, Homo sapiens
  misc_feature 1..54: note = chr2:131595112-131595166
  misc_feature 1..54: note = hyper
  source 1..54: mol_type = genomic DNA
gccccctctctggcccgatttccgggcccgctcaccatccgggacccactcagt

SEQ ID NO: 6386 - DNA, 272 bp, Homo sapiens; identical to SEQ ID NO: 2047
  misc_feature 1..272: note = chr2:131720827-131721099
  misc_feature 1..272: note = hyper
  source 1..272: mol_type = genomic DNA

SEQ ID NO: 6387 - DNA, 124 bp, Homo sapiens; identical to SEQ ID NO: 2048
  misc_feature 1..124: note = chr2:131721461-131721585
  misc_feature 1..124: note = hyper
  source 1..124: mol_type = genomic DNA

SEQ ID NO: 6388 - DNA, 83 bp, Homo sapiens; identical to SEQ ID NO: 2049
  misc_feature 1..83: note = chr2:131721866-131721949
  misc_feature 1..83: note = hyper
  source 1..83: mol_type = genomic DNA

SEQ ID NO: 6389 - DNA, 295 bp, Homo sapiens; identical to SEQ ID NO: 2050
  misc_feature 1..295: note = chr2:131792225-131792520
  misc_feature 1..295: note = hyper
  source 1..295: mol_type = genomic DNA

SEQ ID NO: 6390 - DNA, 106 bp, Homo sapiens; identical to SEQ ID NO: 2051
  misc_feature 1..106: note = chr2:131792531-131792637
  misc_feature 1..106: note = hyper
  source 1..106: mol_type = genomic DNA

SEQ ID NO: 6391 - DNA, 30 bp, Homo sapiens
  misc_feature 1..30: note = chr2:131792996-131793026
  misc_feature 1..30: note = hyper
  source 1..30: mol_type = genomic DNA
aggggcgtggtggcacgtgtgtcacagggt

SEQ ID NO: 6392 - DNA, 35 bp, Homo sapiens
  misc_feature 1..35: note = chr2:132088604-132088639
  misc_feature 1..35: note = hyper
  source 1..35: mol_type = genomic DNA
gcgctccctgaaatccgggctgtccaagtaggaat

SEQ ID NO: 6393 - DNA, 187 bp, Homo sapiens
  misc_feature 1..187: note = chr2:132121342-132121529
  misc_feature 1..187: note = hyper
  source 1..187: mol_type = genomic DNA
cgatgctgctccagccggctgacgaaaaaggcgagcggaagggcgggcgccgagctctctgcgcccctgcaagggccggtggaggagcccggctggagggcagcaggactctccacagactggcagccgccgccgcctcccggcagagtagccgagcaccgagcgaggcccgcggctgggaagggaa

SEQ ID NO: 6394 - DNA, 184 bp, Homo sapiens; identical to SEQ ID NO: 2052
  misc_feature 1..184: note = chr2:132152311-132152495
  misc_feature 1..184: note = hyper
  source 1..184: mol_type = genomic DNA

SEQ ID NO: 6395 - DNA, 325 bp, Homo sapiens; identical to SEQ ID NO: 199
  misc_feature 1..325: note = chr2:132182764-132183089
  misc_feature 1..325: note = hyper
  source 1..325: mol_type = genomic DNA

SEQ ID NO: 6396 - DNA, 81 bp, Homo sapiens
  misc_feature 1..81: note = chr2:132767414-132767495
  misc_feature 1..81: note = hyper
  source 1..81: mol_type = genomic DNA
aaccccacaaaaacccgcggcgacggggggaaaaaaccgcggcggcaaaaagcctcagcggcaggagcaaaaagccgccgc

SEQ ID NO: 6397 - DNA, 140 bp, Homo sapiens
  misc_feature 1..140: note = chr2:132767735-132767875
  misc_feature 1..140: note = hyper
  source 1..140: mol_type = genomic DNA
gcaaaaagctgccgcagcggtgacgaaaagccacaggggcgggggcaaaaagccgcaaaaagccccgacggcgggtcaaagagccgcaaaaagccccagcgtcgggggcaaaaagccgcggctgccggggcaaaaagcag

SEQ ID NO: 6398 - DNA, 79 bp, Homo sapiens
  misc_feature 1..79: note = chr2:132796105-132796184
  misc_feature 1..79: note = hyper
  source 1..79: mol_type = genomic DNA
acgggggtaaaaagccgcggcgacaaaaagccgctgagagggggcaaaaagcagcgggagcgggggcaaaacacaaaaa

SEQ ID NO: 6399 - DNA, 104 bp, Homo sapiens
  misc_feature 1..104: note = chr2:133015320-133015424
  misc_feature 1..104: note = hyper
  source 1..104: mol_type = genomic DNA
ggagggggcctgcggtaccaggaaaaatctgcgtgcggcaaccttgagccttcgcggtctgggcagggggcctggccgctgcgcgtgcgcgcaatccccgaagg

SEQ ID NO: 6400 - DNA, 30 bp, Homo sapiens
  misc_feature 1..30: note = chr2:133015649-133015679
  misc_feature 1..30: note = hyper
  source 1..30: mol_type = genomic DNA
cgcgtctcactcaaccgcctcgacccccac

SEQ ID NO: 6401 - DNA, 56 bp, Homo sapiens
  misc_feature 1..56: note = chr2:133426223-133426279
  misc_feature 1..56: note = hyper
  source 1..56: mol_type = genomic DNA
ccactcctgggtctccgggtagggctggatgtggctgacaccggcagggggcggcg

SEQ ID NO: 6402 - DNA, 79 bp, Homo sapiens
  misc_feature 1..79: note = chr2:133427558-133427637
  misc_feature 1..79: note = hyper
  source 1..79: mol_type = genomic DNA
cagcggaggctgccccggctgcagcggctgtggctgccgaggctgctggggcccgcgctgctgccgcggagacgacggt

SEQ ID NO: 6403 - DNA, 321 bp, Homo sapiens
  misc_feature 1..321: note = chr2:135475874-135476195
  misc_feature 1..321: note = hyper
  source 1..321: mol_type = genomic DNA
ggcagccggcggagccgcaggggactacggaaaggaggatgcaacgagcctgggtccctccgagctgagtagggcccggagtggcccagaagcgctcgactccgaacgcaaaaaatgcctcccgcaaacttttcccgtgggcgccggagggcctggagctggcggagaggagggcgcgagtccaggcggggtcggcctgaaggcagctggggtctgggcttcgagggaaggaaccgcagccgaggcggtgccggccgcagaaggtggggctgccgctctcggctagcggcgttctcgccgggaagtcggggctccgcgccc

SEQ ID NO: 6404 - DNA, 49 bp, Homo sapiens
  misc_feature 1..49: note = chr2:135476941-135476990
  misc_feature 1..49: note = hyper
  source 1..49: mol_type = genomic DNA
gattcctctggggtccgcgaagcccgcggccgcgcgtgggtagcagaca

SEQ ID NO: 6405 - DNA, 75 bp, Homo sapiens
  misc_feature 1..75: note = chr2:136876531-136876606
  misc_feature 1..75: note = hyper
  source 1..75: mol_type = genomic DNA
gagatgcatttagtccgatatttatagaaggacgaactgcgtgccacgcactgttctaggcgttggggatccagc

SEQ ID NO: 6406 - DNA, 41 bp, Homo sapiens
  misc_feature 1..41: note = chr2:137522445-137522486
  misc_feature 1..41: note = hyper
  source 1..41: mol_type = genomic DNA
ttctcctagtaacaccgaagccctctcgtgcccggggactg

SEQ ID NO: 6407 - DNA, 32 bp, Homo sapiens
  misc_feature 1..32: note = chr2:137522850-137522882
  misc_feature 1..32: note = hyper
  source 1..32: mol_type = genomic DNA
agggtcgtgcgggtgcgcggcagaggcggtag

SEQ ID NO: 6408 - DNA, 30 bp, Homo sapiens
  misc_feature 1..30: note = chr2:137523564-137523594
  misc_feature 1..30: note = hyper
  source 1..30: mol_type = genomic DNA
ccgaaccttgggacccgggcagcaggagct

SEQ ID NO: 6409 - DNA, 371 bp, Homo sapiens; identical to SEQ ID NO: 200
  misc_feature 1..371: note = chr2:139536937-139537308
  misc_feature 1..371: note = hyper
  source 1..371: mol_type = genomic DNA

SEQ ID NO: 6410 - DNA, 50 bp, Homo sapiens
  misc_feature 1..50: note = chr2:139537771-139537821
  misc_feature 1..50: note = hyper
  source 1..50: mol_type = genomic DNA
agccagggaccaccacgaggggcagcggccgcaggcgcatggtgccggct

SEQ ID NO: 6411 - DNA, 149 bp, Homo sapiens
  misc_feature 1..149: note = chr2:142888097-142888246
  misc_feature 1..149: note = hyper
  source 1..149: mol_type = genomic DNA
cccggtcccggggagcggagctgcaaggacttaagtttcacactcacttatctgcaagcatcgcccagcaggaaagccaaggaagtcaggggaggggagcggggaggtgttctccttacctcggtcggctcccacggtcagcaccctgg

SEQ ID NO: 6412 - DNA, 34 bp, Homo sapiens
  misc_feature 1..34: note = chr2:142888484-142888518
  misc_feature 1..34: note = hyper
  source 1..34: mol_type = genomic DNA
gaaggtggagggatgcgcgcgtgcgggagagagg

SEQ ID NO: 6413 - DNA, 200 bp, Homo sapiens; identical to SEQ ID NO: 2055
  misc_feature 1..200: note = chr2:144694315-144694515
  misc_feature 1..200: note = hyper
  source 1..200: mol_type = genomic DNA

SEQ ID NO: 6414 - DNA, 704 bp, Homo sapiens; identical to SEQ ID NO: 2056
  misc_feature 1..704: note = chr2:144694553-144695257
  misc_feature 1..704: note = hyper
  source 1..704: mol_type = genomic DNA

SEQ ID NO: 6415 - DNA, 31 bp, Homo sapiens; identical to SEQ ID NO: 2057
  misc_feature 1..31: note = chr2:144695258-144695289
  misc_feature 1..31: note = hyper
  source 1..31: mol_type = genomic DNA

SEQ ID NO: 6416 - DNA, 463 bp, Homo sapiens; identical to SEQ ID NO: 201
  misc_feature 1..463: note = chr2:145273327-145273790
  misc_feature 1..463: note = hyper
  source 1..463: mol_type = genomic DNA

SEQ ID NO: 6417 - DNA, 431 bp, Homo sapiens; identical to SEQ ID NO: 2059
  misc_feature 1..431: note = chr2:145274080-145274511
  misc_feature 1..431: note = hyper
  source 1..431: mol_type = genomic DNA

SEQ ID NO: 6418 - DNA, 399 bp, Homo sapiens; identical to SEQ ID NO: 2060
  misc_feature 1..399: note = chr2:145274576-145274975
  misc_feature 1..399: note = hyper
  source 1..399: mol_type = genomic DNA

SEQ ID NO: 6419 - DNA, 479 bp, Homo sapiens; identical to SEQ ID NO: 2061
  misc_feature 1..479: note = chr2:145274976-145275455
  misc_feature 1..479: note = hyper
  source 1..479: mol_type = genomic DNA

SEQ ID NO: 6420 - DNA, 132 bp, Homo sapiens
  misc_feature 1..132: note = chr2:145277493-145277625
  misc_feature 1..132: note = hyper
  source 1..132: mol_type = genomic DNA
aaaaaaacctacctgcgaagtcttgtttgtagttttggccagaaatggtgagaagaaaaagcatgaagaagccgcgaagtgtgggggagaaaaaggtggaagcgaagaaacagctcccggagcaaactgtac

SEQ ID NO: 6421 - DNA, 92 bp, Homo sapiens; identical to SEQ ID NO: 2062
  misc_feature 1..92: note = chr2:145281307-145281399
  misc_feature 1..92: note = hyper
  source 1..92: mol_type = genomic DNA

SEQ ID NO: 6422 - DNA, 188 bp, Homo sapiens
  misc_feature 1..188: note = chr2:145281754-145281942
  misc_feature 1..188: note = hyper
  source 1..188: mol_type = genomic DNA
cccccccacacaccccgccccaacccccgccgccagcttcggtccctgcatttgatctccaggaagggccccgctgcacaggcggaggagcgcgtcgcgggggggggcggtgttcggccccctcccaccagaccgccctcccccagacctgtccccgcccgggatcctgcgacccccgcccgccgccc

SEQ ID NO: 6423 - DNA, 36 bp, Homo sapiens
  misc_feature 1..36: note = chr2:145281943-145281979
  misc_feature 1..36: note = hyper
  source 1..36: mol_type = genomic DNA
gtcagctgacctggctcgctcgcctgctccccgccc

SEQ ID NO: 6424 - DNA, 78 bp, Homo sapiens
  misc_feature 1..78: note = chr2:145282041-145282119
  misc_feature 1..78: note = hyper
  source 1..78: mol_type = genomic DNA
gggaggtgatgccgggggctgattaccatgagaaaggctgtgcctggaaaagcctcctccacgcgactgtcaatctca

SEQ ID NO: 6425 - DNA, 746 bp, Homo sapiens; identical to SEQ ID NO: 2063
  misc_feature 1..746: note = chr2:149633311-149634057
  misc_feature 1..746: note = hyper
  source 1..746: mol_type = genomic DNA

SEQ ID NO: 6426 - DNA, 24 bp, Homo sapiens
  misc_feature 1..24: note = chr2:149645535-149645559
  misc_feature 1..24: note = hyper
  source 1..24: mol_type = genomic DNA
ccgcagcaagggctgcgaccccgc

SEQ ID NO: 6427 - DNA, 287 bp, Homo sapiens; identical to SEQ ID NO: 203
  misc_feature 1..287: note = chr2:149645560-149645847
  misc_feature 1..287: note = hyper
  source 1..287: mol_type = genomic DNA

SEQ ID NO: 6428 - DNA, 198 bp, Homo sapiens
  misc_feature 1..198: note = chr2:152954698-152954896
  misc_feature 1..198: note = hyper
  source 1..198: mol_type = genomic DNA
agcccgagcaccggccgaggccgggaagagacgcgcgcgggcttgacccgcagctcccgcacgtgtgggccacggccggctccaggacccccgcgccgcgcgctcggcctcctccccatcctggtctcccgcctccttctcatacctgtctgaggatgaagctggtcgaagtggtgctgccatcggatcttttcaacc

SEQ ID NO: 6429 - DNA, 357 bp, Homo sapiens
  misc_feature 1..357: note = chr2:154333374-154333731
  misc_feature 1..357: note = hyper
  source 1..357: mol_type = genomic DNA
aattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacggaagtgtaatcttcccgcgggggcccttctgtcgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccagggga

SEQ ID NO: 6430 - DNA, 247 bp, Homo sapiens; identical to SEQ ID NO: 2066
  misc_feature 1..247: note = chr2:154334199-154334446
  misc_feature 1..247: note = hyper
  source 1..247: mol_type = genomic DNA

SEQ ID NO: 6431 - DNA, 266 bp, Homo sapiens; identical to SEQ ID NO: 2067
  misc_feature 1..266: note = chr2:154335184-154335450
  misc_feature 1..266: note = hyper
  source 1..266: mol_type = genomic DNA

SEQ ID NO: 6432 - DNA, 158 bp, Homo sapiens
  misc_feature 1..158: note = chr2:154729082-154729240
  misc_feature 1..158: note = hyper
  source 1..158: mol_type = genomic DNA
gcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcagg

SEQ ID NO: 6433 - DNA, 30 bp, Homo sapiens
  misc_feature 1..30: note = chr2:154729766-154729796
  misc_feature 1..30: note = hyper
  source 1..30: mol_type = genomic DNA
gacctgaaggaggggcgcaaggggttagag

SEQ ID NO: 6434 - DNA, 47 bp, Homo sapiens
  misc_feature 1..47: note = chr2:157176592-157176639
  misc_feature 1..47: note = hyper
  source 1..47: mol_type = genomic DNA
gacctccacgaggtgcggacgcgcctctgccccgcccttttgtgcgc

SEQ ID NO: 6435 - DNA, 1265 bp, Homo sapiens; identical to SEQ ID NO: 204
  misc_feature 1..1265: note = chr2:157176900-157178165
  misc_feature 1..1265: note = hyper
  source 1..1265: mol_type = genomic DNA

SEQ ID NO: 6436 - DNA, 13 bp, Homo sapiens
  misc_feature 1..13: note = chr2:157178166-157178179
  misc_feature 1..13: note = hyper
  source 1..13: mol_type = genomic DNA
aggcccaggcagg

SEQ ID NO: 6437 - DNA, 30 bp, Homo sapiens
  misc_feature 1..30: note = chr2:160760685-160760715
  misc_feature 1..30: note = hyper
  source 1..30: mol_type = genomic DNA
aaggtgaccaagggccgaaggaaaagcgag

SEQ ID NO: 6438 - DNA, 64 bp, Homo sapiens
  misc_feature 1..64: note = chr2:160761069-160761133
  misc_feature 1..64: note = hyper
  source 1..64: mol_type = genomic DNA
ggactgcggggctggcgtgcccgcggttacctgcgcggccagagggctccgcgagatcgaagaa

SEQ ID NO: 6439 - DNA, 43 bp, Homo sapiens
  misc_feature 1..43: note = chr2:162095596-162095639
  misc_feature 1..43: note = hyper
  source 1..43: mol_type = genomic DNA
cgcgcgcccactccccggggcggtggggcgaggacccgcgctc

SEQ ID NO: 6440 - DNA, 441 bp, Homo sapiens
  misc_feature 1..441: note = chr2:162273508-162273949
  misc_feature 1..441: note = hyper
  source 1..441: mol_type = genomic DNA
gccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctct

SEQ ID NO: 6441 - DNA, 30 bp, Homo sapiens
  misc_feature 1..30: note = chr2:162274914-162274944
  misc_feature 1..30: note = hyper
  source 1..30: mol_type = genomic DNA
atggaactggatacacgtttctttgcttca

SEQ ID NO: 6442 - DNA, 55 bp, Homo sapiens; identical to SEQ ID NO: 206
  misc_feature 1..55: note = chr2:162275172-162275227
  misc_feature 1..55: note = hyper
  source 1..55: mol_type = genomic DNA

SEQ ID NO: 6443 - DNA, 128 bp, Homo sapiens; identical to SEQ ID NO: 207
  misc_feature 1..128: note = chr2:162275310-162275438
  misc_feature 1..128: note = hyper
  source 1..128: mol_type = genomic DNA

SEQ ID NO: 6444 - DNA, 128 bp, Homo sapiens; identical to SEQ ID NO: 208
  misc_feature 1..128: note = chr2:162275472-162275600
  misc_feature 1..128: note = hyper
  source 1..128: mol_type = genomic DNA

SEQ ID NO: 6445 - DNA, 264 bp, Homo sapiens; identical to SEQ ID NO: 209
  misc_feature 1..264: note = chr2:162280152-162280416
  misc_feature 1..264: note = hyper
  source 1..264: mol_type = genomic DNA

SEQ ID NO: 6446 - DNA, 216 bp, Homo sapiens; identical to SEQ ID NO: 210
  misc_feature 1..216: note = chr2:162280740-162280956
  misc_feature 1..216: note = hyper
  source 1..216: mol_type = genomic DNA

SEQ ID NO: 6447 - DNA, 238 bp, Homo sapiens; identical to SEQ ID NO: 211
  misc_feature 1..238: note = chr2:162283365-162283603
  misc_feature 1..238: note = hyper
  source 1..238: mol_type = genomic DNA

SEQ ID NO: 6448 - DNA, 273 bp, Homo sapiens; identical to SEQ ID NO: 212
  misc_feature 1..273: note = chr2:162283782-162284055
  misc_feature 1..273: note = hyper
  source 1..273: mol_type = genomic DNA

SEQ ID NO: 6449 - DNA, 38 bp, Homo sapiens
  misc_feature 1..38: note = chr2:162284338-162284376
  misc_feature 1..38: note = hyper
  source 1..38: mol_type = genomic DNA
gacgaaagaagaagacgagcgtgcggctagcactgtat

SEQ ID NO: 6450 - DNA, 34 bp, Homo sapiens
  misc_feature 1..34: note = chr2:162930251-162930285
  misc_feature 1..34: note = hyper
  source 1..34: mol_type = genomic DNA
ctgtgagtggctctccgggacattcaaagctcga

SEQ ID NO: 6451 - DNA, 52 bp, Homo sapiens
  misc_feature 1..52: note = chr2:162930338-162930390
  misc_feature 1..52: note = hyper
  source 1..52: mol_type = genomic DNA
cgtcccttcacctgtcagagggtggccttggggcttccgcctaaggggagtc

SEQ ID NO: 6452 - DNA, 25 bp, Homo sapiens
  misc_feature 1..25: note = chr2:163695246-163695271
  misc_feature 1..25: note = hyper
  source 1..25: mol_type = genomic DNA
cggactgccgcgggtgagagggttt

SEQ ID NO: 6453 - DNA, 30 bp, Homo sapiens
  misc_feature 1..30: note = chr2:163695477-163695507
  misc_feature 1..30: note = hyper
  source 1..30: mol_type = genomic DNA
atggaagacttgtgccggttttgctggaag

SEQ ID NO: 6454 - DNA, 141 bp, Homo sapiens
  misc_feature 1..141: note = chr2:164592629-164592770
  misc_feature 1..141: note = hyper
  source 1..141: mol_type = genomic DNA
agagggagaaagagacggaggctgccgtgagggagagaagacgggaggcagtggcgagaggcgggcagtggagagagacgggcagcgggaggaccaggagggagagggagaggcgcacggagcccgcggagctggaggggg

SEQ ID NO: 6455 - DNA, 30 bp, Homo sapiens
  misc_feature 1..30: note = chr2:164593340-164593370
  misc_feature 1..30: note = hyper
  source 1..30: mol_type = genomic DNA
ccagttcccctcccccgcctccctgtgaat

SEQ ID NO: 6456 - DNA, 31 bp, Homo sapiens
  misc_feature 1..31: note = chr2:167233063-167233094
  misc_feature 1..31: note = hyper
  source 1..31: mol_type = genomic DNA
cggtgacgctcaagaccggtatctaggctat

SEQ ID NO: 6457 - DNA, 203 bp, Homo sapiens
  misc_feature 1..203: note = chr2:168150033-168150236
  misc_feature 1..203: note = hyper
  source 1..203: mol_type = genomic DNA
cacagactttgacagcgcggggatggcattgtgtgagtgtggatgtggatgcgtgtgtgcgcgcgcgcggcttggggcactttgcagcgagaacagtgggtcccctctgcgtggcccgacgtccttcaaggacccaagctgggctggagtgagtaggatgctgttggctcggcgggaggtagaacgcacggagcgcacgggaa

SEQ ID NO: 6458 - DNA, 228 bp, Homo sapiens; identical to SEQ ID NO: 2077
  misc_feature 1..228: note = chr2:168150566-168150794
  misc_feature 1..228: note = hyper
  source 1..228: mol_type = genomic DNA

SEQ ID NO: 6459 - DNA, 42 bp, Homo sapiens
  misc_feature 1..42: note = chr2:170218695-170218737
  misc_feature 1..42: note = hyper
  source 1..42: mol_type = genomic DNA
accgggagcagctcccgcgccgccgcccggccctagcccctg

SEQ ID NO: 6460 - DNA, 175 bp, Homo sapiens
  misc_feature 1..175: note = chr2:170219365-170219540
  misc_feature 1..175: note = hyper
  source 1..175: mol_type = genomic DNA
acagtcacacttcaacgccgacatacacagtcccctttacgcgtgcatacaagagcacactcctgtgcgcacactctcacaggcacactcacacgtgcacacgcgctgccctcgcctctccgcagggtttgccccgcacagaagccggcgaggcggctcacggggaaatctgcac

SEQ ID NO: 6461 - DNA, 51 bp, Homo sapiens
  misc_feature 1..51: note = chr2:170219958-170220009
  misc_feature 1..51: note = hyper
  source 1..51: mol_type = genomic DNA
aaaattgaaaaagagcgaacgtcttctccatggttccggtacccttttata

SEQ ID NO: 6462 - DNA, 358 bp, Homo sapiens
  misc_feature 1..358: note = chr2:171568345-171568703
  misc_feature 1..358: note = hyper
  source 1..358: mol_type = genomic DNA
gcgcaagtgtcactgcgggttcacctaccggcctcttcctctcgcaggtggcatgcagtcggcgctcgccgcccgcccgcaaagaaacggcaatgcaaacttcccagcctgggaaccccgctgcttggagagcagctccgctgtgccagccgccgccaggagactggtattcaacctccccgccccccgccacggttaaagtttgctccacattcgcagctcccaccccacccccatctccgccccgaggcaggaggaccacataggagttcctgggtccaccgtgcgcaaacacacccaccaacaaaagaaagcccattaaatcttccctcctgtgaactcgcgccccaacggatac

SEQ ID NO: 6463 - DNA, 431 bp, Homo sapiens
  misc_feature 1..431: note = chr2:171570470-171570901
  misc_feature 1..431: note = hyper
  source 1..431: mol_type = genomic DNA
gggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctgtactgacttttctcccgccttcgggatcctctctcgtatgatttgtggtttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtg

SEQ ID NO: 6464 - DNA, 35 bp, Homo sapiens
  misc_feature 1..35: note = chr2:171669891-171669926
  misc_feature 1..35: note = hyper
  source 1..35: mol_type = genomic DNA
gcttcccccagttctcgtctcgggagacagacgtt

SEQ ID NO: 6465 - DNA, 205 bp, Homo sapiens
  misc_feature 1..205: note = chr2:171670242-171670447
  misc_feature 1..205: note = hyper
  source 1..205: mol_type = genomic DNA
tcccccacccacccacgacggggaaaggaataaagggcattgtgggcggagggtcgtgttcccaagtcccagcggtggttgacctaaggaaacgttatcctcggcagacagggtggagtagccggggctgcaagctcgcaaatccctaatgccggagagagactggaggggtcgcatatcgccccctccttcttctgcctttgag

SEQ ID NO: 6466 - DNA, 401 bp, Homo sapiens
  misc_feature 1..401: note = chr2:171671389-171671790
  misc_feature 1..401: note = hyper
  source 1..401: mol_type = genomic DNA
gaaatgtctcaatctcgtgccacaggtgaagtaaacgaatcttcctttccagggaatcacgggttttgggaaaaggttgaggcgagcgggcgtctatgctggacaatgaagaacgaggggcaccgggagatgtgttgcctcctccttcctgtctcctgccccgtgcgtcttgaatgatttagcactggcacctggctccctgattggtgcgagcgtctcgtttagggaaggctctaggagggccggtggatggaattccgagcttcacctggttgtatgccgcccacttcaagcagcgcagagcagctgccggttgagtggtttggggggacgtttcctacgtggagcagacacccccagcctgtccagccccaagcctcagtgcccggggctgcagtcac

SEQ ID NO: 6467 - DNA, 18 bp, Homo sapiens
  misc_feature 1..18: note = chr2:171671799-171671817
  misc_feature 1..18: note = hyper
  source 1..18: mol_type = genomic DNA
cgccgtttaggatgtttt

SEQ ID NO: 6468 - DNA, 79 bp, Homo sapiens
  misc_feature 1..79: note = chr2:171674129-171674208
  misc_feature 1..79: note = hyper
  source 1..79: mol_type = genomic DNA
agagtcgagcaggggcgccgcgcaagatctttgtccgccgcctcctgcgcgctgcgcgcaagttcgtttccccggtgac

SEQ ID NO: 6469 - DNA, 129 bp, Homo sapiens
  misc_feature 1..129: note = chr2:171674744-171674873
  misc_feature 1..129: note = hyper
  source 1..129: mol_type = genomic DNA
accccgaccccgcctcgtctcggcgcttcactccaggtcgcgccgatgcaccgccagactcgagagcggcccagggctacgctccctgcgccccagtaccggagctagcgcgcacgtctcctccgctgc

SEQ ID NO: 6470 - DNA, 22 bp, Homo sapiens
  misc_feature 1..22: note = chr2:171675361-171675383
  misc_feature 1..22: note = hyper
  source 1..22: mol_type = genomic DNA
tgactcccagggcaccggaaag

SEQ ID NO: 6471 - DNA, 131 bp, Homo sapiens; identical to SEQ ID NO: 214
  misc_feature 1..131: note = chr2:171675522-171675653
  misc_feature 1..131: note = hyper
  source 1..131: mol_type = genomic DNA

SEQ ID NO: 6472 - DNA, 36 bp, Homo sapiens
  misc_feature 1..36: note = chr2:171678013-171678049
  misc_feature 1..36: note = hyper
  source 1..36: mol_type = genomic DNA
tgaagagcagccatgcgagcccgatcatctagtcaa

SEQ ID NO: 6473 - DNA, 30 bp, Homo sapiens
  misc_feature 1..30: note = chr2:172945137-172945167
  misc_feature 1..30: note = hyper
  source 1..30: mol_type = genomic DNA
gccgcccgaaggtcgcggtgacctggtgcc

SEQ ID NO: 6474 - DNA, 329 bp, Homo sapiens; identical to SEQ ID NO: 215
  misc_feature 1..329: note = chr2:172945896-172946225
  misc_feature 1..329: note = hyper
  source 1..329: mol_type = genomic DNA

SEQ ID NO: 6475 - DNA, 141 bp, Homo sapiens
  misc_feature 1..141: note = chr2:172947773-172947914
  misc_feature 1..141: note = hyper
  source 1..141: mol_type = genomic DNA
ggtcccctgtgctaccgcaaaagtctttgatccttttccagctgtggacacagagcacccaagagactgtcgcgatgtgcggccgtctctccccttcccccaccttgcaagtctctggaatacactgtccctaggcggccc

SEQ ID NO: 6476 - DNA, 95 bp, Homo sapiens
  misc_feature 1..95: note = chr2:172948219-172948314
  misc_feature 1..95: note = hyper
  source 1..95: mol_type = genomic DNA
gctacaaagcctcaccgtgtggttcggtgattaagaaaaaaaaaatcttttaaacgttggcaaacccgttattggtttggcgtattgggtttttt

SEQ ID NO: 6477 - DNA, 56 bp, Homo sapiens; identical to SEQ ID NO: 2081
  misc_feature 1..56: note = chr2:172949227-172949283
  misc_feature 1..56: note = hyper
  source 1..56: mol_type = genomic DNA

SEQ ID NO: 6478 - DNA, 499 bp, Homo sapiens; identical to SEQ ID NO: 2082
  misc_feature 1..499: note = chr2:172949348-172949847
  misc_feature 1..499: note = hyper
  source 1..499: mol_type = genomic DNA

SEQ ID NO: 6479 - DNA, 141 bp, Homo sapiens
  misc_feature 1..141: note = chr2:172950071-172950212
  misc_feature 1..141: note = hyper
  source 1..141: mol_type = genomic DNA
tacccgaggccgggccgcctcgcccgctctagtccagcggagcccgagcgcctcggaccaatccccagtgattatgcaagacagcggaccaatcagctccgccagctcatgaatatttatgaccttcgctgagtcaaagct

SEQ ID NO: 6480 - DNA, 292 bp, Homo sapiens
  misc_feature 1..292: note = chr2:172951251-172951543
  misc_feature 1..292: note = hyper
  source 1..292: mol_type = genomic DNA
tcagagtttcttgaacgttctctccctggtgctgcctccgccacccttcggtagccactcgctctcggctgttcgcactaaaggcggcccctcgtattaacaacgggccctacttctgctgtccctccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagaggg

SEQ ID NO: 6481 - DNA, 158 bp, Homo sapiens
  misc_feature 1..158: note = chr2:172952393-172952551
  misc_feature 1..158: note = hyper
  source 1..158: mol_type = genomic DNA
aggcgctgtatcttccgcaggcggtagccacggtcggactgagcccctggcaggctaaggcctggatcccggttctcccctcatcacaactcctccctggctctctgagagctgcccccgtgggctgacggcggcgggaggttcggccttcgagcctt

SEQ ID NO: 6482 - DNA, 323 bp, Homo sapiens; identical to SEQ ID NO: 216
  misc_feature 1..323: note = chr2:172955471-172955794
  misc_feature 1..323: note = hyper
  source 1..323: mol_type = genomic DNA

SEQ ID NO: 6483 - DNA, 59 bp, Homo sapiens; identical to SEQ ID NO: 217
  misc_feature 1..59: note = chr2:172957976-172958035
  misc_feature 1..59: note = hyper
  source 1..59: mol_type = genomic DNA

SEQ ID NO: 6484 - DNA, 335 bp, Homo sapiens
  misc_feature 1..335: note = chr2:172961325-172961660
  misc_feature 1..335: note = hyper
  source 1..335: mol_type = genomic DNA
gcgggagtacctgggcggcaggcagttggccctggagctcagtgcccgcgttctgcctgagttgggagagccctgccagagggtggagcggagagggccgtgcacccctcactcttcagcttccctccccctgcttcccagcgcttgtcatatcctgtctctggcctgatatttcacgcgagcaattggaaggagattacaatggagatttatgtgtgttctgagcactgctagtttcccagcgtagagagccgagatcgctgcttcccatttccatttttcattcgcgctttggggagctcagtagagcacggggggagcgtgtctgcgcggcg

SEQ ID NO: 6485 - DNA, 94 bp, Homo sapiens; identical to SEQ ID NO: 218
  misc_feature 1..94: note = chr2:172964795-172964889
  misc_feature 1..94: note = hyper
  source 1..94: mol_type = genomic DNA

SEQ ID NO: 6486 - skipped

SEQ ID NO: 6487 - DNA, 116 bp, Homo sapiens; identical to SEQ ID NO: 220
  misc_feature 1..116: note = chr2:172965647-172965763
  misc_feature 1..116: note = hyper
  source 1..116: mol_type = genomic DNA

SEQ ID NO: 6488 - DNA, 802 bp, Homo sapiens; identical to SEQ ID NO: 221
  misc_feature 1..802: note = chr2:172966250-172967052
  misc_feature 1..802: note = hyper
  source 1..802: mol_type = genomic DNA

SEQ ID NO: 6489 - DNA, 395 bp, Homo sapiens
  misc_feature 1..395: note = chr2:172970975-172971370
  misc_feature 1..395: note = hyper
  source 1..395: mol_type = genomic DNA
gagaggacaagtctgcgctttgctctcagacccttgccccaccgctagcctggggcaggattccagccttcgcctagccgggcgctttgctctgccgggctattgggcgtcctccgctgcacagaaagccagcccagttgggtattactggggagaggatgcctcctgtcggcagggagctagggtgggcgcccgggtgccctcagtgcgtggcggggccaggcccattttcactctccttcctcactcgggggatgggagggctgcatgcgctgctgctcctactcctcacagtctcgtcgagggtcccggagacgggagtttccgggccgctggtccaagaggcaatgccagtttcggtacctttgtgttttcgtccccgaagtagtagctct

SEQ ID NO: 6490 - DNA, 269 bp, Homo sapiens
  misc_feature 1..269: note = chr2:172972981-172973250
  misc_feature 1..269: note = hyper
  source 1..269: mol_type = genomic DNA
ggagaggaggaggcccgcccggctgcgcagagggtagccccgggaagattcctgaacagactcgagcctctgcggagagggcgggatgcgggtgccccctggcttggcacgtgaagccaagcttgaggacctgatgttttgttcccgctgggattccgccccaagttatctttgctccctgctggggtgtaagtaaaccccaggggcttgaaccgaaatcatcggttactcgacgcttccagccgtggcctttccgcggcgctgggctt

SEQ ID NO: 6491 - DNA, 356 bp, Homo sapiens
  misc_feature 1..356: note = chr2:173099741-173100097
  misc_feature 1..356: note = hyper
  source 1..356: mol_type = genomic DNA
cagcatcggcagcatcgagaaaggtgacgagttctgcaaataacagctgcggagcaatcgttatgtttggacaacgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgc

SEQ ID NO: 6492 - DNA, 194 bp, Homo sapiens
  misc_feature 1..194: note = chr2:173100098-173100292
  misc_feature 1..194: note = hyper
  source 1..194: mol_type = genomic DNA
gcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtata

SEQ ID NO: 6493 - DNA, 90 bp, Homo sapiens
  misc_feature 1..90: note = chr2:173600600-173600690
  misc_feature 1..90: note = hyper
  source 1..90: mol_type = genomic DNA
ggcgtccgggaggagcggggtccgcgcggcggacgaggcgggggcggaggcgcaggcagagcgagcgcgggaggtcgccgcagccaggga

SEQ ID NO: 6494 - DNA, 1168 bp, Homo sapiens; identical to SEQ ID NO: 222
  misc_feature 1..1168: note = chr2:175190805-175191973
  misc_feature 1..1168: note = hyper
  source 1..1168: mol_type = genomic DNA

SEQ ID NO: 6495 - DNA, 149 bp, Homo sapiens; identical to SEQ ID NO: 223
  misc_feature 1..149: note = chr2:175192084-175192233
  misc_feature 1..149: note = hyper
  source 1..149: mol_type = genomic DNA

SEQ ID NO: 6496 - DNA, 83 bp, Homo sapiens; identical to SEQ ID NO: 224
  misc_feature 1..83: note = chr2:175193294-175193377
  misc_feature 1..83: note = hyper
  source 1..83: mol_type = genomic DNA

SEQ ID NO: 6497 - DNA, 267 bp, Homo sapiens; identical to SEQ ID NO: 225
  misc_feature 1..267: note = chr2:175193378-175193645
  misc_feature 1..267: note = hyper
  source 1..267: mol_type = genomic DNA

SEQ ID NO: 6498 - DNA, 35 bp, Homo sapiens; identical to SEQ ID NO: 226
  misc_feature 1..35: note = chr2:175193808-175193843
  misc_feature 1..35: note = hyper
  source 1..35: mol_type = genomic DNA

SEQ ID NO: 6499 - DNA, 86 bp, Homo sapiens
  misc_feature 1..86: note = chr2:175197089-175197175
  misc_feature 1..86: note = hyper
  source 1..86: mol_type = genomic DNA
attgtgatgcagacgcgtgtatctaaaggaatatgcgagtgcccacgtctagagtctgacagctggaactacggggaaaacggcgg

SEQ ID NO: 6500 - DNA, 90 bp, Homo sapiens; identical to SEQ ID NO: 227
  misc_feature 1..90: note = chr2:175199465-175199555
  misc_feature 1..90: note = hyper
  source 1..90: mol_type = genomic DNA

SEQ ID NO: 6501 - skipped

SEQ ID NO: 6502 - DNA, 181 bp, Homo sapiens; identical to SEQ ID NO: 229
  misc_feature 1..181: note = chr2:175200260-175200441
  misc_feature 1..181: note = hyper
  source 1..181: mol_type = genomic DNA

SEQ ID NO: 6503 - DNA, 144 bp, Homo sapiens; identical to SEQ ID NO: 230
  misc_feature 1..144: note = chr2:175200709-175200853
  misc_feature 1..144: note = hyper
  source 1..144: mol_type = genomic DNA

SEQ ID NO: 6504 - DNA, 267 bp, Homo sapiens; identical to SEQ ID NO: 231
  misc_feature 1..267: note = chr2:175200916-175201183
  misc_feature 1..267: note = hyper
  source 1..267: mol_type = genomic DNA

SEQ ID NO: 6505 - DNA, 183 bp, Homo sapiens; identical to SEQ ID NO: 232
  misc_feature 1..183: note = chr2:175201359-175201542
  misc_feature 1..183: note = hyper
  source 1..183: mol_type = genomic DNA

SEQ ID NO: 6506 - DNA, 54 bp, Homo sapiens; identical to SEQ ID NO: 233
  misc_feature 1..54: note = chr2:175201775-175201829
  misc_feature 1..54: note = hyper
  source 1..54: mol_type = genomic DNA

SEQ ID NO: 6507 - DNA, 120 bp, Homo sapiens; identical to SEQ ID NO: 234
  misc_feature 1..120: note = chr2:175202126-175202246
  misc_feature 1..120: note = hyper
  source 1..120: mol_type = genomic DNA

SEQ ID NO: 6508 - DNA, 33 bp, Homo sapiens; identical to SEQ ID NO: 235
  misc_feature 1..33: note = chr2:175202568-175202601
  misc_feature 1..33: note = hyper
  source 1..33: mol_type = genomic DNA

SEQ ID NO: 6509 - DNA, 78 bp, Homo sapiens; identical to SEQ ID NO: 236
  misc_feature 1..78: note = chr2:175202633-175202711
  misc_feature 1..78: note = hyper
  source 1..78: mol_type = genomic DNA

SEQ ID NO: 6510 - DNA, 30 bp, Homo sapiens
  misc_feature 1..30: note = chr2:175203142-175203172
  misc_feature 1..30: note = hyper
  source 1..30: mol_type = genomic DNA
taaagaaattaaatgcgtttatctgtatca

SEQ ID NO: 6511 - DNA, 119 bp, Homo sapiens; identical to SEQ ID NO: 237
  misc_feature 1..119: note = chr2:175204828-175204947
  misc_feature 1..119: note = hyper
  source 1..119: mol_type = genomic DNA

SEQ ID NO: 6512 - DNA, 58 bp, Homo sapiens
  misc_feature 1..58: note = chr2:175206848-175206906
  misc_feature 1..58: note = hyper
  source 1..58: mol_type = genomic DNA
cggctggaaccaggccgattcaaacaggccaccaaaccatcccacccccctaccccct

SEQ ID NO: 6513 - DNA, 606 bp, Homo sapiens
  misc_feature 1..606: note = chr2:175206960-175207566
  misc_feature 1..606: note = hyper
  source 1..606: mol_type = genomic DNA
cgggccggagcagccttctgcattgccttcgtcctccggcggacaccccagcccgagtggggcgcggggggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttctctcctctcagcgtatcgtcctccccctgccgcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacctttgcggcgggtaactcggctgggtttgtat

SEQ ID NO: 6514 - DNA, 558 bp, Homo sapiens; identical to SEQ ID NO: 238
  misc_feature 1..558: note = chr2:175208311-175208869
  misc_feature 1..558: note = hyper
  source 1..558: mol_type = genomic DNA

SEQ ID NO: 6515 - DNA, 93 bp, Homo sapiens; identical to SEQ ID NO: 239
  misc_feature 1..93: note = chr2:175208996-175209089
  misc_feature 1..93: note = hyper
  source 1..93: mol_type = genomic DNA

SEQ ID NO: 6516 - DNA, 30 bp, Homo sapiens
  misc_feature 1..30: note = chr2:175547125-175547155
  misc_feature 1..30: note = hyper
  source 1..30: mol_type = genomic DNA
cgcgaagcccctgctcgagacctacggaga

SEQ ID NO: 6517 - DNA, 201 bp, Homo sapiens
  misc_feature 1..201: note = chr2:175547440-175547641
  misc_feature 1..201: note = hyper
  source 1..201: mol_type = genomic DNA
gtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgcgaccatccgggaac

SEQ ID NO: 6518 - DNA, 148 bp, Homo sapiens; identical to SEQ ID NO: 2107
  misc_feature 1..148: note = chr2:176940167-176940315
  misc_feature 1..148: note = hyper
  source 1..148: mol_type = genomic DNA

SEQ ID NO: 6519 - DNA, 43 bp, Homo sapiens
  misc_feature 1..43: note = chr2:176943640-176943683
  misc_feature 1..43: note = hyper
  source 1..43: mol_type = genomic DNA
aacccctccagtagccgggttggcagagcgggtctcagcaacc

SEQ ID NO: 6520 - DNA, 59 bp, Homo sapiens; identical to SEQ ID NO: 240
  misc_feature 1..59: note = chr2:176944346-176944405
  misc_feature 1..59: note = hyper
  source 1..59: mol_type = genomic DNA

SEQ ID NO: 6521 - DNA, 391 bp, Homo sapiens; identical to SEQ ID NO: 241
  misc_feature 1..391: note = chr2:176944456-176944847
  misc_feature 1..391: note = hyper
  source 1..391: mol_type = genomic DNA

SEQ ID NO: 6522 - DNA, 132 bp, Homo sapiens; identical to SEQ ID NO: 242
  misc_feature 1..132: note = chr2:176945137-176945269
  misc_feature 1..132: note = hyper
  source 1..132: mol_type = genomic DNA

SEQ ID NO: 6523 - DNA, 203 bp, Homo sapiens; identical to SEQ ID NO: 243
  misc_feature 1..203: note = chr2:176945581-176945784
  misc_feature 1..203: note = hyper
  source 1..203: mol_type = genomic DNA

SEQ ID NO: 6524 - DNA, 30 bp, Homo sapiens
  misc_feature 1..30: note = chr2:176947306-176947336
  misc_feature 1..30: note = hyper
  source 1..30: mol_type = genomic DNA
cttacaaattgctgccgttaatggaatcaa

SEQ ID NO: 6525 - DNA, 140 bp, Homo sapiens
  misc_feature 1..140: note = chr2:176947763-176947903
  misc_feature 1..140: note = hyper
  source 1..140: mol_type = genomic DNA
cggctgctgactaggggtctaccggctcgctcgggctcttagacacgagcgcagaaacattttctcggactcaggagcgagggcgggtgggcctggtgttccaggctccgcaggcctgagcctggcgggaaagctcaagg

SEQ ID NO: 6526 - DNA, 227 bp, Homo sapiens
  misc_feature 1..227: note = chr2:176948848-176949075
  misc_feature 1..227: note = hyper
  source 1..227: mol_type = genomic DNA
gatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttaggtcctaatcatgcagcgccttcttcatttt

SEQ ID NO: 6527 - DNA, 43 bp, Homo sapiens; identical to SEQ ID NO: 2112
  misc_feature 1..43: note = chr2:176949959-176950002
  misc_feature 1..43: note = hyper
  source 1..43: mol_type = genomic DNA

SEQ ID NO: 6528 - DNA, 184 bp, Homo sapiens; identical to SEQ ID NO: 2113
  misc_feature 1..184: note = chr2:176950074-176950258
  misc_feature 1..184: note = hyper
  source 1..184: mol_type = genomic DNA

SEQ ID NO: 6529 - DNA, 30 bp, Homo sapiens
  misc_feature 1..30: note = chr2:176952943-176952973
  misc_feature 1..30: note = hyper
  source 1..30: mol_type = genomic DNA
cacgggtgcaggtttcgctgcataagggaa

SEQ ID NO: 6530 - DNA, 69 bp, Homo sapiens
  misc_feature 1..69: note = chr2:176957047-176957116
  misc_feature 1..69: note = hyper
  source 1..69: mol_type = genomic DNA
tgcaactcggggagccgaggagaggtggcaaaaacagcggttgccgagacaaggcgcaggccttggcgc

SEQ ID NO: 6531 - DNA, 68 bp, Homo sapiens; identical to SEQ ID NO: 244
  misc_feature 1..68: note = chr2:176957347-176957415
  misc_feature 1..68: note = hyper
  source 1..68: mol_type = genomic DNA

SEQ ID NO: 6532 - DNA, 53 bp, Homo sapiens; identical to SEQ ID NO: 245
  misc_feature 1..53: note = chr2:176957576-176957629
  misc_feature 1..53: note = hyper
  source 1..53: mol_type = genomic DNA

SEQ ID NO: 6533 - DNA, 207 bp, Homo sapiens; identical to SEQ ID NO: 246
  misc_feature 1..207: note = chr2:176957914-176958121
  misc_feature 1..207: note = hyper
  source 1..207: mol_type = genomic DNA

SEQ ID NO: 6534 - DNA, 52 bp, Homo sapiens; identical to SEQ ID NO: 2117
  misc_feature 1..52: note = chr2:176958391-176958443
  misc_feature 1..52: note = hyper
  source 1..52: mol_type = genomic DNA

SEQ ID NO: 6535 - DNA, 298 bp, Homo sapiens; identical to SEQ ID NO: 247
  misc_feature 1..298: note = chr2:176959213-176959511
  misc_feature 1..298: note = hyper
  source 1..298: mol_type = genomic DNA

SEQ ID NO: 6536 - DNA, 30 bp, Homo sapiens
  misc_feature 1..30: note = chr2:176963448-176963478
  misc_feature 1..30: note = hyper
  source 1..30: mol_type = genomic DNA
tgagcacaccgctcccggctaagaactgct

SEQ ID NO: 6537 - DNA, 213 bp, Homo sapiens; identical to SEQ ID NO: 2119
  misc_feature 1..213: note = chr2:176964389-176964602
  misc_feature 1..213: note = hyper
  source 1..213: mol_type = genomic DNA

SEQ ID NO: 6538 - DNA, 36 bp, Homo sapiens
  misc_feature 1..36: note = chr2:176965474-176965510
  misc_feature 1..36: note = hyper
  source 1..36: mol_type = genomic DNA
tggcgctctactagccgcgcgcgtggccagggccgg

SEQ ID NO: 6539 - DNA, 48 bp, Homo sapiens
  misc_feature 1..48: note = chr2:176969256-176969304
  misc_feature 1..48: note = hyper
  source 1..48: mol_type = genomic DNA
cggagcggctggctgcgccccgaaggcctggtgcgctccctgcgtttc

SEQ ID NO: 6540 - DNA, 35 bp, Homo sapiens; identical to SEQ ID NO: 2120
  misc_feature 1..35: note = chr2:176969579-176969614
  misc_feature 1..35: note = hyper
  source 1..35: mol_type = genomic DNA

SEQ ID NO: 6541 - DNA, 69 bp, Homo sapiens; identical to SEQ ID NO: 2121
  misc_feature 1..69: note = chr2:176969676-176969745
  misc_feature 1..69: note = hyper
  source 1..69: mol_type = genomic DNA

SEQ ID NO: 6542 - DNA, 30 bp, Homo sapiens
  misc_feature 1..30: note = chr2:176971402-176971432
  misc_feature 1..30: note = hyper
  source 1..30: mol_type = genomic DNA
tggcgaaattactcccgcccggtgaacaag

SEQ ID NO: 6543 - DNA, 30 bp, Homo sapiens
  misc_feature 1..30: note = chr2:176972908-176972938
  misc_feature 1..30: note = hyper
  source 1..30: mol_type = genomic DNA
gggagggggggggggcggaggcctccctct

SEQ ID NO: 6544 - DNA, 105 bp, Homo sapiens; identical to SEQ ID NO: 2122
  misc_feature 1..105: note = chr2:176976065-176976170
  misc_feature 1..105: note = hyper
  source 1..105: mol_type = genomic DNA

SEQ ID NO: 6545 - DNA, 168 bp, Homo sapiens; identical to SEQ ID NO: 248
  misc_feature 1..168: note = chr2:176980770-176980938
  misc_feature 1..168: note = hyper
  source 1..168: mol_type = genomic DNA

SEQ ID NO: 6546 - DNA, 130 bp, Homo sapiens; identical to SEQ ID NO: 249
  misc_feature 1..130: note = chr2:176981376-176981506
  misc_feature 1..130: note = hyper
  source 1..130: mol_type = genomic DNA

SEQ ID NO: 6547 - DNA, 30 bp, Homo sapiens
  misc_feature 1..30: note = chr2:176982584-176982614
  misc_feature 1..30: note = hyper
  source 1..30: mol_type = genomic DNA
cgcaaaggagacctgcggctcataaacacg

SEQ ID NO: 6548 - DNA, 30 bp, Homo sapiens
  misc_feature 1..30: note = chr2:176983753-176983783
  misc_feature 1..30: note = hyper
  source 1..30: mol_type = genomic DNA
acactaagcaccaaacgctggaattagaaa

SEQ ID NO: 6549 - DNA, 504 bp, Homo sapiens; identical to SEQ ID NO: 2125
  misc_feature 1..504: note = chr2:176986711-176987215
  misc_feature 1..504: note = hyper
  source 1..504: mol_type = genomic DNA

SEQ ID NO: 6550 - DNA, 277 bp, Homo sapiens; identical to SEQ ID NO: 2126
  misc_feature 1..277: note = chr2:176993514-176993791
  misc_feature 1..277: note = hyper
  source 1..277: mol_type = genomic DNA

SEQ ID NO: 6551 - DNA, 256 bp, Homo sapiens; identical to SEQ ID NO: 2127
  misc_feature 1..256: note = chr2:176994124-176994380
  misc_feature 1..256: note = hyper
  source 1..256: mol_type = genomic DNA

SEQ ID NO: 6552 - DNA, 63 bp, Homo sapiens; identical to SEQ ID NO: 2128
  misc_feature 1..63: note = chr2:176994497-176994560
  misc_feature 1..63: note = hyper
  source 1..63: mol_type = genomic DNA

SEQ ID NO: 6553 - DNA, 288 bp, Homo sapiens
  misc_feature 1..288: note = chr2:176995380-176995668
  misc_feature 1..288: note = hyper
  source 1..288: mol_type = genomic DNA
ccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccac

SEQ ID NO: 6554 - DNA, 38 bp, Homo sapiens
  misc_feature 1..38: note = chr2:176996261-176996299
  misc_feature 1..38: note = hyper
  source 1..38: mol_type = genomic DNA
gcaggaggtgaaggacggggaaacgaaaaaggaagccc

SEQ ID NO: 6555 - DNA, 57 bp, Homo sapiens; identical to SEQ ID NO: 250
  misc_feature 1..57: note = chr2:177001206-177001263
  misc_feature 1..57: note = hyper
  source 1..57: mol_type = genomic DNA

SEQ ID NO: 6556 - DNA, 432 bp, Homo sapiens; identical to SEQ ID NO: 251
  misc_feature 1..432: note = chr2:177001264-177001696
  misc_feature 1..432: note = hyper
  source 1..432: mol_type = genomic DNA

SEQ ID NO: 6557 - DNA, 75 bp, Homo sapiens; identical to SEQ ID NO: 252
  misc_feature 1..75: note = chr2:177001781-177001856
  misc_feature 1..75: note = hyper
  source 1..75: mol_type = genomic DNA

SEQ ID NO: 6558 - DNA, 101 bp, Homo sapiens
  misc_feature 1..101: note = chr2:177004982-177005083
  misc_feature 1..101: note = hyper
  source 1..101: mol_type = genomic DNA
ttcaggccaatccttcggcctgaccattcccggatcttgttatgccagcacagcacattcgagggctctggggggcagcagctcggcgaagagcagtcaaa

SEQ ID NO: 6559 - DNA, 35 bp, Homo sapiens
  misc_feature 1..35: note = chr2:177005582-177005617
  misc_feature 1..35: note = hyper
  source 1..35: mol_type = genomic DNA
ctgggagcctagggccgttccgggttggcgggcca

SEQ ID NO: 6560 - DNA, 55 bp, Homo sapiens
  misc_feature 1..55: note = chr2:177042646-177042701
  misc_feature 1..55: note = hyper
  source 1..55: mol_type = genomic DNA
tccctcaatccccctcggttaccccttggggcagcaacgacgccatcccagcccc

SEQ ID NO: 6561 - DNA, 73 bp, Homo sapiens; identical to SEQ ID NO: 2132
  misc_feature 1..73: note = chr2:177042926-177042999
  misc_feature 1..73: note = hyper
  source 1..73: mol_type = genomic DNA

SEQ ID NO: 6562 - DNA, 82 bp, Homo sapiens
  misc_feature 1..82: note = chr2:177043427-177043509
  misc_feature 1..82: note = hyper
  source 1..82: mol_type = genomic DNA
gcctgcacccacacccgcccctgagccacagtgaccttgcattccccgccccctgccacacctcctgcgtgcccgagtgtca

SEQ ID NO: 6563 - DNA, 56 bp, Homo sapiens
  misc_feature 1..56: note = chr2:177053379-177053435
  misc_feature 1..56: note = hyper
  source 1..56: mol_type = genomic DNA
tacctccggctcactcgccatgggttggagagggcagctcgggtagagagggctgg

SEQ ID NO: 6564 - DNA, 85 bp, Homo sapiens
  misc_feature 1..85: note = chr2:177053618-177053703
  misc_feature 1..85: note = hyper
  source 1..85: mol_type = genomic DNA
cgacgcccggcccgtggctctgcagcccgccttccctctgggcaacggcgacggcgccttcgtcagctgtctgcccctggccgcc

SEQ ID NO: 6565 - DNA, 19 bp, Homo sapiens
  misc_feature 1..19: note = chr2:177053935-177053954
  misc_feature 1..19: note = hyper
  source 1..19: mol_type = genomic DNA
cctcggccgtcttctcggg

SEQ ID NO: 6566 - DNA, 364 bp, Homo sapiens; identical to SEQ ID NO: 254
  misc_feature 1..364: note = chr2:177053999-177054363
  misc_feature 1..364: note = hyper
  source 1..364: mol_type = genomic DNA

SEQ ID NO: 6567 - DNA, 60 bp, Homo sapiens
  misc_feature 1..60: note = chr2:177502788-177502848
  misc_feature 1..60: note = hyper
  source 1..60: mol_type = genomic DNA
ccgccgcgggcagggcgctccgctcccggaccccgaatctgaaagcggagaccaagggct

SEQ ID NO: 6568 - DNA, 30 bp, Homo sapiens
  misc_feature 1..30: note = chr2:179278479-179278509
  misc_feature 1..30: note = hyper
  source 1..30: mol_type = genomic DNA
tcgtgcttggttttccggaccttgcttcct

SEQ ID NO: 6569 - DNA, 51 bp, Homo sapiens
  misc_feature 1..51: note = chr2:179278710-179278761
  misc_feature 1..51: note = hyper
  source 1..51: mol_type = genomic DNA
cacaaaaagcaggaacgagtagcggtggctgaagaacgagcaggagcttga

SEQ ID NO: 6570 - DNA, 487 bp, Homo sapiens
  misc_feature 1..487: note = chr2:180725172-180725659
  misc_feature 1..487: note = hyper
  source 1..487: mol_type = genomic DNA
ccctccccttctcctcgtcccttccgcagtcccacagtgtcctcccacccttccctgacaccttcaccagcgcttagtggccgaggccgcccgtcagggctcccaacaagtgcaaacttcggggaccttctctctgctcctctgcccccatctcatctgggttctgctgcagaactctcccacgaccccaagcttcgaccgctaccctcctcacacacctcggtcccctaactacccatttcccggtcattgagagaaagacaaaccccaaacttccagcccaggtgacgaggcgctgcggctaaacatagcggggcactctcctcgtcctttcccctctccatccgtccttgggaattggagcctaccctggggaacagaggagtatgctcctgtggcttccacgacctaatcctaactccagggactcgcaggagttaggattaggtcgtggaagccacaggcgcctgggcgccctcctctacaa

SEQ ID NO: 6571 - DNA, 35 bp, Homo sapiens
  misc_feature 1..35: note = chr2:180726046-180726081
  misc_feature 1..35: note = hyper
  source 1..35: mol_type = genomic DNA
tgtccaactcttgcccgcgccgggcttaagcgccc

SEQ ID NO: 6572 - DNA, 158 bp, Homo sapiens; identical to SEQ ID NO: 255
  misc_feature 1..158: note = chr2:182321397-182321555
  misc_feature 1..158: note = hyper
  source 1..158: mol_type = genomic DNA

SEQ ID NO: 6573 - DNA, 27 bp, Homo sapiens
  misc_feature 1..27: note = chr2:182321811-182321838
  misc_feature 1..27: note = hyper
  source 1..27: mol_type = genomic DNA
ctggcatttgggccacgccgggctggg

SEQ ID NO: 6574 - DNA, 154 bp, Homo sapiens; identical to SEQ ID NO: 257
  misc_feature 1..154: note = chr2:182322038-182322192
  misc_feature 1..154: note = hyper
  source 1..154: mol_type = genomic DNA

SEQ ID NO: 6575 - DNA, 631 bp, Homo sapiens; identical to SEQ ID NO: 258
  misc_feature 1..631: note = chr2:182322399-182323030
  misc_feature 1..631: note = hyper
  source 1..631: mol_type = genomic DNA

SEQ ID NO: 6576 - DNA, 440 bp, Homo sapiens; identical to SEQ ID NO: 2139
  misc_feature 1..440: note = chr2:182542878-182543318
  misc_feature 1..440: note = hyper
  source 1..440: mol_type = genomic DNA

SEQ ID NO: 6577 - DNA, 397 bp, Homo sapiens; identical to SEQ ID NO: 2140
  misc_feature 1..397: note = chr2:182545388-182545785
  misc_feature 1..397: note = hyper
  source 1..397: mol_type = genomic DNA

SEQ ID NO: 6578 - DNA, 84 bp, Homo sapiens; identical to SEQ ID NO: 2141
  misc_feature 1..84: note = chr2:182546001-182546085
  misc_feature 1..84: note = hyper
  source 1..84: mol_type = genomic DNA

SEQ ID NO: 6579 - DNA, 47 bp, Homo sapiens
  misc_feature 1..47: note = chr2:182546488-182546535
  misc_feature 1..47: note = hyper
  source 1..47: mol_type = genomic DNA
tgctcccctcagtctcgggtctgtataagatacttgattcagacaag

SEQ ID NO: 6580 - DNA, 495 bp, Homo sapiens; identical to SEQ ID NO: 259
  misc_feature 1..495: note = chr2:182547437-182547932
  misc_feature 1..495: note = hyper
  source 1..495: mol_type = genomic DNA

SEQ ID NO: 6581 - DNA, 100 bp, Homo sapiens; identical to SEQ ID NO: 260
  misc_feature 1..100: note = chr2:182548061-182548161
  misc_feature 1..100: note = hyper
  source 1..100: mol_type = genomic DNA

SEQ ID NO: 6582 - DNA, 30 bp, Homo sapiens
  misc_feature 1..30: note = chr2:182548451-182548481
  misc_feature 1..30: note = hyper
  source 1..30: mol_type = genomic DNA
ccgcgggaaggggggcgggaggaggcgtgt

SEQ ID NO: 6583 - DNA, 55 bp, Homo sapiens
  misc_feature 1..55: note = chr2:182548734-182548789
  misc_feature 1..55: note = hyper
  source 1..55: mol_type = genomic DNA
gcaaagggaggtttgcgttcaatgaaaggatcaagtgtggccagggcagcccggc

SEQ ID NO: 6584 - DNA, 15 bp, Homo sapiens
  misc_feature 1..15: note = chr2:182548819-182548834
  misc_feature 1..15: note = hyper
  source 1..15: mol_type = genomic DNA
cgccctgcctaggag

SEQ ID NO: 6585 - DNA, 366 bp, Homo sapiens; identical to SEQ ID NO: 2144
  misc_feature 1..366: note = chr2:182549088-182549454
  misc_feature 1..366: note = hyper
  source 1..366: mol_type = genomic DNA

SEQ ID NO: 6586 - DNA, 30 bp, Homo sapiens
  misc_feature 1..30: note = chr2:182550094-182550124
  misc_feature 1..30: note = hyper
  source 1..30: mol_type = genomic DNA
ttgggagagaggacccggacaagttcctaa

SEQ ID NO: 6587 - DNA, 301 bp, Homo sapiens
  misc_feature 1..301: note = chr2:182819048-182819349
  misc_feature 1..301: note = hyper
  source 1..301: mol_type = genomic DNA
cccaccccaccaccccgacctccacatacattcccccgaccccctccagcagtgaagtctaagagcaccgcgaagtaatttaaattttcgagggaaagcacagcgccatctgtcggacatcatgccaattactcttgttaagttcctacctgacggttactttatactttgaactgctaggtactccttttggcctaaggacacagtgaaaaatgtaccgagaccttggagagccacgaaccaagaaacttcagaaacctctgatatctgatcaagagttaagagacgtcagaatcatcac

SEQ ID NO: 6588 - DNA, 110 bp, Homo sapiens; identical to SEQ ID NO: 2145
  misc_feature 1..110: note = chr2:183731222-183731332
  misc_feature 1..110: note = hyper
  source 1..110: mol_type = genomic DNA

SEQ ID NO: 6589 - DNA, 640 bp, Homo sapiens; identical to SEQ ID NO: 2146
  misc_feature 1..640: note = chr2:183731466-183732106
  misc_feature 1..640: note = hyper
  source 1..640: mol_type = genomic DNA

SEQ ID NO: 6590 - DNA, 158 bp, Homo sapiens
  misc_feature 1..158: note = chr2:185462831-185462989
  misc_feature 1..158: note = hyper
  source 1..158: mol_type = genomic DNA
tcttgagaaagaagccgctgctggcaccggcctggattcgctgcagtcggaagcgggtggctttcggtattgaattattaatttatttatccccctcgcccccacccccacgccgactgccaggcaagaaatcgcggcctcttcgcttcctctccgcc

SEQ ID NO: 6591 - DNA, 500 bp, Homo sapiens; identical to SEQ ID NO: 2147
  misc_feature 1..500: note = chr2:185463255-185463755
  misc_feature 1..500: note = hyper
  source 1..500: mol_type = genomic DNA

SEQ ID NO: 6592 - DNA, 61 bp, Homo sapiens
  misc_feature 1..61: note = chr2:186603457-186603518
  misc_feature 1..61: note = hyper
  source 1..61: mol_type = genomic DNA
ccgcccttctggggccgctaccattggaagcctggaacgcggggggcggggctgaggtcgt

SEQ ID NO: 6593 - DNA, 293 bp, Homo sapiens; identical to SEQ ID NO: 2148
  misc_feature 1..293: note = chr2:193059025-193059318
  misc_feature 1..293: note = hyper
  source 1..293: mol_type = genomic DNA

SEQ ID NO: 6594 - DNA, 165 bp, Homo sapiens; identical to SEQ ID NO: 2149
  misc_feature 1..165: note = chr2:193059344-193059509
  misc_feature 1..165: note = hyper
  source 1..165: mol_type = genomic DNA

SEQ ID NO: 6595 - DNA, 707 bp, Homo sapiens; identical to SEQ ID NO: 2150
  misc_feature 1..707: note = chr2:193059734-193060441
  misc_feature 1..707: note = hyper
  source 1..707: mol_type = genomic DNA

SEQ ID NO: 6596 - DNA, 271 bp, Homo sapiens; identical to SEQ ID NO: 2151
  misc_feature 1..271: note = chr2:193060675-193060946
  misc_feature 1..271: note = hyper
  source 1..271: mol_type = genomic DNA

SEQ ID NO: 6597 - DNA, 423 bp, Homo sapiens
  misc_feature 1..423: note = chr2:197457404-197457827
  misc_feature 1..423: note = hyper
  source 1..423: mol_type = genomic DNA
tggcaaatgaatgaccgcgccggggcgcaagggaggaaaaacaaagccacctcccgccgtccgctacctgcggcgagggccgcgcgctcacctgggctttgcgcccgtcgccacaagctgcgggtggggacccggccgcggggcgggagggcgcccccaaagtcgcccggacccgcggccccggcgccctgcggccggtccgtgcgcgccgaggagaaagcaggcggccgggggcgccgccgcgcgttgcatgcagctcacggctgctgcggccgctgccacggagccgagagtctctgcgctgcagtccccgaccccgagaccgcgagaagcgcccggagagacgcggcgcaggggcagagcgcgctcggcgcgcccctcagcggctcttcccgccgccctccgcagcgggctgggtctcgg

SEQ ID NO: 6598 - DNA, 66 bp, Homo sapiens
  misc_feature 1..66: note = chr2:197458195-197458261
  misc_feature 1..66: note = hyper
  source 1..66: mol_type = genomic DNA
ccggtccgcggagagcgaagagtccggcctcctcacctccagccgcgccggcgcccttcccgctag

SEQ ID NO: 6599 - DNA, 30 bp, Homo sapiens
  misc_feature 1..30: note = chr2:198651504-198651534
  misc_feature 1..30: note = hyper
  source 1..30: mol_type = genomic DNA
agcgggtcccggccccgctgagcacctcca

SEQ ID NO: 6600 - DNA, 29 bp, Homo sapiens
  misc_feature 1..29: note = chr2:200327423-200327452
  misc_feature 1..29: note = hyper
  source 1..29: mol_type = genomic DNA
ggaggtagagactgtggaggtcctcctcc

SEQ ID NO: 6601 - DNA, 46 bp, Homo sapiens
  misc_feature 1..46: note = chr2:200328258-200328304
  misc_feature 1..46: note = hyper
  source 1..46: mol_type = genomic DNA
ggcccggagccccagcgtcctctcccgacagcgccaccgcgtgggc

SEQ ID NO: 6602 - DNA, 365 bp, Homo sapiens; identical to SEQ ID NO: 2153
  misc_feature 1..365: note = chr2:200329029-200329394
  misc_feature 1..365: note = hyper
  source 1..365: mol_type = genomic DNA

SEQ ID NO: 6603 - DNA, 262 bp, Homo sapiens; identical to SEQ ID NO: 2154
  misc_feature 1..262: note = chr2:200329432-200329694
  misc_feature 1..262: note = hyper
  source 1..262: mol_type = genomic DNA

SEQ ID NO: 6604 - DNA, 30 bp, Homo sapiens
  misc_feature 1..30: note = chr2:200334190-200334220
  misc_feature 1..30: note = hyper
  source 1..30: mol_type = genomic DNA
cagctctgggatacccgctcagtacagaca

SEQ ID NO: 6605 - DNA, 49 bp, Homo sapiens; identical to SEQ ID NO: 2155
  misc_feature 1..49: note = chr2:200335076-200335125
  misc_feature 1..49: note = hyper
  source 1..49: mol_type = genomic DNA

SEQ ID NO: 6606 - DNA, 33 bp, Homo sapiens
  misc_feature 1..33: note = chr2:200335771-200335804
  misc_feature 1..33: note = hyper
  source 1..33: mol_type = genomic DNA
ctgttgtgtcagaatcggcgagtgcaaagtagc

SEQ ID NO: 6607 - DNA, 82 bp, Homo sapiens
  misc_feature 1..82: note = chr2:200336264-200336346
  misc_feature 1..82: note = hyper
  source 1..82: mol_type = genomic DNA
gaagcctccaaggagcgggcggctgggagaggttgtgccacccgggaccaagccatcggcgctgctccggactcccggtagg

SEQ ID NO: 6608 - DNA, 217 bp, Homo sapiens; identical to SEQ ID NO: 2156
  misc_feature 1..217: note = chr2:201450490-201450707
  misc_feature 1..217: note = hyper
  source 1..217: mol_type = genomic DNA

SEQ ID NO: 6609 - DNA, 67 bp, Homo sapiens
  misc_feature 1..67: note = chr2:202899715-202899782
  misc_feature 1..67: note = hyper
  source 1..67: mol_type = genomic DNA
gccatcccgccgtgtcgttctctgtgcgagcgcgcccgccagggctgcgaggcgctcatgaacaagt

SEQ ID NO: 6610 - DNA, 74 bp, Homo sapiens
  misc_feature 1..74: note = chr2:206550451-206550525
  misc_feature 1..74: note = hyper
  source 1..74: mol_type = genomic DNA
gcgcggcaggctcgccgcgacccctagagagacggctttgagtggcgggaggccgaggccggctggcttgggaa

SEQ ID NO: 6611 - DNA, 206 bp, Homo sapiens
  misc_feature 1..206: note = chr2:206551071-206551277
  misc_feature 1..206: note = hyper
  source 1..206: mol_type = genomic DNA
cgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttccca

SEQ ID NO: 6612 - DNA, 40 bp, Homo sapiens; identical to SEQ ID NO: 2157
  misc_feature 1..40: note = chr2:207139115-207139155
  misc_feature 1..40: note = hyper
  source 1..40: mol_type = genomic DNA

SEQ ID NO: 6613 - DNA, 606 bp, Homo sapiens; identical to SEQ ID NO: 2158
  misc_feature 1..606: note = chr2:207139217-207139823
  misc_feature 1..606: note = hyper
  source 1..606: mol_type = genomic DNA

SEQ ID NO: 6614 - DNA, 30 bp, Homo sapiens
  misc_feature 1..30: note = chr2:207140134-207140164
  misc_feature 1..30: note = hyper
  source 1..30: mol_type = genomic DNA
ggcctttcccagcctcgggcgattatagtt

SEQ ID NO: 6615 - DNA, 15 bp, Homo sapiens
  misc_feature 1..15: note = chr2:207307463-207307478
  misc_feature 1..15: note = hyper
  source 1..15: mol_type = genomic DNA
tctgtattgcttccc

SEQ ID NO: 6616 - DNA, 182 bp, Homo sapiens
  misc_feature 1..182: note = chr2:207307547-207307729
  misc_feature 1..182: note = hyper
  source 1..182: mol_type = genomic DNA
cggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctc

SEQ ID NO: 6617 - DNA, 169 bp, Homo sapiens
  misc_feature 1..169: note = chr2:207308045-207308214
  misc_feature 1..169: note = hyper
  source 1..169: mol_type = genomic DNA
ctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcc

SEQ ID NO: 6618 - DNA, 418 bp, Homo sapiens
  misc_feature 1..418: note = chr2:207308502-207308920
  misc_feature 1..418: note = hyper
  source 1..418: mol_type = genomic DNA
cggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccc

SEQ ID NO: 6619 - DNA, 310 bp, Homo sapiens; identical to SEQ ID NO: 2159
  misc_feature 1..310: note = chr2:207506759-207507069
  misc_feature 1..310: note = hyper
  source 1..310: mol_type = genomic DNA

SEQ ID NO: 6620 - DNA, 75 bp, Homo sapiens
  misc_feature 1..75: note = chr2:208546197-208546272
  misc_feature 1..75: note = hyper
  source 1..75: mol_type = genomic DNA
cgccgcggagccgcgcggagcggagccggcgagctaacccgagccagccggcgggcgtcccggaggcggcggcgc

SEQ ID NO: 6621 - DNA, 30 bp, Homo sapiens
  misc_feature 1..30: note = chr2:208635667-208635697
  misc_feature 1..30: note = hyper
  source 1..30: mol_type = genomic DNA
ggcaaccctgggattcgaacccaggtagtt

SEQ ID NO: 6622 - DNA, 40 bp, Homo sapiens
  misc_feature 1..40: note = chr2:210636466-210636506
  misc_feature 1..40: note = hyper
  source 1..40: mol_type = genomic DNA
tccggccgtgcagcccggcgcgggccgctgtccacagtgg

SEQ ID NO: 6623 - DNA, 140 bp, Homo sapiens
  misc_feature 1..140: note = chr2:210636737-210636877
  misc_feature 1..140: note = hyper
  source 1..140: mol_type = genomic DNA
cggcggctagcgaggagacagagctgggtcctgcagtaggactcccgggagccaccattatggtgaagaggaagagctccgagggccaggagcaggacggcggccgcggcatccccctgcccatccagaccttcctgtgg

SEQ ID NO: 6624 - DNA, 124 bp, Homo sapiens
  misc_feature 1..124: note = chr2:211089565-211089689
  misc_feature 1..124: note = hyper
  source 1..124: mol_type = genomic DNA
caaaacgcaggctcccgggtcccactgcaggccgctgaactagacgggttggattggggctccggaatgaacttctggagaaatctttcggctttccccgacgtgggctcggcggtctgttctc

SEQ ID NO: 6625 - DNA, 104 bp, Homo sapiens
  misc_feature 1..104: note = chr2:213401235-213401339
  misc_feature 1..104: note = hyper
  source 1..104: mol_type = genomic DNA
ggaacaacaatggcacgctaatcctcgcgctctaaatgggctcacttgtgggtctgacaattcgcccagggaaacgagaagagacgaagcgagggcgcgagcta

SEQ ID NO: 6626 - DNA, 182 bp, Homo sapiens
  misc_feature 1..182: note = chr2:213401654-213401836
  misc_feature 1..182: note = hyper
  source 1..182: mol_type = genomic DNA
atgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaactt

SEQ ID NO: 6627 - DNA, 695 bp, Homo sapiens; identical to SEQ ID NO: 2160
  misc_feature 1..695: note = chr2:213402687-213403382
  misc_feature 1..695: note = hyper
  source 1..695: mol_type = genomic DNA

SEQ ID NO: 6628 - DNA, 88 bp, Homo sapiens
  misc_feature 1..88: note = chr2:213403913-213404001
  misc_feature 1..88: note = hyper
  source 1..88: mol_type = genomic DNA
aaaaaaaaaaaggtgcggggggcggtgggaataaaacaaccctccacgcaaccaggccggctctgctcagccgcgcaaaccccgccca

SEQ ID NO: 6629 - DNA, 32 bp, Homo sapiens
  misc_feature 1..32: note = chr2:216300252-216300284
  misc_feature 1..32: note = hyper
  source 1..32: mol_type = genomic DNA
tttctctcagtaaagcgcgcacacactcgcac

SEQ ID NO: 6630 - DNA, 30 bp, Homo sapiens
  misc_feature 1..30: note = chr2:216301757-216301787
  misc_feature 1..30: note = hyper
  source 1..30: mol_type = genomic DNA
ctttcccacgttcaccgtgccagttacaca

SEQ ID NO: 6631 - DNA, 356 bp, Homo sapiens
  misc_feature 1..356: note = chr2:217559066-217559422
  misc_feature 1..356: note = hyper
  source 1..356: mol_type = genomic DNA
cgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgccgcacgactgcccctcggccagggcgcaggtcatgcagcagccgcagcccggctccttgaccagctcgcagcccagggggctgggggggcacatggagagggctttctcgtcgcagggctcgcagt

SEQ ID NO: 6632 - DNA, 93 bp, Homo sapiens; identical to SEQ ID NO: 2161
  misc_feature 1..93: note = chr2:218806209-218806302
  misc_feature 1..93: note = hyper
  source 1..93: mol_type = genomic DNA

SEQ ID NO: 6633 - DNA, 45 bp, Homo sapiens
  misc_feature 1..45: note = chr2:219735785-219735830
  misc_feature 1..45: note = hyper
  source 1..45: mol_type = genomic DNA
atctgcaggaaggcacggcggctggccgggcggcaggccgagttg

SEQ ID NO: 6634 - DNA, 394 bp, Homo sapiens; identical to SEQ ID NO: 262
  misc_feature 1..394: note = chr2:219736151-219736545
  misc_feature 1..394: note = hyper
  source 1..394: mol_type = genomic DNA

SEQ ID NO: 6635 - DNA, 30 bp, Homo sapiens
  misc_feature 1..30: note = chr2:219773737-219773767
  misc_feature 1..30: note = hyper
  source 1..30: mol_type = genomic DNA
caacctcaaccaacacgtaggcgaggatgc

SEQ ID NO: 6636 - DNA, 304 bp, Homo sapiens
  misc_feature 1..304: note = chr2:219824786-219825090
  misc_feature 1..304: note = hyper
  source 1..304: mol_type = genomic DNA
aggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccac

SEQ ID NO: 6637 - DNA, 36 bp, Homo sapiens
  misc_feature 1..36: note = chr2:219825513-219825549
  misc_feature 1..36: note = hyper
  source 1..36: mol_type = genomic DNA
cctcaagaacgagggcgaggccgccgccagcggcgg

SEQ ID NO: 6638 - DNA, 92 bp, Homo sapiens
  misc_feature 1..92: note = chr2:219846666-219846758
  misc_feature 1..92: note = hyper
  source 1..92: mol_type = genomic DNA
cggcggcggcatgagcgtgcgcgggcggcggctggcaggcctgcgccaggccctggaagtcgaagcggtaggcgtagcgcttgccatgcacc

SEQ ID NO: 6639 - DNA, 103 bp, Homo sapiens
  misc_feature 1..103: note = chr2:219847047-219847150
  misc_feature 1..103: note = hyper
  source 1..103: mol_type = genomic DNA
gaaactgacccaccccggcaggaaccggcactgggggaggaaaagtgcaagtcaaactgcagctgcgttcggcgggagaggccggccccggaggggctgatca

SEQ ID NO: 6640 - DNA, 83 bp, Homo sapiens
  misc_feature 1..83: note = chr2:219848809-219848892
  misc_feature 1..83: note = hyper
  source 1..83: mol_type = genomic DNA
tcttcccaaggcctccgcacaaccaggccaggactccgggcttcagtgtgaaccctgggtccacactgctcccacctactgtc

SEQ ID NO: 6641 - DNA, 542 bp, Homo sapiens
  misc_feature 1..542: note = chr2:219848935-219849477
  misc_feature 1..542: note = hyper
  source 1..542: mol_type = genomic DNA
cgcgccggccatctcacctttctgaaccgcggggctcagcggcccccagctcgggttcttcccgtccttgaagagaccgtctccgacgggatctgcaagcagcagaagaaaagaatcaggagaaccccgggcggaagttgtgggcttgacaaaagggccccgggccaaggcttaaggggggtgctgtggtccccaggcgcgaggctgggggcccgggccacccggctcctcctcccggagcctggtccaggcgcgctgcgcggagcccctccatagagcccaagtcaggaaacgcgtccaggaaaaaggaaatccgctttccgaaggggccggctggagccttataaagccgagcggggaactgcgccagccgagctggagcgcgaagagaagaggagggtgcctggagggccggcctgaagctcgtagcaggaaggtgaggagccgtgagagcgcaggggagacgcccgcggaccacagccttctggtacggctcggccacagagtactccaccacgccagagacccgtgcttcccctctc

SEQ ID NO: 6642 - DNA, 61 bp, Homo sapiens
  misc_feature 1..61: note = chr2:219850168-219850229
  misc_feature 1..61: note = hyper
  source 1..61: mol_type = genomic DNA
cagccccccgcgccccgcagccggggagacgcgcgggggatgggcccgggccatgtgccct

SEQ ID NO: 6643 - DNA, 58 bp, Homo sapiens
  misc_feature 1..58: note = chr2:219857911-219857969
  misc_feature 1..58: note = hyper
  source 1..58: mol_type = genomic DNA
ggaagggtggcaccacgcgctcagcgtctcaagagccccgtttcgagccacacacagc

SEQ ID NO: 6644 - DNA, 40 bp, Homo sapiens
  misc_feature 1..40: note = chr2:219867872-219867912
  misc_feature 1..40: note = hyper
  source 1..40: mol_type = genomic DNA
gcggcagggcgatgacgcgtggccgcgaggtgagtaccac

SEQ ID NO: 6645 - DNA, 231 bp, Homo sapiens; identical to SEQ ID NO: 2163
  misc_feature 1..231: note = chr2:220174065-220174296
  misc_feature 1..231: note = hyper
  source 1..231: mol_type = genomic DNA

SEQ ID NO: 6646 - DNA, 280 bp, Homo sapiens; identical to SEQ ID NO: 2164
  misc_feature 1..280: note = chr2:220196354-220196634
  misc_feature 1..280: note = hyper
  source 1..280: mol_type = genomic DNA

SEQ ID NO: 6647 - DNA, 50 bp, Homo sapiens
  misc_feature 1..50: note = chr2:220197440-220197490
  misc_feature 1..50: note = hyper
  source 1..50: mol_type = genomic DNA
accagcccgcgactccgaatctgtttaaccctcctcggcagttcagccaa

SEQ ID NO: 6648 - DNA, 268 bp, Homo sapiens
  misc_feature 1..268: note = chr2:220222947-220223215
  misc_feature 1..268: note = hyper
  source 1..268: mol_type = genomic DNA
ggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgcattggtgtccaagctcgagcaccaggtggaggaacccgtggccatcgggtgtggggtgtgcagggtgcggagaaggctaggattcctcccaatcctctgctgcgccctcccccagcc

SEQ ID NO: 6649 - DNA, 30 bp, Homo sapiens
  misc_feature 1..30: note = chr2:220223590-220223620
  misc_feature 1..30: note = hyper
  source 1..30: mol_type = genomic DNA
ggtggggactaatggcgtcccagccccccg

SEQ ID NO: 6650 - DNA, 36 bp, Homo sapiens
  misc_feature 1..36: note = chr2:220283254-220283290
  misc_feature 1..36: note = hyper
  source 1..36: mol_type = genomic DNA
tcccactcggctccccgctgagttcgcccgtgttcc

SEQ ID NO: 6651 - DNA, 39 bp, Homo sapiens
  misc_feature 1..39: note = chr2:220283362-220283401
  misc_feature 1..39: note = hyper
  source 1..39: mol_type = genomic DNA
cgggcggggccgggggcctggggtcgctgcgggccagcc

SEQ ID NO: 6652 - DNA, 21 bp, Homo sapiens
  misc_feature 1..21: note = chr2:220283711-220283732
  misc_feature 1..21: note = hyper
  source 1..21: mol_type = genomic DNA
cgacgtcgagcgcgacaacct

SEQ ID NO: 6653 - DNA, 102 bp, Homo sapiens; identical to SEQ ID NO: 263
  misc_feature 1..102: note = chr2:220299533-220299635
  misc_feature 1..102: note = hyper
  source 1..102: mol_type = genomic DNA

SEQ ID NO: 6654 - DNA, 174 bp, Homo sapiens; identical to SEQ ID NO: 264
  misc_feature 1..174: note = chr2:220299885-220300059
  misc_feature 1..174: note = hyper
  source 1..174: mol_type = genomic DNA

SEQ ID NO: 6655 - DNA, 618 bp, Homo sapiens; identical to SEQ ID NO: 265
  misc_feature 1..618: note = chr2:220349101-220349719
  misc_feature 1..618: note = hyper
  source 1..618: mol_type = genomic DNA

SEQ ID NO: 6656 - DNA, 20 bp, Homo sapiens
  misc_feature 1..20: note = chr2:220361447-220361467
  misc_feature 1..20: note = hyper
  source 1..20: mol_type = genomic DNA
aggtaggagatggtgcgctc

SEQ ID NO: 6657 - DNA, 30 bp, Homo sapiens
  misc_feature 1..30: note = chr2:220379221-220379251
  misc_feature 1..30: note = hyper
  source 1..30: mol_type = genomic DNA
cagcagaggcagcagcggcagaggcagcac

SEQ ID NO: 6658 - DNA, 1308 bp, Homo sapiens; identical to SEQ ID NO: 2168
  misc_feature 1..1308: note = chr2:220416379-220417687
  misc_feature 1..1308: note = hyper
  source 1..1308: mol_type = genomic DNA

SEQ ID NO: 6659 - DNA, 56 bp, Homo sapiens
  misc_feature 1..56: note = chr2:222435807-222435863
  misc_feature 1..56: note = hyper
  source 1..56: mol_type = genomic DNA
ccgcgtccgcttccacgcaggcattcgcgcacctacatacacgcagttgcacgcgc

SEQ ID NO: 6660 - DNA, 306 bp, Homo sapiens
  misc_feature 1..306: note = chr2:223155822-223156128
  misc_feature 1..306: note = hyper
  source 1..306: mol_type = genomic DNA
cccagcccattgtggcggcgcccgcgggcccgctaggccgagccgggggaggaacagaggcgcccattgagcggccgctgcgcagggcggtgcccacagccccggatgcctcggccaggacttggctcccccggctgcctctgctccagtctcagcgcgggccaggggctagggggattggggatagcgggcggggttcgtgttagtgaaccgcccagccctctcctttctcctgggctatggagctggagggatgtatccagcaagggtgcatcatgcttagcgcgcgcccgttagggagcgcgg

SEQ ID NO: 6661 - DNA, 749 bp, Homo sapiens; identical to SEQ ID NO: 266
  misc_feature 1..749: note = chr2:223158730-223159479
  misc_feature 1..749: note = hyper
  source 1..749: mol_type = genomic DNA

SEQ ID NO: 6662 - DNA, 51 bp, Homo sapiens
  misc_feature 1..51: note = chr2:223159710-223159761
  misc_feature 1..51: note = hyper
  source 1..51: mol_type = genomic DNA
aaaaacaaaccctcccgtgcgccctctcgctggccccgtgcttgcccctct

SEQ ID NO: 6663 - DNA, 81 bp, Homo sapiens
  misc_feature 1..81: note = chr2:223160035-223160116
  misc_feature 1..81: note = hyper
  source 1..81: mol_type = genomic DNA
ggtctcgccaccctccgtccccaggacaagcagctcacccctccctccataaagtgccaagaacaccgggttggcaaatat

SEQ ID NO: 6664 - DNA, 145 bp, Homo sapiens; identical to SEQ ID NO: 267
  misc_feature 1..145: note = chr2:223161540-223161685
  misc_feature 1..145: note = hyper
  source 1..145: mol_type = genomic DNA

SEQ ID NO: 6665 - DNA, 220 bp, Homo sapiens; identical to SEQ ID NO: 268
  misc_feature 1..220: note = chr2:223161806-223162026
  misc_feature 1..220: note = hyper
  source 1..220: mol_type = genomic DNA

SEQ ID NO: 6666 - DNA, 32 bp, Homo sapiens; identical to SEQ ID NO: 269
  misc_feature 1..32: note = chr2:223162859-223162891
  misc_feature 1..32: note = hyper
  source 1..32: mol_type = genomic DNA

SEQ ID NO: 6667 - DNA, 297 bp, Homo sapiens; identical to SEQ ID NO: 270
  misc_feature 1..297: note = chr2:223162928-223163225
  misc_feature 1..297: note = hyper
  source 1..297: mol_type = genomic DNA

SEQ ID NO: 6668 - DNA, 337 bp, Homo sapiens; identical to SEQ ID NO: 271
  misc_feature 1..337: note = chr2:223163472-223163809
  misc_feature 1..337: note = hyper
  source 1..337: mol_type = genomic DNA

SEQ ID NO: 6669 - DNA, 193 bp, Homo sapiens; identical to SEQ ID NO: 272
  misc_feature 1..193: note = chr2:223163810-223164003
  misc_feature 1..193: note = hyper
  source 1..193: mol_type = genomic DNA

SEQ ID NO: 6670 - DNA, 162 bp, Homo sapiens
  misc_feature 1..162: note = chr2:223164417-223164579
  misc_feature 1..162: note = hyper
  source 1..162: mol_type = genomic DNA
ttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctct

SEQ ID NO: 6671 - DNA, 15 bp, Homo sapiens
  misc_feature 1..15: note = chr2:223166211-223166226
  misc_feature 1..15: note = hyper
  source 1..15: mol_type = genomic DNA
tgtggcctgtgtccc

SEQ ID NO: 6672 - DNA, 371 bp, Homo sapiens
  misc_feature 1..371: note = chr2:223166449-223166820
  misc_feature 1..371: note = hyper
  source 1..371: mol_type = genomic DNA
cccacacccaaaccccgcagctggatgggagtccaggccacttccctatccgcagccggtgggccaaggagtcctggtgccaaatttggccgcggtacaggcgctaattggtaaagggatgacccagcggtggggcttggaaggcgagggcccgcgccctgcatccttgaaccctggtttgggaggcagtgacttttacctgggctaacaaattacccagaaagcatcagtgggactctccacaacggtgttgtgaacgagtgtagggtccactcacgctctgtgcacgttcgaaatgaaacgggagccttgaagacgatatttggataatttgacaaaaaaaaaaaaaaggtgggcgggggagatagctt

SEQ ID NO: 6673 - DNA, 300 bp, Homo sapiens; identical to SEQ ID NO: 2176
  misc_feature 1..300: note = chr2:223167250-223167550
  misc_feature 1..300: note = hyper
  source 1..300: mol_type = genomic DNA

SEQ ID NO: 6674 - DNA, 361 bp, Homo sapiens
  misc_feature 1..361: note = chr2:223168471-223168832
  misc_feature 1..361: note = hyper
  source 1..361: mol_type = genomic DNA
ctccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcc

SEQ ID NO: 6675 - DNA, 450 bp, Homo sapiens
  misc_feature 1..450: note = chr2:223168916-223169366
  misc_feature 1..450: note = hyper
  source 1..450: mol_type = genomic DNA
cggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaa

SEQ ID NO: 6676 - DNA, 224 bp, Homo sapiens
  misc_feature 1..224: note = chr2:223169640-223169864
  misc_feature 1..224: note = hyper
  source 1..224: mol_type = genomic DNA
caccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaag

SEQ ID NO: 6677 - DNA, 398 bp, Homo sapiens
  misc_feature 1..398: note = chr2:223170354-223170752
  misc_feature 1..398: note = hyper
  source 1..398: mol_type = genomic DNA
cttctttccatccctcggccccctcccagagggcagcgacgaaagccctggccgagcacaaggatcggtgatctgggctcctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttcca

SEQ ID NO: 6678 - DNA, 35 bp, Homo sapiens
  misc_feature 1..35: note = chr2:223171277-223171312
  misc_feature 1..35: note = hyper
  source 1..35: mol_type = genomic DNA
cctgttgccccaggacgccccgaaaaactgctctg

SEQ ID NO: 6679 - DNA, 416 bp, Homo sapiens; identical to SEQ ID NO: 273
  misc_feature 1..416: note = chr2:223176096-223176512
  misc_feature 1..416: note = hyper
  source 1..416: mol_type = genomic DNA

SEQ ID NO: 6680 - DNA, 307 bp, Homo sapiens; identical to SEQ ID NO: 274
  misc_feature 1..307: note = chr2:223176719-223177026
  misc_feature 1..307: note = hyper
  source 1..307: mol_type = genomic DNA

SEQ ID NO: 6681 - DNA, 323 bp, Homo sapiens
  misc_feature 1..323: note = chr2:223177315-223177638
  misc_feature 1..323: note = hyper
  source 1..323: mol_type = genomic DNA
tcccccgcttcccaccgactgccggaagctcggcctctgtgcaaaccgaagtatacctgcacccaagagcgtggaaataatttacacgctgaatggctactattaaaaaggatctttttaacagatctcctggcgagtattttaaaacaggactctgcgctagatcagctcgcccgtcggcagctgtcagcgaccagccgacaagctgagattcccctttcagctgtcactggcgatgacacccacatctatcactggcgatgttttgttaatttaacctcgagacttccctgattatccgcataatccgtcctcaaatcccc

SEQ ID NO: 6682 - DNA, 375 bp, Homo sapiens
  misc_feature 1..375: note = chr2:225906404-225906779
  misc_feature 1..375: note = hyper
  source 1..375: mol_type = genomic DNA
tgggtttttaccctgcggtgggagggctgttccaagtacatctatttctgcgatagttaacgtcggggggccccagctctaaccagggcgaggaccacggactgcatccctctctctcagcgcactggtctgtttactggagggtgagagggacgcgcagacctccggactcaggggttctgttctgtagatccccccaccccacccggggtctctggcactcgtatcacttagcaccagtgtgactggcggtgcattccggccccctcgcgccccattaaagcccctgcacatcctctcccacgctgcgcttctgctacccacgcagctgctcctctgagcgtcccgcgtgcacaaacgcgcccccggtcctta

SEQ ID NO: 6683 - DNA, 352 bp, Homo sapiens
  misc_feature 1..352: note = chr2:225906790-225907142
  misc_feature 1..352: note = hyper
  source 1..352: mol_type = genomic DNA
cgctgcctcgctgaggtggcgccgggggagcccgcagaggcggcgggggagggagtgcggaggagaggacccgtgagctgcggggacctgggcccgccgagcttttggggaagctgggctccgttccccccgggcgcctggggcgcgcgggaaggcgcggaggacgcgccgcactcacccgctgctgctgccggctgctgactgccaccgcggcggcggacgcggcgctgtgccggagctcggccgcctgcccaggtctcaacaggctccgggtgaacctgcgggtccgctcaccggccatcgccggtcacgccaatcgcgccgcgggcccggggcgcgcctcccgccggtc

SEQ ID NO: 6684 - DNA, 57 bp, Homo sapiens
  misc_feature 1..57: note = chr2:228736215-228736272
  misc_feature 1..57: note = hyper
  source 1..57: mol_type = genomic DNA
cacctccagaacactcgccccccgcgcgccggagccccgggtcgccaccaaccgccc

SEQ ID NO: 6685 - DNA, 41 bp, Homo sapiens
  misc_feature 1..41: note = chr2:229046219-229046260
  misc_feature 1..41: note = hyper
  source 1..41: mol_type = genomic DNA
actcacaacgcggaacggagtttgatcgacatggtattggg

SEQ ID NO: 6686 - DNA, 15 bp, Homo sapiens
  misc_feature 1..15: note = chr2:229046730-229046745
  misc_feature 1..15: note = hyper
  source 1..15: mol_type = genomic DNA
ccctgaagttgttca

SEQ ID NO: 6687 - DNA, 232 bp, Homo sapiens; identical to SEQ ID NO: 2179
  misc_feature 1..232: note = chr2:230578195-230578427
  misc_feature 1..232: note = hyper
  source 1..232: mol_type = genomic DNA

SEQ ID NO: 6688 - DNA, 123 bp, Homo sapiens
  misc_feature 1..123: note = chr2:231903049-231903172
  misc_feature 1..123: note = hyper
  source 1..123: mol_type = genomic DNA
aggcctcgcagctagcggagagcgggccgtgcgtagcggatcgagtctgtcccggaagggtccggagtgcacgggagatgcctagggggcgtgggaaagctgaggggccgagtagaaggcaga

SEQ ID NO: 6689 - DNA, 70 bp, Homo sapiens
  misc_feature 1..70: note = chr2:232394952-232395022
  misc_feature 1..70: note = hyper
  source 1..70: mol_type = genomic DNA
ggacggggggcaccccgacggagccctcggacccttcccgccctaggacgaccctgcccgcaccgagccc

SEQ ID NO: 6690 - DNA, 77 bp, Homo sapiens
  misc_feature 1..77: note = chr2:232395054-232395131
  misc_feature 1..77: note = hyper
  source 1..77: mol_type = genomic DNA
cgcctgcgcacctaccatgcggcccgcggcccgcgagaccccggcttccaccctccgagcgacggacacagacgcgg

SEQ ID NO: 6691 - DNA, 352 bp, Homo sapiens; identical to SEQ ID NO: 2180
  misc_feature 1..352: note = chr2:232791677-232792029
  misc_feature 1..352: note = hyper
  source 1..352: mol_type = genomic DNA

SEQ ID NO: 6692 - DNA, 30 bp, Homo sapiens
  misc_feature 1..30: note = chr2:233283450-233283480
  misc_feature 1..30: note = hyper
  source 1..30: mol_type = genomic DNA
cagccccagccctcacggagatgtcagccc

SEQ ID NO: 6693 - DNA, 30 bp, Homo sapiens
  misc_feature 1..30: note = chr2:233283737-233283767
  misc_feature 1..30: note = hyper
  source 1..30: mol_type = genomic DNA
cactcaggcggatgacgtagcgcgaggagt

SEQ ID NO: 6694 - DNA, 66 bp, Homo sapiens
  misc_feature 1..66: note = chr2:233285777-233285843
  misc_feature 1..66: note = hyper
  source 1..66: mol_type = genomic DNA
gcagcgcggcggcagcggggacctgggtcgggggccgcggagacaggcttccgagggtcgtgcgcg

SEQ ID NO: 6695 - DNA, 277 bp, Homo sapiens; identical to SEQ ID NO: 275
  misc_feature 1..277: note = chr2:233350263-233350540
  misc_feature 1..277: note = hyper
  source 1..277: mol_type = genomic DNA

SEQ ID NO: 6696 - DNA, 436 bp, Homo sapiens; identical to SEQ ID NO: 276
  misc_feature 1..436: note = chr2:233350843-233351279
  misc_feature 1..436: note = hyper
  source 1..436: mol_type = genomic DNA

SEQ ID NO: 6697 - DNA, 181 bp, Homo sapiens; identical to SEQ ID NO: 277
  misc_feature 1..181: note = chr2:233351415-233351596
  misc_feature 1..181: note = hyper
  source 1..181: mol_type = genomic DNA

SEQ ID NO: 6698 - DNA, 351 bp, Homo sapiens; identical to SEQ ID NO: 278
  misc_feature 1..351: note = chr2:233352101-233352452
  misc_feature 1..351: note = hyper
  source 1..351: mol_type = genomic DNA

SEQ ID NO: 6699 - DNA, 257 bp, Homo sapiens; identical to SEQ ID NO: 279
  misc_feature 1..257: note = chr2:233352506-233352763
  misc_feature 1..257: note = hyper
  source 1..257: mol_type = genomic DNA

SEQ ID NO: 6700 - DNA, 136 bp, Homo sapiens; identical to SEQ ID NO: 280
  misc_feature 1..136: note = chr2:233352775-233352911
  misc_feature 1..136: note = hyper
  source 1..136: mol_type = genomic DNA

SEQ ID NO: 6701 - DNA, 98 bp, Homo sapiens
  misc_feature 1..98: note = chr2:233368141-233368239
  misc_feature 1..98: note = hyper
  source 1..98: mol_type = genomic DNA
tataggtcaatgtcccgctcagcctccctcccccagcaccgtgaggaccgaggcctggggcctggcgcccgcctggtggacctcgggggcaggctggg

SEQ ID NO: 6702 - DNA, 85 bp, Homo sapiens
  misc_feature 1..85: note = chr2:233388723-233388808
  misc_feature 1..85: note = hyper
  source 1..85: mol_type = genomic DNA
gctccgactcctgtccggtccgcagagctgcgctcgctggcgcacacgctgctgggcctgctgcggaacgcgcaggagctgctcg

SEQ ID NO: 6703 - DNA, 30 bp, Homo sapiens
  misc_feature 1..30: note = chr2:233389121-233389151
  misc_feature 1..30: note = hyper
  source 1..30: mol_type = genomic DNA
gggcctggacgaggtcggaagcgcttctac

SEQ ID NO: 6704 - DNA, 131 bp, Homo sapiens
  misc_feature 1..131: note = chr2:233498345-233498476
  misc_feature 1..131: note = hyper
  source 1..131: mol_type = genomic DNA
cgcgccgcccgccagctccctgcgtcccgtcccgcgtccccgcgttcccgcgtcctgcgatccgccgccatggccagtgaggagctggcgtgcaagctggagcgccggctgcggcgcgaggaggccgagga

SEQ ID NO: 6705 - DNA, 164 bp, Homo sapiens
  misc_feature 1..164: note = chr2:233498710-233498874
  misc_feature 1..164: note = hyper
  source 1..164: mol_type = genomic DNA
caaactgtgagctcccgctgcgcgcccttcgcccccgggaccagggagggagcgggagggctttctggtccgaagtcccgggccctgtttgtgtggggaggggtcccggggtgcaggtagcatttggcccaacgcagccagatcttgcgtgctcgggtctatct

SEQ ID NO: 6706 - DNA, 86 bp, Homo sapiens
  misc_feature 1..86: note = chr2:233498895-233498981
  misc_feature 1..86: note = hyper
  source 1..86: mol_type = genomic DNA
cgaagaggggggacaccaggagcaggagctctccgggacggagcccaaaagttctcggcggctgccgggcccgagttccaggtccc

SEQ ID NO: 6707 - DNA, 30 bp, Homo sapiens
  misc_feature 1..30: note = chr2:233499209-233499239
  misc_feature 1..30: note = hyper
  source 1..30: mol_type = genomic DNA
ggagtttggtaaagtcgttgtaagagattc

SEQ ID NO: 6708 - DNA, 51 bp, Homo sapiens
  misc_feature 1..51: note = chr2:233740999-233741050
  misc_feature 1..51: note = hyper
  source 1..51: mol_type = genomic DNA
cctgctggccacctgcgtggtgctggcgctcgtggtcgtcgcgctgagaaa

SEQ ID NO: 6709 - DNA, 100 bp, Homo sapiens
  misc_feature 1..100: note = chr2:233741381-233741481
  misc_feature 1..100: note = hyper
  source 1..100: mol_type = genomic DNA
ggagtgcctcaggagcgcgccgcatgtgcgtgcccggtgcgcgtgcgccggggccgccagggcatcggagcgggtgtgcggccagcggtcttagcccgtc

SEQ ID NO: 6710 - DNA, 117 bp, Homo sapiens
  misc_feature 1..117: note = chr2:235404416-235404533
  misc_feature 1..117: note = hyper
  source 1..117: mol_type = genomic DNA
gggtggggggcaggtcgagagtaggccggtaaatcagacttcgcagctccttaagtcaccagtcctgcatttgggtgcagagattccgttttaaaaattcgaagcatcgctttggtt

SEQ ID NO: 6711 - DNA, 13 bp, Homo sapiens
  misc_feature 1..13: note = chr2:235404550-235404563
  misc_feature 1..13: note = hyper
  source 1..13: mol_type = genomic DNA
cgcgggttctcgc

SEQ ID NO: 6712 - DNA, 26 bp, Homo sapiens
  misc_feature 1..26: note = chr2:235404623-235404649
  misc_feature 1..26: note = hyper
  source 1..26: mol_type = genomic DNA
cgctcgctccccggtcgctccgggcg

SEQ ID NO: 6713 - skipped

SEQ ID NO: 6714 - DNA, 16 bp, Homo sapiens
  misc_feature 1..16: note = chr2:237068925-237068941
  misc_feature 1..16: note = hyper
  source 1..16: mol_type = genomic DNA
gcggtggaggctaggg

SEQ ID NO: 6715 - DNA, 357 bp, Homo sapiens; identical to SEQ ID NO: 281
  misc_feature 1..357: note = chr2:237072641-237072998
  misc_feature 1..357: note = hyper
  source 1..357: mol_type = genomic DNA

SEQ ID NO: 6716 - DNA, 16 bp, Homo sapiens
  misc_feature 1..16: note = chr2:237072999-237073015
  misc_feature 1..16: note = hyper
  source 1..16: mol_type = genomic DNA
ctcacactcgctggcc

SEQ ID NO: 6717 - DNA, 440 bp, Homo sapiens; identical to SEQ ID NO: 283
  misc_feature 1..440: note = chr2:237073056-237073496
  misc_feature 1..440: note = hyper
  source 1..440: mol_type = genomic DNA

SEQ ID NO: 6718 - skipped

SEQ ID NO: 6719 - DNA, 39 bp, Homo sapiens
  misc_feature 1..39: note = chr2:237075146-237075185
  misc_feature 1..39: note = hyper
  source 1..39: mol_type = genomic DNA
gtcatttggacattccgcgccccccgccccccacccttt

SEQ ID NO: 6720 - DNA, 34 bp, Homo sapiens
  misc_feature 1..34: note = chr2:237076602-237076636
  misc_feature 1..34: note = hyper
  source 1..34: mol_type = genomic DNA
cgctgcgctcatagacgcgctcggtagaggccag

SEQ ID NO: 6721 - DNA, 69 bp, Homo sapiens
  misc_feature 1..69: note = chr2:237076656-237076725
  misc_feature 1..69: note = hyper
  source 1..69: mol_type = genomic DNA
cgccgcgccgccgccgggaagcccgccggacgccgggagcaccgccgggagcgccgggcaggggccgag

SEQ ID NO: 6722 - DNA, 61 bp, Homo sapiens
  misc_feature 1..61: note = chr2:237078315-237078376
  misc_feature 1..61: note = hyper
  source 1..61: mol_type = genomic DNA
ttaaaaatcagctcacgccgaggagctagtggttggggagttggcccgtgttggacgtgtg

SEQ ID NO: 6723 - DNA, 71 bp, Homo sapiens
  misc_feature 1..71: note = chr2:237080210-237080281
  misc_feature 1..71: note = hyper
  source 1..71: mol_type = genomic DNA
ggcgcgcttcgctgccgccgccagagtcgaggtaacgggtggtcgtggagagggtacggtgtggccacccg

SEQ ID NO: 6724 - DNA, 118 bp, Homo sapiens
  misc_feature 1..118: note = chr2:237081277-237081395
  misc_feature 1..118: note = hyper
  source 1..118: mol_type = genomic DNA
ctgaaggctgggaaacgtgacccttcacacctgcgccgccctctccactccagcgacgaggaacaggaggagccacagccgctcggcccgcgaggcgagccctcgtggcatctgggaa

SEQ ID NO: 6725 - DNA, 377 bp, Homo sapiens; identical to SEQ ID NO: 285
  misc_feature 1..377: note = chr2:237082343-237082720
  misc_feature 1..377: note = hyper
  source 1..377: mol_type = genomic DNA

SEQ ID NO: 6726 - DNA, 37 bp, Homo sapiens
  misc_feature 1..37: note = chr2:237086438-237086475
  misc_feature 1..37: note = hyper
  source 1..37: mol_type = genomic DNA
accgagacggaggtgcggaggccgtgtctggccctgg

SEQ ID NO: 6727 - DNA, 177 bp, Homo sapiens
  misc_feature 1..177: note = chr2:237086712-237086889
  misc_feature 1..177: note = hyper
  source 1..177: mol_type = genomic DNA
cagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggcc

SEQ ID NO: 6728 - DNA, 22 bp, Homo sapiens
  misc_feature 1..22: note = chr2:237145988-237146010
  misc_feature 1..22: note = hyper
  source 1..22: mol_type = genomic DNA
ggccggggcgcggggcgggggc

SEQ ID NO: 6729 - DNA, 50 bp, Homo sapiens
  misc_feature 1..50: note = chr2:237146264-237146314
  misc_feature 1..50: note = hyper
  source 1..50: mol_type = genomic DNA
gtggggggaggcgggcgtctggtctcggggcggggcggacgccgcgggcc

SEQ ID NO: 6730 - DNA, 202 bp, Homo sapiens; identical to SEQ ID NO: 2192
  misc_feature 1..202: note = chr2:237416164-237416366
  misc_feature 1..202: note = hyper
  source 1..202: mol_type = genomic DNA

SEQ ID NO: 6731 - DNA, 117 bp, Homo sapiens
  misc_feature 1..117: note = chr2:238395216-238395333
  misc_feature 1..117: note = hyper
  source 1..117: mol_type = genomic DNA
cggtcctggaaccaccgcgccgcgcgtcctggcttccacatctgccccatttgcccgcggatcttgactttttcttggcgggcaaggcctcggtctcctccccgcagcagggctgcc

SEQ ID NO: 6732 - DNA, 420 bp, Homo sapiens
  misc_feature 1..420: note = chr2:238536266-238536686
  misc_feature 1..420: note = hyper
  source 1..420: mol_type = genomic DNA
cagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgg

SEQ ID NO: 6733 - DNA, 43 bp, Homo sapiens; identical to SEQ ID NO: 2193
  misc_feature 1..43: note = chr2:238864588-238864631
  misc_feature 1..43: note = hyper
  source 1..43: mol_type = genomic DNA

SEQ ID NO: 6734 - DNA, 330 bp, Homo sapiens; identical to SEQ ID NO: 2194
  misc_feature 1..330: note = chr2:238864726-238865056
  misc_feature 1..330: note = hyper
  source 1..330: mol_type = genomic DNA

SEQ ID NO: 6735 - DNA, 30 bp, Homo sapiens
  misc_feature 1..30: note = chr2:238865269-238865299
  misc_feature 1..30: note = hyper
  source 1..30: mol_type = genomic DNA
cagatgagggggctgcgtccacccccaccc

SEQ ID NO: 6736 - DNA, 62 bp, Homo sapiens
  misc_feature 1..62: note = chr2:239072210-239072272
  misc_feature 1..62: note = hyper
  source 1..62: mol_type = genomic DNA
aggacgcaaagactccgaggcccttcaggccgaggggacgtcgccctcgccccacccctgcg

SEQ ID NO: 6737 - DNA, 111 bp, Homo sapiens; identical to SEQ ID NO: 2195
  misc_feature 1..111: note = chr2:239140138-239140249
  misc_feature 1..111: note = hyper
  source 1..111: mol_type = genomic DNA

SEQ ID NO: 6738 - DNA, 30 bp, Homo sapiens
  misc_feature 1..30: note = chr2:239755137-239755167
  misc_feature 1..30: note = hyper
  source 1..30: mol_type = genomic DNA
gggtggggctgggtgcggtggctctgcaga

SEQ ID NO: 6739 - DNA, 40 bp, Homo sapiens
  misc_feature 1..40: note = chr2:239757929-239757969
  misc_feature 1..40: note = hyper
  source 1..40: mol_type = genomic DNA
ggcctgcccagtgggcgtagaggtgcgggcctgcggctcc

SEQ ID NO: 6740 - DNA, 30 bp, Homo sapiens
  misc_feature 1..30: note = chr2:239758179-239758209
  misc_feature 1..30: note = hyper
  source 1..30: mol_type = genomic DNA
tgaccctggagtacccgggaggggccccgc

SEQ ID NO: 6741 - DNA, 37 bp, Homo sapiens
  misc_feature 1..37: note = chr2:239758409-239758446
  misc_feature 1..37: note = hyper
  source 1..37: mol_type = genomic DNA
ccctttagacaagctcgagccacggaggcgccgtcct

SEQ ID NO: 6742 - DNA, 187 bp, Homo sapiens; identical to SEQ ID NO: 286
  misc_feature 1..187: note = chr2:241393223-241393410
  misc_feature 1..187: note = hyper
  source 1..187: mol_type = genomic DNA

SEQ ID NO: 6743 - DNA, 301 bp, Homo sapiens; identical to SEQ ID NO: 2197
  misc_feature 1..301: note = chr2:241758377-241758678
  misc_feature 1..301: note = hyper
  source 1..301: mol_type = genomic DNA

SEQ ID NO: 6744 - DNA, 483 bp, Homo sapiens
  misc_feature 1..483: note = chr2:241759211-241759694
  misc_feature 1..483: note = hyper
  source 1..483: mol_type = genomic DNA
ccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcgagcccggagctgctgccgctcgccggctgctctgcgctgtgacggcgccgccgcgtgacgggctgcgcgcccccggcccggaccgccccgcgcccctc

SEQ ID NO: 6745 - DNA, 42 bp, Homo sapiens
  misc_feature 1..42: note = chr2:241760366-241760408
  misc_feature 1..42: note = hyper
  source 1..42: mol_type = genomic DNA
aagtcacacgccgctcgggggccaccccggcaaaccccagcc

SEQ ID NO: 6746 - DNA, 30 bp, Homo sapiens
  misc_feature 1..30: note = chr2:241760679-241760709
  misc_feature 1..30: note = hyper
  source 1..30: mol_type = genomic DNA
cccagcaggggcctgcgctgccctagcggc

SEQ ID NO: 6747 - DNA, 101 bp, Homo sapiens
  misc_feature 1..101: note = chr2:241771227-241771328
  misc_feature 1..101: note = hyper
  source 1..101: mol_type = genomic DNA
cgccacggtccccctcgggcctgggaagcctggaaggtcagggcctggaggggagctgggtccaggcagggaactcacagcagagacgccccgagggtggg

SEQ ID NO: 6748 - DNA, 30 bp, Homo sapiens
  misc_feature 1..30: note = chr2:241771696-241771726
  misc_feature 1..30: note = hyper
  source 1..30: mol_type = genomic DNA
tccccgcccctgccccgctgtaggccccgc

SEQ ID NO: 6749 - DNA, 458 bp, Homo sapiens
  misc_feature 1..458: note = chr3:238258-238716
  misc_feature 1..458: note = hyper
  source 1..458: mol_type = genomic DNA
gcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgc

SEQ ID NO: 6750 - DNA, 103 bp, Homo sapiens
  misc_feature 1..103: note = chr3:239006-239109
  misc_feature 1..103: note = hyper
  source 1..103: mol_type = genomic DNA
gggcgcccgaatccgccgggtcccactcacgcccgccggccgccggtaggttggccctcccgcttccagcctccgccaccccatccctcgctgctctctgagg

SEQ ID NO: 6751 - DNA, 522 bp, Homo sapiens; identical to SEQ ID NO: 287
  misc_feature 1..522: note = chr3:239347-239869
  misc_feature 1..522: note = hyper
  source 1..522: mol_type = genomic DNA

SEQ ID NO: 6752 - DNA, 59 bp, Homo sapiens
  misc_feature 1..59: note = chr3:240193-240252
  misc_feature 1..59: note = hyper
  source 1..59: mol_type = genomic DNA
ctaggcatttaactacgtgcctcagtttccctttctcaataatacggagattatcgata

SEQ ID NO: 6753 - DNA, 32 bp, Homo sapiens
  misc_feature 1..32: note = chr3:2139944-2139976
  misc_feature 1..32: note = hyper
  source 1..32: mol_type = genomic DNA
aagttcaatgccacccgcccacccacattccc

SEQ ID NO: 6754 - DNA, 103 bp, Homo sapiens
  misc_feature 1..103: note = chr3:2140332-2140435
  misc_feature 1..103: note = hyper
  source 1..103: mol_type = genomic DNA
cgcgcactgagcatgcgcgggctccgggcctccggcgcgtctccccgtccccgctcgtctcccgcccgttcccacccgcccgcgcctctccccttccccgagc

SEQ ID NO: 6755 - DNA, 36 bp, Homo sapiens
  misc_feature 1..36: note = chr3:2140827-2140863
  misc_feature 1..36: note = hyper
  source 1..36: mol_type = genomic DNA
ggggccgtccagctcagagcccggaagccctgcagg

SEQ ID NO: 6756 - DNA, 81 bp, Homo sapiens; identical to SEQ ID NO: 2199
  misc_feature 1..81: note = chr3:3840498-3840579
  misc_feature 1..81: note = hyper
  source 1..81: mol_type = genomic DNA

SEQ ID NO: 6757 - DNA, 69 bp, Homo sapiens
  misc_feature 1..69: note = chr3:3840887-3840956
  misc_feature 1..69: note = hyper
  source 1..69: mol_type = genomic DNA
cccctagacaaaaagcggcgaccgcggcccggccacccgagccccgccgcgctgcgcctttgttgggcg

SEQ ID NO: 6758 - DNA, 148 bp, Homo sapiens
  misc_feature 1..148: note = chr3:3841494-3841642
  misc_feature 1..148: note = hyper
  source 1..148: mol_type = genomic DNA
cctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgg

SEQ ID NO: 6759 - DNA, 422 bp, Homo sapiens
  misc_feature 1..422: note = chr3:3842186-3842608
  misc_feature 1..422: note = hyper
  source 1..422: mol_type = genomic DNA
ttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggagaggggtgt

SEQ ID NO: 6760 - DNA, 196 bp, Homo sapiens
  misc_feature 1..196: note = chr3:4910354-4910550
  misc_feature 1..196: note = hyper
  source 1..196: mol_type = genomic DNA
gcttcgccgcgtgcgcgtgcgcatggtggggtttggctggctgcgggatgcggtcgaggccgccgaggccgcaaactccagtgggaaggcggcgtgccgcggccggcttcggtggaggagggggcgtttccccggaaaaggaaggaagtgggtgtcacgggcctcaatacggcccctttgacgtcttgagtgggaa

SEQ ID NO: 6761 - DNA, 30 bp, Homo sapiens
  misc_feature 1..30: note = chr3:5019001-5019031
  misc_feature 1..30: note = hyper
  source 1..30: mol_type = genomic DNA
gggagctctccaaggcgacctgaaggaaat

SEQ ID NO: 6762 - DNA, 82 bp, Homo sapiens
  misc_feature 1..82: note = chr3:5137937-5138019
  misc_feature 1..82: note = hyper
  source 1..82: mol_type = genomic DNA
gggtggggggtggtgcggggagtcacatgcgtcccctccgaagctgggctggagttcatttacagctcgcttttctaggcct

SEQ ID NO: 6763 - DNA, 278 bp, Homo sapiens
  misc_feature 1..278: note = chr3:6902321-6902599
  misc_feature 1..278: note = hyper
  source 1..278: mol_type = genomic DNA
tagctagggtcttcccgcgcccctccctcactggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctcccc

SEQ ID NO: 6764 - DNA, 15 bp, Homo sapiens
  misc_feature 1..15: note = chr3:6903084-6903099
  misc_feature 1..15: note = hyper
  source 1..15: mol_type = genomic DNA
ctgaggaagctgctc

SEQ ID NO: 6765 - DNA, 47 bp, Homo sapiens
  misc_feature 1..47: note = chr3:6904160-6904207
  misc_feature 1..47: note = hyper
  source 1..47: mol_type = genomic DNA
cctgtagccagcctccgcgagagcccagggcgcgaggtgctgggacc

SEQ ID NO: 6766 - DNA, 306 bp, Homo sapiens
  misc_feature 1..306: note = chr3:8809409-8809715
  misc_feature 1..306: note = hyper
  source 1..306: mol_type = genomic DNA
aggcggtcggtgcggcggcgcagcgagcgcagcggctggcagatggccaggcagcggtccagggacatgagcagcagcaggtaggtggaggcgaacatgcccaccacctgcaagtacttgaccaggcggcacagcaggtcgggcccgtagaagcggaaggtgatgtcccacagcaactgcggcagcacctgaaacactgccaccaccaggtcggcgatgcttaggtgcttcatgaagaagaagaggcgcgagtgcttctggcgtgtggtgcgcagcgccagcagcacacacgcgttcccgctcagc

SEQ ID NO: 6767 - DNA, 30 bp, Homo sapiens
  misc_feature 1..30: note = chr3:8810241-8810271
  misc_feature 1..30: note = hyper
  source 1..30: mol_type = genomic DNA
agcgtgccagttcctcgggatgttcagcgg

SEQ ID NO: 6768 - DNA, 68 bp, Homo sapiens
  misc_feature 1..68: note = chr3:8811111-8811179
  misc_feature 1..68: note = hyper
  source 1..68: mol_type = genomic DNA
gatgggtacaggaggcgagcgaggagcgcctcccaggctgcgcgcgcggacagcgtctggatgcggcg

SEQ ID NO: 6769 - DNA, 258 bp, Homo sapiens
  misc_feature 1..258: note = chr3:9541746-9542004
  misc_feature 1..258: note = hyper
  source 1..258: mol_type = genomic DNA
ttctctgtgcctgtgcgtccccctcgctccttctccaatcatctctcatctccctgtctctgcacccctcttctcctcaccccagtgtcttctcccattcccagtcgcttgctgcgcccctcccctcactctctcctaactctgctctccccctccaacgctgggcttggtttgcatctttgaggaactccctcctaccccaactccctcccacggggctcccgcatcctcccgcatttaactcggaccctctgtccc

SEQ ID NO: 6770 - DNA, 57 bp, Homo sapiens
  misc_feature 1..57: note = chr3:9593979-9594036
  misc_feature 1..57: note = hyper
  source 1..57: mol_type = genomic DNA
gcagatcttgtagaccgtagccgtgttgcagaagaagaaaagcgaaaagcaggtgat

SEQ ID NO: 6771 - DNA, 47 bp, Homo sapiens; identical to SEQ ID NO: 2200
  misc_feature 1..47: note = chr3:9595395-9595442
  misc_feature 1..47: note = hyper
  source 1..47: mol_type = genomic DNA

SEQ ID NO: 6772 - DNA, 41 bp, Homo sapiens
  misc_feature 1..41: note = chr3:9745437-9745478
  misc_feature 1..41: note = hyper
  source 1..41: mol_type = genomic DNA
gctgctccaatggggcgggggccgcccgcagggccgggcgg

SEQ ID NO: 6773 - DNA, 334 bp, Homo sapiens; identical to SEQ ID NO: 2201
  misc_feature 1..334: note = chr3:9904291-9904625
  misc_feature 1..334: note = hyper
  source 1..334: mol_type = genomic DNA

SEQ ID NO: 6774 - DNA, 703 bp, Homo sapiens
  misc_feature 1..703: note = chr3:9956910-9957613
  misc_feature 1..703: note = hyper
  source 1..703: mol_type = genomic DNA
tcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaag

SEQ ID NO: 6775 - DNA, 35 bp, Homo sapiens
  misc_feature 1..35: note = chr3:9993993-9994028
  misc_feature 1..35: note = hyper
  source 1..35: mol_type = genomic DNA
ccagctcctcacctgcgcgccgcagcccccgtgtt

SEQ ID NO: 6776 - DNA, 55 bp, Homo sapiens
  misc_feature 1..55: note = chr3:10207053-10207108
  misc_feature 1..55: note = hyper
  source 1..55: mol_type = genomic DNA
acagcctgcaaagtgcgagcctcgaccctgtagggacccacggtgctgtcacttc

SEQ ID NO: 6777 - DNA, 112 bp, Homo sapiens
  misc_feature 1..112: note = chr3:10749325-10749437
  misc_feature 1..112: note = hyper
  source 1..112: mol_type = genomic DNA
cccccttccctcacccgcaggcgccgggtccgcggacgcccaccccggcccgccccgcccgccgcctggtgcccgctcaaggtcactgctgacaaggcgcctgcctccgcgg

SEQ ID NO: 6778 - DNA, 267 bp, Homo sapiens
  misc_feature 1..267: note = chr3:10749637-10749904
  misc_feature 1..267: note = hyper
  source 1..267: mol_type = genomic DNA
tgccgccgccgctgccgctggtgcgcgcccggcccggcccggccccgctgcggctgcggctcctctgccgcggctgccccgcgctcgcctgccccgcggccccgccgccgcccgcccgcctccctccctccgccgccgcctctgccaccgctgcactgcgctctgcccgcctccccctcccgccctccctgctcactcctccccgcgcgctccccctcggccctccccaaactcctcacggagagcgccccgcgggaccggagcgcg

SEQ ID NO: 6779 - DNA, 43 bp, Homo sapiens
  misc_feature 1..43: note = chr3:10857674-10857717
  misc_feature 1..43: note = hyper
  source 1..43: mol_type = genomic DNA
cagtgggcagggccgcgggaaggacgggcgctgcaggggctcc

SEQ ID NO: 6780 - DNA, 50 bp, Homo sapiens
  misc_feature 1..50: note = chr3:11034716-11034766
  misc_feature 1..50: note = hyper
  source 1..50: mol_type = genomic DNA
ggggggcggacacctcgagattcaagcccccgcgccgcaccttccctgag

SEQ ID NO: 6781 - DNA, 182 bp, Homo sapiens; identical to SEQ ID NO: 288
  misc_feature 1..182: note = chr3:11035171-11035353
  misc_feature 1..182: note = hyper
  source 1..182: mol_type = genomic DNA

SEQ ID NO: 6782 - skipped

SEQ ID NO: 6783 - DNA, 144 bp, Homo sapiens
  misc_feature 1..144: note = chr3:12046209-12046353
  misc_feature 1..144: note = hyper
  source 1..144: mol_type = genomic DNA
cgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtgga

SEQ ID NO: 6784 - DNA, 60 bp, Homo sapiens
  misc_feature 1..60: note = chr3:12046377-12046437
  misc_feature 1..60: note = hyper
  source 1..60: mol_type = genomic DNA
cgccaggaaggccaaggtgctgctggtggtcgacgagccgcacgccgactggtaggtgcc

SEQ ID NO: 6785 - DNA, 30 bp, Homo sapiens
  misc_feature 1..30: note = chr3:12917639-12917669
  misc_feature 1..30: note = hyper
  source 1..30: mol_type = genomic DNA
gcgtgggggcagcagcgtctggagggaggt

SEQ ID NO: 6786 - DNA, 535 bp, Homo sapiens; identical to SEQ ID NO: 2204
  misc_feature 1..535: note = chr3:13323494-13324029
  misc_feature 1..535: note = hyper
  source 1..535: mol_type = genomic DNA

SEQ ID NO: 6787 - DNA, 114 bp, Homo sapiens; identical to SEQ ID NO: 2205
  misc_feature 1..114: note = chr3:13324234-13324348
  misc_feature 1..114: note = hyper
  source 1..114: mol_type = genomic DNA

SEQ ID NO: 6788 - DNA, 19 bp, Homo sapiens
  misc_feature 1..19: note = chr3:13324419-13324438
  misc_feature 1..19: note = hyper
  source 1..19: mol_type = genomic DNA
gatccgggtcagctcctgc

SEQ ID NO: 6789 - DNA, 29 bp, Homo sapiens
  misc_feature 1..29: note = chr3:13324645-13324674
  misc_feature 1..29: note = hyper
  source 1..29: mol_type = genomic DNA
gcctcctgctccccgcgccgccgcgctcc

SEQ ID NO: 6790 - DNA, 186 bp, Homo sapiens
  misc_feature 1..186: note = chr3:13324740-13324926
  misc_feature 1..186: note = hyper
  source 1..186: mol_type = genomic DNA
gaggagttttgcaaagtgccggccgcggcgcgggaagagggcggggagggcgccgcctgctgggaccgcccctgggtcccgcgcccccgcaccaggcgtcgggggacagctccatccttctccggccgcctcgggcgccttaaatcggaagcgattccgtgaaatacatctcgaatccatcagcgg

SEQ ID NO: 6791 - DNA, 194 bp, Homo sapiens; identical to SEQ ID NO: 290
  misc_feature 1..194: note = chr3:13590447-13590641
  misc_feature 1..194: note = hyper
  source 1..194: mol_type = genomic DNA

SEQ ID NO: 6792 - DNA, 48 bp, Homo sapiens; identical to SEQ ID NO: 291
  misc_feature 1..48: note = chr3:13590973-13591021
  misc_feature 1..48: note = hyper
  source 1..48: mol_type = genomic DNA

SEQ ID NO: 6793 - DNA, 57 bp, Homo sapiens
  misc_feature 1..57: note = chr3:13920328-13920385
  misc_feature 1..57: note = hyper
  source 1..57: mol_type = genomic DNA
gctccgagcctcacacgcgttgtcttaagtacaaagggtgaccggctttgcacaagc

SEQ ID NO: 6794 - DNA, 58 bp, Homo sapiens
  misc_feature 1..58: note = chr3:13921080-13921138
  misc_feature 1..58: note = hyper
  source 1..58: mol_type = genomic DNA
cggggggcctttgtgcgtccaccgctcccacaccgcacccacccggcctctcagagaa

SEQ ID NO: 6795 - DNA, 131 bp, Homo sapiens
  misc_feature 1..131: note = chr3:13921475-13921606
  misc_feature 1..131: note = hyper
  source 1..131: mol_type = genomic DNA
ggagcacgggagccacggagcgggaggagggagggaggagcgagcgcggcgtggggcgacgccgggctgcgcgcgagcgaccggtgcaagtgtgcgagacgcggggagtgcgggggcgctgctgcctccag

SEQ ID NO: 6796 - DNA, 278 bp, Homo sapiens
  misc_feature 1..278: note = chr3:14643752-14644030
  misc_feature 1..278: note = hyper
  source 1..278: mol_type = genomic DNA
gtcagacaacaggtacgcggggagcagcccgggcggccccgcgcaggggttgagccgcagcgctgctgtgcaggggcaggcccgggcagggggcagtgcggcgagtcagccccctccctggcctcctcgcaactttgagtaaccgcggactccggggtcggcatgggggtggcgccgggcgttcaaaggaaagttgggtgcgacggaccgcagcctcgggggccaaaggacccccaccgtgagcgcggccacctcccgacacccggcgggctggctgg

SEQ ID NO: 6797 - DNA, 95 bp, Homo sapiens
  misc_feature 1..95: note = chr3:14851832-14851927
  misc_feature 1..95: note = hyper
  source 1..95: mol_type = genomic DNA
tgagttctcgtccttcgaacccccagcgcctcccgcggtgcccatggccacggcccctttaaatgtgcgcagggacgccccggccctcgcctccc

SEQ ID NO: 6798 - DNA, 59 bp, Homo sapiens
  misc_feature 1..59: note = chr3:14852367-14852426
  misc_feature 1..59: note = hyper
  source 1..59: mol_type = genomic DNA
agcaggtaggaggcccggcgacctccggcgccgaggcacgagcgcgagggaccccggcc

SEQ ID NO: 6799 - DNA, 59 bp, Homo sapiens
  misc_feature 1..59: note = chr3:16554052-16554111
  misc_feature 1..59: note = hyper
  source 1..59: mol_type = genomic DNA
acagacagcagggagcgtgcctggttctacaaccttggcctccacgcggttcttgctgc

SEQ ID NO: 6800 - DNA, 119 bp, Homo sapiens; identical to SEQ ID NO: 2209
  misc_feature 1..119: note = chr3:16554347-16554466
  misc_feature 1..119: note = hyper
  source 1..119: mol_type = genomic DNA

SEQ ID NO: 6801 - DNA, 189 bp, Homo sapiens; identical to SEQ ID NO: 2210
  misc_feature 1..189: note = chr3:16554467-16554656
  misc_feature 1..189: note = hyper
  source 1..189: mol_type = genomic DNA

SEQ ID NO: 6802 - DNA, 466 bp, Homo sapiens
  misc_feature 1..466: note = chr3:18485186-18485652
  misc_feature 1..466: note = hyper
  source 1..466: mol_type = genomic DNA
aaaccccggttctgccggcccgggagccttagcactggagcaataggaaaaggccaccgcgctcgggtctggacagcaggagggaaacacggtgtggactgcgaggctgcacctgtgatgtcccggcccctgctaagaggacggccctttcttctgcctcttgcccaactccaaacccacattcacgccagcagcctctccaggaccggcctcgctacagccagcgagggctcgaaatgaggagtgccgcggctttcaaactccgggctccaacttgagcgccccggcgcccgagtagctcccgggatgcagaagttgccacaaacttcccaggcccctcttcgccgatgcttacaatcagccgcgcaggcagggagcggagggaggcggagatggaccgggaaaggatgctgagcagactcgcgatccggtgggggaacattaccactcccgcagcccactcctc

SEQ ID NO: 6803 - DNA, 76 bp, Homo sapiens
  misc_feature 1..76: note = chr3:19189419-19189495
  misc_feature 1..76: note = hyper
  source 1..76: mol_type = genomic DNA
gcctcacaactaactcgggctgccctgcccctgtcgcgtgggctcgcaatggcaagtgctccggaagggggccgcc

SEQ ID NO: 6804 - DNA, 56 bp, Homo sapiens
  misc_feature 1..56: note = chr3:19190075-19190131
  misc_feature 1..56: note = hyper
  source 1..56: mol_type = genomic DNA
cctgctcggccccgccgtcaggccgggtcccccttccctgccgtcatcaggttccc

SEQ ID NO: 6805 - DNA, 15 bp, Homo sapiens
  misc_feature 1..15: note = chr3:22413896-22413911
  misc_feature 1..15: note = hyper
  source 1..15: mol_type = genomic DNA
ctccgccacctgaac

SEQ ID NO: 6806 - DNA, 119 bp, Homo sapiens
  misc_feature 1..119: note = chr3:22413959-22414078
  misc_feature 1..119: note = hyper
  source 1..119: mol_type = genomic DNA
cggcgcccccaggagcttttctctccttcctcccaccgagctcttcattctcctgctggcggccgcccggcgccctggccctggcatccgggaggagcagccgccggggctggctgtcc

SEQ ID NO: 6807 - DNA, 75 bp, Homo sapiens
  misc_feature 1..75: note = chr3:24870769-24870844
  misc_feature 1..75: note = hyper
  source 1..75: mol_type = genomic DNA
cctggcgccagggggcggggcgcagcgagccgggctcccgctgtctgctctcagcggcggcggcaggggctgagg

SEQ ID NO: 6808 - DNA, 32 bp, Homo sapiens
  misc_feature 1..32: note = chr3:24872010-24872042
  misc_feature 1..32: note = hyper
  source 1..32: mol_type = genomic DNA
ccttccagctctcagcgcggggtgagtttccc

SEQ ID NO: 6809 - DNA, 45 bp, Homo sapiens; identical to SEQ ID NO: 2211
  misc_feature 1..45: note = chr3:26665077-26665122
  misc_feature 1..45: note = hyper
  source 1..45: mol_type = genomic DNA

SEQ ID NO: 6810 - DNA, 63 bp, Homo sapiens
  misc_feature 1..63: note = chr3:26665569-26665632
  misc_feature 1..63: note = hyper
  source 1..63: mol_type = genomic DNA
ctgggtacctgggggcgcgtggagacaaggaatggagccccggaatgccgggcccttgggtac

SEQ ID NO: 6811 - DNA, 47 bp, Homo sapiens
  misc_feature 1..47: note = chr3:27754174-27754221
  misc_feature 1..47: note = hyper
  source 1..47: mol_type = genomic DNA
gtggatgtgtgtgtgcgcactcgcccacgtctcgtgttttacttttc

SEQ ID NO: 6812 - DNA, 67 bp, Homo sapiens
  misc_feature 1..67: note = chr3:27754465-27754532
  misc_feature 1..67: note = hyper
  source 1..67: mol_type = genomic DNA
attcttttcaagacacgcgccggtggaccgggtcctgggattggcttactcccgggctggaccttgg

SEQ ID NO: 6813 - DNA, 114 bp, Homo sapiens
  misc_feature 1..114: note = chr3:27754814-27754928
  misc_feature 1..114: note = hyper
  source 1..114: mol_type = genomic DNA
aaatcaaagggaatgcggggaagtttttattccagagcgtttccatgacacccgcagagatttaaaaaattacattcctccccctacgcaggtttaattcggaaagaagagact

SEQ ID NO: 6814 - DNA, 66 bp, Homo sapiens
  misc_feature 1..66: note = chr3:27756087-27756153
  misc_feature 1..66: note = hyper
  source 1..66: mol_type = genomic DNA
ggggtgtggggaaggcgctgaccaggataggggggctatgagtctcccttccggaatctaaatcag

SEQ ID NO: 6815 - DNA, 985 bp, Homo sapiens
  misc_feature 1..985: note = chr3:27762857-27763842
  misc_feature 1..985: note = hyper
  source 1..985: mol_type = genomic DNA
gtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattat

SEQ ID NO: 6816 - DNA, 32 bp, Homo sapiens
  misc_feature 1..32: note = chr3:27764130-27764162
  misc_feature 1..32: note = hyper
  source 1..32: mol_type = genomic DNA
atccacccactagcccgcgcctttctgccctt

SEQ ID NO: 6817 - DNA, 15 bp, Homo sapiens
  misc_feature 1..15: note = chr3:27764457-27764472
  misc_feature 1..15: note = hyper
  source 1..15: mol_type = genomic DNA
ttggggtctccatag

SEQ ID NO: 6818 - DNA, 181 bp, Homo sapiens; identical to SEQ ID NO: 2212
  misc_feature 1..181: note = chr3:27765181-27765362
  misc_feature 1..181: note = hyper
  source 1..181: mol_type = genomic DNA

SEQ ID NO: 6819 - DNA, 507 bp, Homo sapiens
  misc_feature 1..507: note = chr3:27771497-27772004
  misc_feature 1..507: note = hyper
  source 1..507: mol_type = genomic DNA
cctcctgcatgaaagcgcgctctaaagctagggtttttggactttaggagcgcttctcgcctccccctagacgtttgaagccttccaattgagcaagggctgggaagcgagaaggctcctctggtctctccctcctctgagcgcgggacctcggcggacaccctaatcccgaaacactcctctctgggactgcgcacttgccagcacgacagccaactccgcctcagaggagtcttttagggctctgagcgagtggcgaatgctcccccggtgatgcactatcgctcccacccacgccctggtacgcgcagcccgggaaaaagaaaaaaaaaagtccacgtaggggctcaaacccaggcgtcaggcgctgcagtcagggaaggctcccttaggggctgggttcctggcgcttacgacgcagagaaggataagggcgatggtttcgcaatcccaccccctcctttgtcctcctccccacctcccagcctttggcggcttagatctcca

SEQ ID NO: 6820 - DNA, 367 bp, Homo sapiens; identical to SEQ ID NO: 2213
  misc_feature 1..367: note = chr3:28616764-28617131
  misc_feature 1..367: note = hyper
  source 1..367: mol_type = genomic DNA

SEQ ID NO: 6821 - DNA, 306 bp, Homo sapiens; identical to SEQ ID NO: 2214
  misc_feature 1..306: note = chr3:28617343-28617649
  misc_feature 1..306: note = hyper
  source 1..306: mol_type = genomic DNA

SEQ ID NO: 6822 - DNA, 45 bp, Homo sapiens
  misc_feature 1..45: note = chr3:28617899-28617944
  misc_feature 1..45: note = hyper
  source 1..45: mol_type = genomic DNA
tcaggatgaactgcccggcgagagtgcaggcgctgaggacagcga

SEQ ID NO: 6823 - DNA, 40 bp, Homo sapiens
  misc_feature 1..40: note = chr3:32857752-32857792
  misc_feature 1..40: note = hyper
  source 1..40: mol_type = genomic DNA
aaggtgggtaaaaaccgagatctcccgggcagtggatatg

SEQ ID NO: 6824 - DNA, 33 bp, Homo sapiens
  misc_feature 1..33: note = chr3:32858114-32858147
  misc_feature 1..33: note = hyper
  source 1..33: mol_type = genomic DNA
atcagtcccaataaccggcgtactgaagagaag

SEQ ID NO: 6825 - DNA, 606 bp, Homo sapiens; identical to SEQ ID NO: 292
  misc_feature 1..606: note = chr3:32858353-32858959
  misc_feature 1..606: note = hyper
  source 1..606: mol_type = genomic DNA

SEQ ID NO: 6826 - DNA, 30 bp, Homo sapiens; identical to SEQ ID NO: 293
  misc_feature 1..30: note = chr3:32859255-32859285
  misc_feature 1..30: note = hyper
  source 1..30: mol_type = genomic DNA

SEQ ID NO: 6827 - DNA, 800 bp, Homo sapiens; identical to SEQ ID NO: 294
  misc_feature 1..800: note = chr3:32859417-32860217
  misc_feature 1..800: note = hyper
  source 1..800: mol_type = genomic DNA

SEQ ID NO: 6828 - DNA, 57 bp, Homo sapiens
  misc_feature 1..57: note = chr3:33259719-33259776
  misc_feature 1..57: note = hyper
  source 1..57: mol_type = genomic DNA
cccactcatctttcacgtcttcccggaccaagccaaaatatccgagggagttttcta

SEQ ID NO: 6829 - DNA, 770 bp, Homo sapiens; identical to SEQ ID NO: 2218
  misc_feature 1..770: note = chr3:33260026-33260796
  misc_feature 1..770: note = hyper
  source 1..770: mol_type = genomic DNA

SEQ ID NO: 6830 - DNA, 131 bp, Homo sapiens
  misc_feature 1..131: note = chr3:35680984-35681115
  misc_feature 1..131: note = hyper
  source 1..131: mol_type = genomic DNA
ccgcgtgggagggcacggaccggcggaggggcagacgacggaggcggccaagctggaggaacgggaccgagggatcgaccgaggctggctggctaggggtgggactggcagagctacggacaggtgggagc

SEQ ID NO: 6831 - DNA, 59 bp, Homo sapiens
  misc_feature 1..59: note = chr3:35681483-35681542
  misc_feature 1..59: note = hyper
  source 1..59: mol_type = genomic DNA
agagcagacaggaggcgggggcgcgttcactcccggcggccagccggccagagaaggcg

SEQ ID NO: 6832 - DNA, 149 bp, Homo sapiens
  misc_feature 1..149: note = chr3:36805921-36806070
  misc_feature 1..149: note = hyper
  source 1..149: mol_type = genomic DNA
gcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttg

SEQ ID NO: 6833 - DNA, 240 bp, Homo sapiens; identical to SEQ ID NO: 2219
  misc_feature 1..240: note = chr3:38035773-38036013
  misc_feature 1..240: note = hyper
  source 1..240: mol_type = genomic DNA

SEQ ID NO: 6834 - DNA, 32 bp, Homo sapiens
  misc_feature 1..32: note = chr3:38071358-38071390
  misc_feature 1..32: note = hyper
  source 1..32: mol_type = genomic DNA
ccgccacccacgggccgcgggccctgtcatta

SEQ ID NO: 6835 - DNA, 286 bp, Homo sapiens
  misc_feature 1..286: note = chr3:38080723-38081009
  misc_feature 1..286: note = hyper
  source 1..286: mol_type = genomic DNA
ccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccgg

SEQ ID NO: 6836 - DNA, 133 bp, Homo sapiens
  misc_feature 1..133: note = chr3:38081153-38081286
  misc_feature 1..133: note = hyper
  source 1..133: mol_type = genomic DNA
cggacggtgccggggtctcagcgctcggcacgcgtcagcacctgccaggtgccaggcgctgttccaggatctggggctgcagttgagaaacagcccatcatgccgaagtgggcccgacattctagtggaagga

SEQ ID NO: 6837 - DNA, 76 bp, Homo sapiens
  misc_feature 1..76: note = chr3:38690624-38690700
  misc_feature 1..76: note = hyper
  source 1..76: mol_type = genomic DNA
tgaccttggggtctccggcctccggtatccgggtcccaatcccagaccctccccgagcctgcgccagggatggccg

SEQ ID NO: 6838 - DNA, 66 bp, Homo sapiens
  misc_feature 1..66: note = chr3:42543514-42543580
  misc_feature 1..66: note = hyper
  source 1..66: mol_type = genomic DNA
gagtcgggcctctttcgagccctcgcttcctctcgcctggcttcttcggcgcgaaggatgaattgg

SEQ ID NO: 6839 - DNA, 672 bp, Homo sapiens
  misc_feature 1..672: note = chr3:42814446-42815118
  misc_feature 1..672: note = hyper
  source 1..672: mol_type = genomic DNA
tgcatggaaaataagcgtctgcctgggttagaagagggctgtgtgtgaagattcaaaggacgaaggggaagagtcctcgctgggcgcccagcacgcggtgagcgcccggccagtggcagcgcgctcgggctggggttgcgctcgggctcggttccgcgcccccggcagctgcgggctttcccagctccggcccgggcccttccgctctccccggcacttacagcggtctctctccacttctcccttctaggaccgcggcggctaggtcacctcctccggacgccgacacgcgctgccctggcaaccgtcaccagggaaacaagcgacgtcacttgcgcgttttcaacgctactctacgggggccgagggggcgccaagagttctgaaagtgacagaggcgctgatggcgcgctgggctggatccaagcgagcacgatctcgagtgcgctggagattttaaatcttctggagtatatttttaaaaaagttttgtggaccaaacgttctgcacagagatgcccattccgctctcctgttggggagttaaaaagcgaacgatctcaccatgaaatttaaagtagccattcagatatatttgaaaaatgtaaaacagtgtggggaaaggccatgttatgatggtgagtgaaggaagcaggacgcaatatagcaatg

SEQ ID NO: 6840 - DNA, 30 bp, Homo sapiens
  misc_feature 1..30: note = chr3:42947411-42947441
  misc_feature 1..30: note = hyper
  source 1..30: mol_type = genomic DNA
ccacctagggtgcagcgagctggagaggaa

SEQ ID NO: 6841 - DNA, 65 bp, Homo sapiens
  misc_feature 1..65: note = chr3:43020926-43020991
  misc_feature 1..65: note = hyper
  source 1..65: mol_type = genomic DNA
tgtgcagcgatctcccgagagttggcgcagggccacttggctgcagagaacgtgtgcaccttcag

SEQ ID NO: 6842 - DNA, 111 bp, Homo sapiens
  misc_feature 1..111: note = chr3:43021302-43021413
  misc_feature 1..111: note = hyper
  source 1..111: mol_type = genomic DNA
caccagagctgggggcgatcggctttcctgccgctcttagtggggcggaccgtaataagggggcttttattactaatctgcactccttgacctaaccgtaacccactcgca

SEQ ID NO: 6843 - DNA, 272 bp, Homo sapiens
  misc_feature 1..272: note = chr3:43935870-43936142
  misc_feature 1..272: note = hyper
  source 1..272: mol_type = genomic DNA
cagcgcgctcccaaccgctggagacagaaacaatgtgcgcgcgcacacggcccacgtgcacgcgcgcacgcccacgcggcatacaggcgcgcacgtgcacacgcgcgcctgcacagctctgcggctctgctccggccccacaggcccatcttaaagtgtttcgtgctctaacttaccaaacacgtggcagccggcagaacgaaaaggaaaataaatgaactgcgacgaaataaagcaggcctttccgcagtcggccacgtccaacagccact

SEQ ID NO: 6844 - DNA, 854 bp, Homo sapiens; identical to SEQ ID NO: 2220
  misc_feature 1..854: note = chr3:44036274-44037128
  misc_feature 1..854: note = hyper
  source 1..854: mol_type = genomic DNA

SEQ ID NO: 6845 - DNA, 1765 bp, Homo sapiens; identical to SEQ ID NO: 2221
  misc_feature 1..1765: note = chr3:44037129-44038894
  misc_feature 1..1765: note = hyper
  source 1..1765: mol_type = genomic DNA

SEQ ID NO: 6846 - DNA, 602 bp, Homo sapiens; identical to SEQ ID NO: 2222
  misc_feature 1..602: note = chr3:44039424-44040026
  misc_feature 1..602: note = hyper
  source 1..602: mol_type = genomic DNA

SEQ ID NO: 6847 - DNA, 1039 bp, Homo sapiens; identical to SEQ ID NO: 2223
  misc_feature 1..1039: note = chr3:44040056-44041095
  misc_feature 1..1039: note = hyper
  source 1..1039: mol_type = genomic DNA

SEQ ID NO: 6848 - DNA, 321 bp, Homo sapiens; identical to SEQ ID NO: 295
  misc_feature 1..321: note = chr3:44063500-44063821
  misc_feature 1..321: note = hyper
  source 1..321: mol_type = genomic DNA

SEQ ID NO: 6849 - DNA, 555 bp, Homo sapiens
  misc_feature 1..555: note = chr3:44596464-44597019
  misc_feature 1..555: note = hyper
  source 1..555: mol_type = genomic DNA
ggtgtagagctgggacgcgtctggatcccccgactatggcctgagagcgggatgtgagtggcctgggccctcgcgagaccccgaccccgcccgcggcaggtggccgggcacagccgagaagtaagccctgccagctctcccgggtgcggggacgcgcgcgcccaccttcgcaaacgagacttccgggatcccggagggggcggaagtcgaggcctctctcgcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgc

SEQ ID NO: 6850 - DNA, 87 bp, Homo sapiens; identical to SEQ ID NO: 2225
  misc_feature 1..87: note = chr3:44626451-44626538
  misc_feature 1..87: note = hyper
  source 1..87: mol_type = genomic DNA

SEQ ID NO: 6851 - DNA, 13 bp, Homo sapiens
  misc_feature 1..13: note = chr3:44626539-44626552
  misc_feature 1..13: note = hyper
  source 1..13: mol_type = genomic DNA
ggttctgggagcg

SEQ ID NO: 6852 - DNA, 24 bp, Homo sapiens
  misc_feature 1..24: note = chr3:44726825-44726849
  misc_feature 1..24: note = hyper
  source 1..24: mol_type = genomic DNA
atctgcatgcgattaaaaatgggt

SEQ ID NO: 6853 - DNA, 16 bp, Homo sapiens
  misc_feature 1..16: note = chr3:44727053-44727069
  misc_feature 1..16: note = hyper
  source 1..16: mol_type = genomic DNA
aggctacggggcgccc

SEQ ID NO: 6854 - DNA, 19 bp, Homo sapiens
  misc_feature 1..19: note = chr3:44727070-44727089
  misc_feature 1..19: note = hyper
  source 1..19: mol_type = genomic DNA
gccccgcacacccaagaaa

SEQ ID NO: 6855 - DNA, 66 bp, Homo sapiens
  misc_feature 1..66: note = chr3:44771010-44771076
  misc_feature 1..66: note = hyper
  source 1..66: mol_type = genomic DNA
gcgggaaggaaccaccgagcggaagccgctcccaccttcctagagaggagacggtagtggttatta

SEQ ID NO: 6856 - DNA, 118 bp, Homo sapiens
  misc_feature 1..118: note = chr3:45837583-45837701
  misc_feature 1..118: note = hyper
  source 1..118: mol_type = genomic DNA
gagggcttgggagggcggcttgggagagagctccggctccggaacgaggtgtcctgggaacactcccgggtctgtaacttcggacaaatcacgctcgctttcccggcctcagtgtgcc

SEQ ID NO: 6857 - DNA, 265 bp, Homo sapiens
  misc_feature 1..265: note = chr3:45837907-45838172
  misc_feature 1..265: note = hyper
  source 1..265: mol_type = genomic DNA
ccatggccccggcctcggcgcgctcggctccggctcgggggtccggcacggcagtctcagtgcgcggtcgccaggcgcgccgtcccaccccggctcggcttgggggtggccccgcgcctccgccgccgacgcagctagctggtttttaaattgctaatctcattaacggcgcgcccgtccgagaggcgaggctggtaaatggatgacggcgagccccaccccgcccgatcgtcgcggccgggaaggcacccgagattgcagagga

SEQ ID NO: 6858 - DNA, 409 bp, Homo sapiens; identical to SEQ ID NO: 296
  misc_feature 1..409: note = chr3:48693292-48693701
  misc_feature 1..409: note = hyper
  source 1..409: mol_type = genomic DNA

SEQ ID NO: 6859 - DNA, 31 bp, Homo sapiens; identical to SEQ ID NO: 297
  misc_feature 1..31: note = chr3:48693851-48693882
  misc_feature 1..31: note = hyper
  source 1..31: mol_type = genomic DNA

SEQ ID NO: 6860 - DNA, 272 bp, Homo sapiens; identical to SEQ ID NO: 298
  misc_feature 1..272: note = chr3:48693883-48694155
  misc_feature 1..272: note = hyper
  source 1..272: mol_type = genomic DNA

SEQ ID NO: 6861 - DNA, 164 bp, Homo sapiens; identical to SEQ ID NO: 299
  misc_feature 1..164: note = chr3:48698847-48699011
  misc_feature 1..164: note = hyper
  source 1..164: mol_type = genomic DNA

SEQ ID NO: 6862 - DNA, 363 bp, Homo sapiens; identical to SEQ ID NO: 300
  misc_feature 1..363: note = chr3:48699376-48699739
  misc_feature 1..363: note = hyper
  source 1..363: mol_type = genomic DNA

SEQ ID NO: 6863 - DNA, 30 bp, Homo sapiens
  misc_feature 1..30: note = chr3:48699943-48699973
  misc_feature 1..30: note = hyper
  source 1..30: mol_type = genomic DNA
agccctggtgcccaccgccccccagctcct

SEQ ID NO: 6864 - DNA, 30 bp, Homo sapiens
  misc_feature 1..30: note = chr3:48700359-48700389
  misc_feature 1..30: note = hyper
  source 1..30: mol_type = genomic DNA
ccggcgcccgaaacacggtggtacaaccca

SEQ ID NO: 6865 - DNA, 41 bp, Homo sapiens
  misc_feature 1..41: note = chr3:49851326-49851367
  misc_feature 1..41: note = hyper
  source 1..41: mol_type = genomic DNA
ggaaccaaggccaagcgaataagggacgctgctggtcacag

SEQ ID NO: 6866 - DNA, 78 bp, Homo sapiens
  misc_feature 1..78: note = chr3:49907209-49907287
  misc_feature 1..78: note = hyper
  source 1..78: mol_type = genomic DNA
cagggaggaagtgatcgcgggctcagcggggcgccgagggctccggggacggcgggcagaatccgctccgagcacgcg

SEQ ID NO: 6867 - DNA, 170 bp, Homo sapiens
  misc_feature 1..170: note = chr3:50243350-50243520
  misc_feature 1..170: note = hyper
  source 1..170: mol_type = genomic DNA
tgctggtcccagagccggtgccatttgcagaggagccagcgggcacagcgggcgcagggcgcgagtggctccctgacctgaggccggggcgccgtgcgagctcctccccacctggcgctgggtagggtgtaagttagagcccgcgcagcgcacggcggagagaaggaacc

SEQ ID NO: 6868 - DNA, 116 bp, Homo sapiens
  misc_feature 1..116: note = chr3:50402170-50402286
  misc_feature 1..116: note = hyper
  source 1..116: mol_type = genomic DNA
gcagggagaccaggacgcccagcgacggcgggaaggaggccccgcggccacagtctgaggtatcttcctgcggggagagacaaggagctggtcggcctgggcgggcgcaaggccgc

SEQ ID NO: 6869 - DNA, 156 bp, Homo sapiens
  misc_feature 1..156: note = chr3:50402494-50402650
  misc_feature 1..156: note = hyper
  source 1..156: mol_type = genomic DNA
gggcaggatacagtgcgtctccttctgcagcagccggccagcctcgcactggctgcacagcggcttctcggccaccacaaagagaagattggtgttggtcagtctctgcgcgtggaacagcctgcgggcagcccggaaaggcggggcgttgagttt

SEQ ID NO: 6870 - DNA, 269 bp, Homo sapiens
  misc_feature 1..269: note = chr3:54155224-54155493
  misc_feature 1..269: note = hyper
  source 1..269: mol_type = genomic DNA
cccaggtgtctggtgcgccgggagccccggcgacgttaggagcgcactccttgctggggtcaccggagttgcgcttggccgggcaaggatgactcagcctcactccggtcggtctttaccgccagcctgcgcgagggctccacaaagttcccaatcacaccccatacctcgcacgggggagaggggttctgcaagctgggtcccggggtgggggcagcggcgagagaggcggggagaagcctggttcccagaacgcgcaggggcttctc

SEQ ID NO: 6871 - DNA, 23 bp, Homo sapiens
  misc_feature 1..23: note = chr3:54155524-54155547
  misc_feature 1..23: note = hyper
  source 1..23: mol_type = genomic DNA
cgagaaggcgcctcctccggcgc

SEQ ID NO: 6872 - DNA, 110 bp, Homo sapiens
  misc_feature 1..110: note = chr3:54155775-54155885
  misc_feature 1..110: note = hyper
  source 1..110: mol_type = genomic DNA
cgcagggggccgctgcgctgcggccggatgccgggagccccgcgctggtgcgcccaagccgtggtggcagcaccgccctccgtgctttcccctgtcgggcgccgcggccg

SEQ ID NO: 6873 - DNA, 77 bp, Homo sapiens
  misc_feature 1..77: note = chr3:54156663-54156740
  misc_feature 1..77: note = hyper
  source 1..77: mol_type = genomic DNA
gcccaccgcccgctccgcgcagctccccgcggccgctctcgtcgccgccgcagcgggcgcgtcggagggagcccagc

SEQ ID NO: 6874 - DNA, 40 bp, Homo sapiens
  misc_feature 1..40: note = chr3:54157034-54157074
  misc_feature 1..40: note = hyper
  source 1..40: mol_type = genomic DNA
gctctggcccctgcccgcaggttgccgagtgagatctgga

SEQ ID NO: 6875 - DNA, 358 bp, Homo sapiens
  misc_feature 1..358: note = chr3:54157315-54157673
  misc_feature 1..358: note = hyper
  source 1..358: mol_type = genomic DNA
gcattcttaactccgcgacccccctcgggccccctcccgcgctgcgctttgcagttttggtgctggcagtttctaccaagccgctttttctatcttttcttcttttaaaacatgttacatcgcactgctccttcagccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatgg

SEQ ID NO: 6876 - DNA, 146 bp, Homo sapiens
  misc_feature 1..146: note = chr3:55521121-55521267
  misc_feature 1..146: note = hyper
  source 1..146: mol_type = genomic DNA
tgcggagtcctccggcgcgcgtccggcgggcgcagtgaaccggagctgaagcgggcactggcgcccgggcctggactcccgagttggggcagagctgggatgcgcccaggaatggagggggcgcggacgcgcgcgagccggcagca

SEQ ID NO: 6877 - DNA, 114 bp, Homo sapiens
  misc_feature 1..114: note = chr3:55522622-55522736
  misc_feature 1..114: note = hyper
  source 1..114: mol_type = genomic DNA
tggggtgccgggaggcggggtacactctccttgtctccccttctctaagttccccatcccccgcggcatctgctgaaagagagaggtccactccgcagccgctgcctgcctgcc

SEQ ID NO: 6878 - DNA, 104 bp, Homo sapiens
  misc_feature 1..104: note = chr3:55523009-55523113
  misc_feature 1..104: note = hyper
  source 1..104: mol_type = genomic DNA
ttgctcatctggctccggcccagagcatgaggcgcgatgcgtggtcctgccacggagatcttggcgggtgccctcaggtgaggagattgcgaagtttggcaaaa

SEQ ID NO: 6879 - DNA, 50 bp, Homo sapiens
  misc_feature 1..50: note = chr3:56502716-56502766
  misc_feature 1..50: note = hyper
  source 1..50: mol_type = genomic DNA
agcgcccggcatgggcgggggtcttcgcagcgcctcctcccggcaggccg

SEQ ID NO: 6880 - DNA, 30 bp, Homo sapiens
  misc_feature 1..30: note = chr3:62305019-62305049
  misc_feature 1..30: note = hyper
  source 1..30: mol_type = genomic DNA
tgcattaattggcctcgttgcaaaaggaaa

SEQ ID NO: 6881 - DNA, 443 bp, Homo sapiens; identical to SEQ ID NO: 301
  misc_feature 1..443: note = chr3:62353488-62353931
  misc_feature 1..443: note = hyper
  source 1..443: mol_type = genomic DNA

SEQ ID NO: 6882 - DNA, 45 bp, Homo sapiens
  misc_feature 1..45: note = chr3:62354283-62354328
  misc_feature 1..45: note = hyper
  source 1..45: mol_type = genomic DNA
caaatagtcgcctcccgccgtggaaatacgcgtggggtcagctcc

SEQ ID NO: 6883 - DNA, 168 bp, Homo sapiens; identical to SEQ ID NO: 2233
  misc_feature 1..168: note = chr3:62354625-62354793
  misc_feature 1..168: note = hyper
  source 1..168: mol_type = genomic DNA

SEQ ID NO: 6884 - DNA, 40 bp, Homo sapiens; identical to SEQ ID NO: 2234
  misc_feature 1..40: note = chr3:62354899-62354939
  misc_feature 1..40: note = hyper
  source 1..40: mol_type = genomic DNA

SEQ ID NO: 6885 - DNA, 54 bp, Homo sapiens
  misc_feature 1..54: note = chr3:62355424-62355478
  misc_feature 1..54: note = hyper
  source 1..54: mol_type = genomic DNA
aaagatggctaggggcgccgcgctcttctggggcgctcacggtgacaggctggg

SEQ ID NO: 6886 - DNA, 446 bp, Homo sapiens; identical to SEQ ID NO: 302
  misc_feature 1..446: note = chr3:62355774-62356220
  misc_feature 1..446: note = hyper
  source 1..446: mol_type = genomic DNA

SEQ ID NO: 6887 - DNA, 279 bp, Homo sapiens; identical to SEQ ID NO: 303
  misc_feature 1..279: note = chr3:62356366-62356645
  misc_feature 1..279: note = hyper
  source 1..279: mol_type = genomic DNA

SEQ ID NO: 6888 - DNA, 367 bp, Homo sapiens; identical to SEQ ID NO: 304
  misc_feature 1..367: note = chr3:62356792-62357159
  misc_feature 1..367: note = hyper
  source 1..367: mol_type = genomic DNA

SEQ ID NO: 6889 - DNA, 176 bp, Homo sapiens
  misc_feature 1..176: note = chr3:62357495-62357671
  misc_feature 1..176: note = hyper
  source 1..176: mol_type = genomic DNA
ccaatactgtgtggccgctgacaagggcatccccattttacagaataggaaactgaggcccaacgaggctcccagtttgggtagtcaactactggggagctcctcagcttgaaaaaggggcattccaggctgccccaaggaagccgccgccgccgatcgcccctcccggcccccct

SEQ ID NO: 6890 - DNA, 15 bp, Homo sapiens
  misc_feature 1..15: note = chr3:62357735-62357750
  misc_feature 1..15: note = hyper
  source 1..15: mol_type = genomic DNA
cggagcctcctggca

SEQ ID NO: 6891 - DNA, 239 bp, Homo sapiens
  misc_feature 1..239: note = chr3:62358336-62358575
  misc_feature 1..239: note = hyper
  source 1..239: mol_type = genomic DNA
cggcgagcagaggttgagcagtttcttgccctggctgccgtccgcctctagcgctccaggccggggctcaaagggcgcacggggctccgacgtcttggccatgatgcgctcgatggaaaaggccagtgtcttggaagtggccggcgacgctccggcgcgcgggcaggccgggggcaccatggtctccagggaagccgagcttgccatggcgcgcggagctgagccgagccaggctgggc

SEQ ID NO: 6892 - DNA, 30 bp, Homo sapiens
  misc_feature 1..30: note = chr3:62358873-62358903
  misc_feature 1..30: note = hyper
  source 1..30: mol_type = genomic DNA
cgggcctctgccacgcgtgctgggagctgg

SEQ ID NO: 6893 - DNA, 1051 bp, Homo sapiens; identical to SEQ ID NO: 305
  misc_feature 1..1051: note = chr3:62359440-62360491
  misc_feature 1..1051: note = hyper
  source 1..1051: mol_type = genomic DNA

SEQ ID NO: 6894 - DNA, 66 bp, Homo sapiens
  misc_feature 1..66: note = chr3:62362851-62362917
  misc_feature 1..66: note = hyper
  source 1..66: mol_type = genomic DNA
gcctcagcctagagccggacgctttggcttcttcgccatctggccctaggttgggcctcaaactcc

SEQ ID NO: 6895 - DNA, 581 bp, Homo sapiens; identical to SEQ ID NO: 2239
  misc_feature 1..581: note = chr3:62363596-62364177
  misc_feature 1..581: note = hyper
  source 1..581: mol_type = genomic DNA

SEQ ID NO: 6896 - DNA, 373 bp, Homo sapiens; identical to SEQ ID NO: 2240
  misc_feature 1..373: note = chr3:62364753-62365126
  misc_feature 1..373: note = hyper
  source 1..373: mol_type = genomic DNA

SEQ ID NO: 6897 - DNA, 54 bp, Homo sapiens
  misc_feature 1..54: note = chr3:62861840-62861894
  misc_feature 1..54: note = hyper
  source 1..54: mol_type = genomic DNA
taatgcgtcgactgtcgcactctgttcacccctgcctctcgggtaaactattaa

SEQ ID NO: 6898 - DNA, 200 bp, Homo sapiens
  misc_feature 1..200: note = chr3:63264640-63264840
  misc_feature 1..200: note = hyper
  source 1..200: mol_type = genomic DNA
ggcttagacaagtgtcgtctcacctcaccgcttgcagacgcgcaggggctgtggaaagaaacctcccccttgggagataggggaggggggcgcatggaagggctgccgctgggttctggcccctcacctggaccttcgtggggatgaggggatgggtggagggacccatagttgagcggaggagccgggaagacttggcc

SEQ ID NO: 6899 - DNA, 30 bp, Homo sapiens
  misc_feature 1..30: note = chr3:64672193-64672223
  misc_feature 1..30: note = hyper
  source 1..30: mol_type = genomic DNA
aagcgggcgaggaggcggaaggggagagga

SEQ ID NO: 6900 - DNA, 94 bp, Homo sapiens
  misc_feature 1..94: note = chr3:68057086-68057180
  misc_feature 1..94: note = hyper
  source 1..94: mol_type = genomic DNA
agcccagggtcctcccgcgcgcctgcaccaggctgcagcgagcgcgcaagcctgctgggtgctggagctcgggccgccccgggagaaggggtgg

SEQ ID NO: 6901 - DNA, 31 bp, Homo sapiens; identical to SEQ ID NO: 306
  misc_feature 1..31: note = chr3:68980916-68980947
  misc_feature 1..31: note = hyper
  source 1..31: mol_type = genomic DNA

SEQ ID NO: 6902 - DNA, 270 bp, Homo sapiens; identical to SEQ ID NO: 307
  misc_feature 1..270: note = chr3:68980948-68981218
  misc_feature 1..270: note = hyper
  source 1..270: mol_type = genomic DNA

SEQ ID NO: 6903 - DNA, 398 bp, Homo sapiens
  misc_feature 1..398: note = chr3:69435163-69435561
  misc_feature 1..398: note = hyper
  source 1..398: mol_type = genomic DNA
gggcgtcccggctctcgtacgtgcagccccgaccccagcggcctgcccgcctgggctcccgacgccggcttctgctggcagccggggggtcaagcctgccaccaaactcgtctttcaccgtgcgtcctggccaggctccggcggcatgccctgggattgggtgcccgccagccaacggctgcgactggcacacagaagcccagtgtccacccccgcccgctcgcagcgccgagcaagctgtgctaagctccaccaagctggccctcgatgctcccggggcacgggaagccctggccggcgaggactccccctggcgcttccccagggcgcggggcagggacggaagcggagcaactctttgcaggcagagaggggagctgcatttcagcacacttggc

SEQ ID NO: 6904 - DNA, 37 bp, Homo sapiens
  misc_feature 1..37: note = chr3:69435621-69435658
  misc_feature 1..37: note = hyper
  source 1..37: mol_type = genomic DNA
cgagtggtctcctaatctgcctcggggaacaccttac

SEQ ID NO: 6905 - DNA, 30 bp, Homo sapiens
  misc_feature 1..30: note = chr3:69590888-69590918
  misc_feature 1..30: note = hyper
  source 1..30: mol_type = genomic DNA
aaaagggcagccaaacgaaacccttagtgt

SEQ ID NO: 6906 - DNA, 44 bp, Homo sapiens
  misc_feature 1..44: note = chr3:69591371-69591415
  misc_feature 1..44: note = hyper
  source 1..44: mol_type = genomic DNA
ctccctgcggcgctccggggctgtagacggctactttattgtct

SEQ ID NO: 6907 - DNA, 65 bp, Homo sapiens
  misc_feature 1..65: note = chr3:69591913-69591978
  misc_feature 1..65: note = hyper
  source 1..65: mol_type = genomic DNA
cgccgcacggggctgcgggctgggctagccttccccggcagagaaagggcgccggtgccaggagg

SEQ ID NO: 6908 - DNA, 70 bp, Homo sapiens
  misc_feature 1..70: note = chr3:71179297-71179367
  misc_feature 1..70: note = hyper
  source 1..70: mol_type = genomic DNA
aaaaagaaggcaacacgaaacaatgtcacagtaagcagagagaggttccaatctacgtttagcctataaa

SEQ ID NO: 6909 - DNA, 514 bp, Homo sapiens
  misc_feature 1..514: note = chr3:71802858-71803372
  misc_feature 1..514: note = hyper
  source 1..514: mol_type = genomic DNA
agagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgc

SEQ ID NO: 6910 - DNA, 130 bp, Homo sapiens
  misc_feature 1..130: note = chr3:71803654-71803784
  misc_feature 1..130: note = hyper
  source 1..130: mol_type = genomic DNA
tggccgcggccttcccgccagtgctggacggcggtggcgacgacgaggacgcgccgtgcgccctggagcagcggcccgacggcgcccccggcgcgctgggcttcctgctgctgctggccgtggtggtggg

SEQ ID NO: 6911 - DNA, 119 bp, Homo sapiens
  misc_feature 1..119: note = chr3:71803826-71803945
  misc_feature 1..119: note = hyper
  source 1..119: mol_type = genomic DNA
cgaccgccgcaagatgcggcccgcgcgcctggtgcccgccgtcagccacgactggaccttccacggcccgggcgccaccggccaggcggccgccaactggacggcgggcttcggccgcg

SEQ ID NO: 6912 - DNA, 469 bp, Homo sapiens
  misc_feature 1..469: note = chr3:71834256-71834725
  misc_feature 1..469: note = hyper
  source 1..469: mol_type = genomic DNA
gtgcgctgggtggagcgcggagcggcgggcggacgggcgcggcggctcccgcgagcctccgggccgttataaaggctagccccgccgtgactcacgccggcgcccgcccggcagcacacgcggggggcacggcgcgggcacacaccccacgccccacgcgcacacgcgcgcccgcctcggcccggccggctcccagacgagcacgtgctatgcgcggccccccgcgcccccgcctcgggcgccacgcaggcagcgctcccggcggggcgccccgctctgcgccgttccctccgccgtcgcccagccaccgcctttcgcacgcgccggaaccgcttttgtggtctccgagacactcatttgctgtcctggtttccaaagctccacgtgctcagcgccgaaaacttgcaaatcatttgctgtacagatgtttaggggtcgcctactacgtgcggggcgctgtggacacata

SEQ ID NO: 6913 - DNA, 15 bp, Homo sapiens
  misc_feature 1..15: note = chr3:75955872-75955887
  misc_feature 1..15: note = hyper
  source 1..15: mol_type = genomic DNA
cgctgcgccaccacc

SEQ ID NO: 6914 - DNA, 46 bp, Homo sapiens
  misc_feature 1..46: note = chr3:75956103-75956149
  misc_feature 1..46: note = hyper
  source 1..46: mol_type = genomic DNA
gactccaggtgagttcggcaaagaggtgaaccgaggggtctcgaac

SEQ ID NO: 6915 - DNA, 32 bp, Homo sapiens
  misc_feature 1..32: note = chr3:77089150-77089182
  misc_feature 1..32: note = hyper
  source 1..32: mol_type = genomic DNA
cctcagaggcggcaccgcgggggtgtctgcag

SEQ ID NO: 6916 - DNA, 360 bp, Homo sapiens
  misc_feature 1..360: note = chr3:79815522-79815882
  misc_feature 1..360: note = hyper
  source 1..360: mol_type = genomic DNA
gagtagtgggagctccgactcgaggcaggagtgggatgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaac

SEQ ID NO: 6917 - DNA, 76 bp, Homo sapiens
  misc_feature 1..76: note = chr3:79816876-79816952
  misc_feature 1..76: note = hyper
  source 1..76: mol_type = genomic DNA
ccttgcaaccatttccgagacttacccttccataagactgttttcagcaatctagaggctccgtagtgcagacgca

SEQ ID NO: 6918 - DNA, 103 bp, Homo sapiens
  misc_feature 1..103: note = chr3:85007801-85007904
  misc_feature 1..103: note = hyper
  source 1..103: mol_type = genomic DNA
aaccccgccccctcgcggtggcgattggctgaacccttcctgagtgcaaagcgctgattaatgaaggcagttgtctcgcctgcaagttcgggcgagacatctc

SEQ ID NO: 6919 - DNA, 118 bp, Homo sapiens; identical to SEQ ID NO: 2243
  misc_feature 1..118: note = chr3:85008597-85008715
  misc_feature 1..118: note = hyper
  source 1..118: mol_type = genomic DNA

SEQ ID NO: 6920 - DNA, 30 bp, Homo sapiens
  misc_feature 1..30: note = chr3:85009273-85009303
  misc_feature 1..30: note = hyper
  source 1..30: mol_type = genomic DNA
caccatcatcatatccgtgtgtctttaaaa

SEQ ID NO: 6921 - DNA, 30 bp, Homo sapiens
  misc_feature 1..30: note = chr3:85009835-85009865
  misc_feature 1..30: note = hyper
  source 1..30: mol_type = genomic DNA
actgggtttggatgccggatggctaaggaa

SEQ ID NO: 6922 - DNA, 30 bp, Homo sapiens
  misc_feature 1..30: note = chr3:87040188-87040218
  misc_feature 1..30: note = hyper
  source 1..30: mol_type = genomic DNA
accgcgtccggctcccgcgagggctgcggc

SEQ ID NO: 6923 - DNA, 30 bp, Homo sapiens
  misc_feature 1..30: note = chr3:87841652-87841682
  misc_feature 1..30: note = hyper
  source 1..30: mol_type = genomic DNA
agaggagggaggagacggaggagagaagag

SEQ ID NO: 6924 - DNA, 36 bp, Homo sapiens
  misc_feature 1..36: note = chr3:87842210-87842246
  misc_feature 1..36: note = hyper
  source 1..36: mol_type = genomic DNA
tctgctccctgggggcgaagttctgtggtgctaggc

SEQ ID NO: 6925 - DNA, 13 bp, Homo sapiens
  misc_feature 1..13: note = chr3:87842247-87842260
  misc_feature 1..13: note = hyper
  source 1..13: mol_type = genomic DNA
gagatagtggtca

SEQ ID NO: 6926 - DNA, 75 bp, Homo sapiens
  misc_feature 1..75: note = chr3:96532177-96532252
  misc_feature 1..75: note = hyper
  source 1..75: mol_type = genomic DNA
gcggcatccgagccgcggctgccaggccgggagaaggctgggcttggccgggctctgcagcgctccgggctccgt

SEQ ID NO: 6927 - DNA, 105 bp, Homo sapiens
  misc_feature 1..105: note = chr3:96532833-96532938
  misc_feature 1..105: note = hyper
  source 1..105: mol_type = genomic DNA
ccgctgagctgtccccggacgggagcgcctgtccacggcactcaccccctccagcggtggaaatgtggagaagtaagtgggaggcggtgtcgggaactgactcct

SEQ ID NO: 6928 - DNA, 224 bp, Homo sapiens
  misc_feature 1..224: note = chr3:96533242-96533466
  misc_feature 1..224: note = hyper
  source 1..224: mol_type = genomic DNA
ccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaaaccacagcccgagctcgctcttgcgcgcgcgcgctctctccggcccaagtgaatagtcctcgcgcaagcgggacactgtggtg

SEQ ID NO: 6929 - DNA, 205 bp, Homo sapiens
  misc_feature 1..205: note = chr3:98452166-98452371
  misc_feature 1..205: note = hyper
  source 1..205: mol_type = genomic DNA
aggagccgtgggggccgagagaatctgctctgggaccctcttttgtcgaatcgccggcgaggttgtgcaattgggaagccaagaggagtgtccagctcctcgttcactattgttttcttgtaaaagggtctgtacgcgaggagggttgaggggtctggaaggttctggtctcttaccgtataaagtttttcgagaaacccttttt

SEQ ID NO: 6930 - DNA, 51 bp, Homo sapiens
  misc_feature 1..51: note = chr3:98620538-98620589
  misc_feature 1..51: note = hyper
  source 1..51: mol_type = genomic DNA
cgcagccagctccctcgcgctccctctcgcgcgcgccggccacgcccccta

SEQ ID NO: 6931 - DNA, 234 bp, Homo sapiens
  misc_feature 1..234: note = chr3:99594925-99595159
  misc_feature 1..234: note = hyper
  source 1..234: mol_type = genomic DNA
tgcgccggggccgggcgggggccgggccggggccgctgtagtgccgcgctgcgagccgactgtgcgcgctccgagagtcgcccgaacaatgcgagcggggcgctgagcgcgcccggcctatgggcgttacgtcactgttctgccttataaggcgctccgcgtgtgcggcgctgtcggcgggggcgccggtgaccgcgggaccctcggccgcggcggcggcgcagccacacaccc

SEQ ID NO: 6932 - DNA, 30 bp, Homo sapiens
  misc_feature 1..30: note = chr3:110789665-110789695
  misc_feature 1..30: note = hyper
  source 1..30: mol_type = genomic DNA
ataaaactacacatacgaacatgcaaagga

SEQ ID NO: 6933 - DNA, 15 bp, Homo sapiens
  misc_feature 1..15: note = chr3:112930422-112930437
  misc_feature 1..15: note = hyper
  source 1..15: mol_type = genomic DNA
tccatatggagggac

SEQ ID NO: 6934 - DNA, 30 bp, Homo sapiens
  misc_feature 1..30: note = chr3:112931110-112931140
  misc_feature 1..30: note = hyper
  source 1..30: mol_type = genomic DNA
cccgggggctgcagccgctacggggcccag

SEQ ID NO: 6935 - DNA, 30 bp, Homo sapiens
  misc_feature 1..30: note = chr3:115231640-115231670
  misc_feature 1..30: note = hyper
  source 1..30: mol_type = genomic DNA
gatggtagaggtgagcgggcgggtgttgaa

SEQ ID NO: 6936 - DNA, 142 bp, Homo sapiens
  misc_feature 1..142: note = chr3:116163769-116163911
  misc_feature 1..142: note = hyper
  source 1..142: mol_type = genomic DNA
ctcggttaaaatccacgctgcgaacaggcagtcctgtgggaagaaggcagagcaatctcagtaggaccagtggcaactgtttccgatccggctgaactctcctgaccatggtggccacgccgaggtgcgggtccgcggggtg

SEQ ID NO: 6937 - DNA, 16 bp, Homo sapiens
  misc_feature 1..16: note = chr3:117715630-117715646
  misc_feature 1..16: note = hyper
  source 1..16: mol_type = genomic DNA
gtcgccaccacctcgc

SEQ ID NO: 6938 - DNA, 358 bp, Homo sapiens; identical to SEQ ID NO: 2245
  misc_feature 1..358: note = chr3:117715766-117716124
  misc_feature 1..358: note = hyper
  source 1..358: mol_type = genomic DNA

SEQ ID NO: 6939 - DNA, 99 bp, Homo sapiens; identical to SEQ ID NO: 2246
  misc_feature 1..99: note = chr3:117716213-117716312
  misc_feature 1..99: note = hyper
  source 1..99: mol_type = genomic DNA

SEQ ID NO: 6940 - DNA, 368 bp, Homo sapiens; identical to SEQ ID NO: 2247
  misc_feature 1..368: note = chr3:117716313-117716681
  misc_feature 1..368: note = hyper
  source 1..368: mol_type = genomic DNA

SEQ ID NO: 6941 - DNA, 48 bp, Homo sapiens
  misc_feature 1..48: note = chr3:120003868-120003916
  misc_feature 1..48: note = hyper
  source 1..48: mol_type = genomic DNA
tgctcacctcatcagcgtcggaccgccgagaagcgccaagcccgctgc

SEQ ID NO: 6942 - DNA, 63 bp, Homo sapiens
  misc_feature 1..63: note = chr3:120169776-120169839
  misc_feature 1..63: note = hyper
  source 1..63: mol_type = genomic DNA
gcaggacggcggcagcgagctgtaagcggaggtgggagctccgccgatcgccagcctcggagg

SEQ ID NO: 6943 - DNA, 53 bp, Homo sapiens
  misc_feature 1..53: note = chr3:120170117-120170170
  misc_feature 1..53: note = hyper
  source 1..53: mol_type = genomic DNA
agggaaaccccaccccgggaggggctgctggctggcggcggcccgggcgggct

SEQ ID NO: 6944 - DNA, 189 bp, Homo sapiens
  misc_feature 1..189: note = chr3:120627329-120627518
  misc_feature 1..189: note = hyper
  source 1..189: mol_type = genomic DNA
gagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctga

SEQ ID NO: 6945 - DNA, 39 bp, Homo sapiens; identical to SEQ ID NO: 2248
  misc_feature 1..39: note = chr3:120627972-120628011
  misc_feature 1..39: note = hyper
  source 1..39: mol_type = genomic DNA

SEQ ID NO: 6946 - DNA, 173 bp, Homo sapiens; identical to SEQ ID NO: 308
  misc_feature 1..173: note = chr3:121902777-121902950
  misc_feature 1..173: note = hyper
  source 1..173: mol_type = genomic DNA

SEQ ID NO: 6947 - DNA, 229 bp, Homo sapiens; identical to SEQ ID NO: 309
  misc_feature 1..229: note = chr3:121902990-121903219
  misc_feature 1..229: note = hyper
  source 1..229: mol_type = genomic DNA

SEQ ID NO: 6948 - DNA, 325 bp, Homo sapiens; identical to SEQ ID NO: 310
  misc_feature 1..325: note = chr3:121903323-121903648
  misc_feature 1..325: note = hyper
  source 1..325: mol_type = genomic DNA

SEQ ID NO: 6949 - DNA, 45 bp, Homo sapiens
  misc_feature 1..45: note = chr3:122296693-122296738
  misc_feature 1..45: note = hyper
  source 1..45: mol_type = genomic DNA
gagtatggtgaggagcgcgggggacgggtgcgggaaggggacagc

SEQ ID NO: 6950 - DNA, 28 bp, Homo sapiens
  misc_feature 1..28: note = chr3:123166978-123167006
  misc_feature 1..28: note = hyper
  source 1..28: mol_type = genomic DNA
gccgccgccgccgcccgcagggggcgcc

SEQ ID NO: 6951 - DNA, 430 bp, Homo sapiens; identical to SEQ ID NO: 2253
  misc_feature 1..430: note = chr3:123167300-123167730
  misc_feature 1..430: note = hyper
  source 1..430: mol_type = genomic DNA

SEQ ID NO: 6952 - DNA, 102 bp, Homo sapiens
  misc_feature 1..102: note = chr3:123602641-123602743
  misc_feature 1..102: note = hyper
  source 1..102: mol_type = genomic DNA
cccgccctaccttcccggaatcacatttgggctggaaggaccttcacgtggcacccccttcccagaggccgtcaccgagtcctctagcgagggtctgggagc

SEQ ID NO: 6953 - DNA, 240 bp, Homo sapiens
  misc_feature 1..240: note = chr3:123603253-123603493
  misc_feature 1..240: note = hyper
  source 1..240: mol_type = genomic DNA
gagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgca

SEQ ID NO: 6954 - DNA, 466 bp, Homo sapiens
  misc_feature 1..466: note = chr3:125898741-125899207
  misc_feature 1..466: note = hyper
  source 1..466: mol_type = genomic DNA
gaccgtccacttgagcgcagtggctggagctgggactccagcgcagcccctgagcgctcacgtcgacccctccaatcacaagaggccctcgtgccaggcccccagatttggccaatcagggaagacctttccctgtcacagaatggggtcgaggggcccaggaaacaggtagtccccagtcacaaatcatcgcgtcgccttcgctggtccctttctcttatcgagcctcagttttctcttccataagccgggccagcagtgcccaccccacaggttggcgccagctccgtaagggccctaccaccgcggccggccagatcctcggcgggccagtcctggcgctgcggtcatttagcctgatgacccctggccaggttcagcctcaattgctccaaagaactccggacccgtaccccgagcccggcgtcccagcggcgaagttgatgggccccgcaggagcccttgc

SEQ ID NO: 6955 - DNA, 184 bp, Homo sapiens
  misc_feature 1..184: note = chr3:125932252-125932436
  misc_feature 1..184: note = hyper
  source 1..184: mol_type = genomic DNA
cttttaactttttggcgtggagtgcgcgtcctgacgtgccccctgagctacagcttactgagctttactggcttcgccggacagccgtccccaggtggagagacagcgcgtcgcgcgctgcccgggccccgcagggcctggcgcctggggcccttgcgccgctttggggcgaggggatcacacc

SEQ ID NO: 6956 - DNA, 134 bp, Homo sapiens
  misc_feature 1..134: note = chr3:125986552-125986686
  misc_feature 1..134: note = hyper
  source 1..134: mol_type = genomic DNA
gctccatttaccctccgcggagggcgctgtgcggcggcacttaagcggcagcttcctctctcccaggcggcctttgtggctgtggccgggacagggaaaagctgcccaggccaagagggcgggggcgtcagggg

SEQ ID NO: 6957 - DNA, 30 bp, Homo sapiens
  misc_feature 1..30: note = chr3:126113880-126113910
  misc_feature 1..30: note = hyper
  source 1..30: mol_type = genomic DNA
gcggcggcaggggtgcgaaaccagggcccg

SEQ ID NO: 6958 - DNA, 34 bp, Homo sapiens
  misc_feature 1..34: note = chr3:126854733-126854767
  misc_feature 1..34: note = hyper
  source 1..34: mol_type = genomic DNA
cgcagcccctgcactcgggcggccctgcctcggc

SEQ ID NO: 6959 - DNA, 386 bp, Homo sapiens; identical to SEQ ID NO: 2254
  misc_feature 1..386: note = chr3:127794474-127794860
  misc_feature 1..386: note = hyper
  source 1..386: mol_type = genomic DNA

SEQ ID NO: 6960 - DNA, 60 bp, Homo sapiens
  misc_feature 1..60: note = chr3:128202417-128202477
  misc_feature 1..60: note = hyper
  source 1..60: mol_type = genomic DNA
cagaggacaggagtccggcccgtggacactcaacttcggggatcccggagcagagtgggg

SEQ ID NO: 6961 - DNA, 222 bp, Homo sapiens
  misc_feature 1..222: note = chr3:128205402-128205624
  misc_feature 1..222: note = hyper
  source 1..222: mol_type = genomic DNA
tagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcat

SEQ ID NO: 6962 - DNA, 67 bp, Homo sapiens
  misc_feature 1..67: note = chr3:128208538-128208605
  misc_feature 1..67: note = hyper
  source 1..67: mol_type = genomic DNA
tggcgttcccctcaacgcgtgcggtcccgccggggcccactgtctctccgtccgtctgtctctcaac

SEQ ID NO: 6963 - DNA, 283 bp, Homo sapiens
  misc_feature 1..283: note = chr3:128208949-128209232
  misc_feature 1..283: note = hyper
  source 1..283: mol_type = genomic DNA
taccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaacc

SEQ ID NO: 6964 - DNA, 220 bp, Homo sapiens; identical to SEQ ID NO: 2255
  misc_feature 1..220: note = chr3:128273832-128274052
  misc_feature 1..220: note = hyper
  source 1..220: mol_type = genomic DNA

SEQ ID NO: 6965 - DNA, 347 bp, Homo sapiens; identical to SEQ ID NO: 2256
  misc_feature 1..347: note = chr3:128274308-128274655
  misc_feature 1..347: note = hyper
  source 1..347: mol_type = genomic DNA

SEQ ID NO: 6966 - DNA, 236 bp, Homo sapiens
  misc_feature 1..236: note = chr3:128417201-128417437
  misc_feature 1..236: note = hyper
  source 1..236: mol_type = genomic DNA
ctaccgcagccttcccgcctgggtctcccacaggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacc

SEQ ID NO: 6967 - DNA, 184 bp, Homo sapiens; identical to SEQ ID NO: 2257
  misc_feature 1..184: note = chr3:128720163-128720347
  misc_feature 1..184: note = hyper
  source 1..184: mol_type = genomic DNA

SEQ ID NO: 6968 - DNA, 116 bp, Homo sapiens; identical to SEQ ID NO: 2258
  misc_feature 1..116: note = chr3:128720418-128720534
  misc_feature 1..116: note = hyper
  source 1..116: mol_type = genomic DNA

SEQ ID NO: 6969 - DNA, 23 bp, Homo sapiens
  misc_feature 1..23: note = chr3:128720566-128720589
  misc_feature 1..23: note = hyper
  source 1..23: mol_type = genomic DNA
cgccctggcgcaccactacgggc

SEQ ID NO: 6970 - DNA, 54 bp, Homo sapiens; identical to SEQ ID NO: 2260
  misc_feature 1..54: note = chr3:128720830-128720884
  misc_feature 1..54: note = hyper
  source 1..54: mol_type = genomic DNA

SEQ ID NO: 6971 - DNA, 430 bp, Homo sapiens; identical to SEQ ID NO: 2261
  misc_feature 1..430: note = chr3:128720885-128721315
  misc_feature 1..430: note = hyper
  source 1..430: mol_type = genomic DNA

SEQ ID NO: 6972 - DNA, 82 bp, Homo sapiens; identical to SEQ ID NO: 2262
  misc_feature 1..82: note = chr3:128764525-128764607
  misc_feature 1..82: note = hyper
  source 1..82: mol_type = genomic DNA

SEQ ID NO: 6973 - DNA, 92 bp, Homo sapiens; identical to SEQ ID NO: 311
  misc_feature 1..92: note = chr3:129693108-129693200
  misc_feature 1..92: note = hyper
  source 1..92: mol_type = genomic DNA

SEQ ID NO: 6974 - DNA, 195 bp, Homo sapiens; identical to SEQ ID NO: 312
  misc_feature 1..195: note = chr3:129693304-129693499
  misc_feature 1..195: note = hyper
  source 1..195: mol_type = genomic DNA

SEQ ID NO: 6975 - DNA, 259 bp, Homo sapiens; identical to SEQ ID NO: 313
  misc_feature 1..259: note = chr3:129693954-129694213
  misc_feature 1..259: note = hyper
  source 1..259: mol_type = genomic DNA

SEQ ID NO: 6976 - DNA, 159 bp, Homo sapiens
  misc_feature 1..159: note = chr3:130064451-130064610
  misc_feature 1..159: note = hyper
  source 1..159: mol_type = genomic DNA
agttcatttggcagccggcggcttctctgaaacaaagccagcaaacagctggagcgtctctggacactcacattaaaacttgtgaagagttaaaagccccagggaagagccaggccaagggcacgggtcagcgccggcttaaaagaccctctcagggca

SEQ ID NO: 6977 - DNA, 37 bp, Homo sapiens
  misc_feature 1..37: note = chr3:130235542-130235579
  misc_feature 1..37: note = hyper
  source 1..37: mol_type = genomic DNA
tggaccttaatctcacggtcttcgttcccacggaaaa

SEQ ID NO: 6978 - DNA, 93 bp, Homo sapiens; identical to SEQ ID NO: 2266
  misc_feature 1..93: note = chr3:130235834-130235927
  misc_feature 1..93: note = hyper
  source 1..93: mol_type = genomic DNA

SEQ ID NO: 6979 - DNA, 13 bp, Homo sapiens
  misc_feature 1..13: note = chr3:130236173-130236186
  misc_feature 1..13: note = hyper
  source 1..13: mol_type = genomic DNA
cgtccagaggaaa

SEQ ID NO: 6980 - DNA, 122 bp, Homo sapiens
  misc_feature 1..122: note = chr3:132757065-132757187
  misc_feature 1..122: note = hyper
  source 1..122: mol_type = genomic DNA
tggctggtctcaccacgtgaccggcgctgagccttccgtgcgaccggattggctgtcgcggacgctgacggacaaggccggggcgggccagagcctggtcggaggggcgcgcgcgggggccc

SEQ ID NO: 6981 - DNA, 95 bp, Homo sapiens
  misc_feature 1..95: note = chr3:132757780-132757875
  misc_feature 1..95: note = hyper
  source 1..95: mol_type = genomic DNA
ctcctgcctaggtgccggcggcctcgccggggacggagcctccgtgctgcccgggaggttgctctgccggctggacctggcggttttcaccccag

SEQ ID NO: 6982 - DNA, 81 bp, Homo sapiens
  misc_feature 1..81: note = chr3:133646291-133646372
  misc_feature 1..81: note = hyper
  source 1..81: mol_type = genomic DNA
gagaggaagttttctcgaggctgtgtcccgtgagcaggcgccggtgggctcagccgccgggccctccgagtaggggaaggc

SEQ ID NO: 6983 - DNA, 63 bp, Homo sapiens
  misc_feature 1..63: note = chr3:134125472-134125535
  misc_feature 1..63: note = hyper
  source 1..63: mol_type = genomic DNA
tccttgtttgcctctcgccaggcctaagccccgggtccccttgggtgtcgtccaggacgccag

SEQ ID NO: 6984 - DNA, 53 bp, Homo sapiens
  misc_feature 1..53: note = chr3:134370030-134370083
  misc_feature 1..53: note = hyper
  source 1..53: mol_type = genomic DNA
ttgaaaggaaatccccgggcccaagccttgacctgcaccggggccatagtcag

SEQ ID NO: 6985 - DNA, 298 bp, Homo sapiens
  misc_feature 1..298: note = chr3:134514320-134514618
  misc_feature 1..298: note = hyper
  source 1..298: mol_type = genomic DNA
gcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaaggtaacgtaccctccacggagcaagttggctgctggtgccggccgccttgggactgctgtgctccgcggttcgcggggttcctctggc

SEQ ID NO: 6986 - DNA, 151 bp, Homo sapiens
  misc_feature 1..151: note = chr3:134515381-134515532
  misc_feature 1..151: note = hyper
  source 1..151: mol_type = genomic DNA
caaagacaccgtgcccggcgcagcggggagcctgggcgctcggtagcgctcgcgaatccctgtgggaaatcccggcccagctccccgcctcccgccccttcccccgcctctgttcttcgcagcctagcagcggccgcggcagcctcctggg

SEQ ID NO: 6987 - DNA, 175 bp, Homo sapiens; identical to SEQ ID NO: 2267
  misc_feature 1..175: note = chr3:134515771-134515946
  misc_feature 1..175: note = hyper
  source 1..175: mol_type = genomic DNA

SEQ ID NO: 6988 - DNA, 112 bp, Homo sapiens
  misc_feature 1..112: note = chr3:134516192-134516304
  misc_feature 1..112: note = hyper
  source 1..112: mol_type = genomic DNA
tatatacccccaaaccgggcaggaaagccagggtgagcgcatttgcaagggcaattccagactggacttgcagcattggggtggcgtcatgcaggtccgaggctcggtccgg

SEQ ID NO: 6989 - DNA, 99 bp, Homo sapiens
  misc_feature 1..99: note = chr3:136537631-136537730
  misc_feature 1..99: note = hyper
  source 1..99: mol_type = genomic DNA
gaaggaatagacttgcgacttttaagcgcaaacaatgggtggaaatggacagaaactgcctccgtgcccacttgcagcggactacgtagccctggcaga

SEQ ID NO: 6990 - DNA, 60 bp, Homo sapiens
  misc_feature 1..60: note = chr3:136538655-136538715
  misc_feature 1..60: note = hyper
  source 1..60: mol_type = genomic DNA
tttcccaagggaagacgagggcaagggttagtggaggaagggcctcgtcacggccgagag

SEQ ID NO: 6991 - DNA, 30 bp, Homo sapiens
  misc_feature 1..30: note = chr3:137479200-137479230
  misc_feature 1..30: note = hyper
  source 1..30: mol_type = genomic DNA
gcgagctgaagcccacgctgctctcaggct

SEQ ID NO: 6992 - DNA, 165 bp, Homo sapiens; identical to SEQ ID NO: 2268
  misc_feature 1..165: note = chr3:137479522-137479687
  misc_feature 1..165: note = hyper
  source 1..165: mol_type = genomic DNA

SEQ ID NO: 6993 - DNA, 698 bp, Homo sapiens; identical to SEQ ID NO: 314
  misc_feature 1..698: note = chr3:137479943-137480641
  misc_feature 1..698: note = hyper
  source 1..698: mol_type = genomic DNA

SEQ ID NO: 6994 - DNA, 145 bp, Homo sapiens; identical to SEQ ID NO: 315
  misc_feature 1..145: note = chr3:137481170-137481315
  misc_feature 1..145: note = hyper
  source 1..145: mol_type = genomic DNA

SEQ ID NO: 6995 - DNA, 30 bp, Homo sapiens
  misc_feature 1..30: note = chr3:137483930-137483960
  misc_feature 1..30: note = hyper
  source 1..30: mol_type = genomic DNA
cggacccgctcaaggcggctggcctgcccg

SEQ ID NO: 6996 - DNA, 283 bp, Homo sapiens; identical to SEQ ID NO: 2271
  misc_feature 1..283: note = chr3:137484405-137484688
  misc_feature 1..283: note = hyper
  source 1..283: mol_type = genomic DNA

SEQ ID NO: 6997 - DNA, 54 bp, Homo sapiens
  misc_feature 1..54: note = chr3:137485531-137485585
  misc_feature 1..54: note = hyper
  source 1..54: mol_type = genomic DNA
ttttaaaaaaccaaacgctgaaggagcagggagaagcaccgagtctcctgggaa

SEQ ID NO: 6998 - DNA, 373 bp, Homo sapiens
  misc_feature 1..373: note = chr3:137485937-137486310
  misc_feature 1..373: note = hyper
  source 1..373: mol_type = genomic DNA
cttttctttcccctccgggtgaatgttttcttgaagattattgtctttcctgagaaaggaccctccgatgttatccagcaaaactctttggaatttgttctcaaaatcgaagggtgctttccacccttggtcttggagtctcaccccaaaagccgcgctcacgcgtggttttccttaatttgcgtgcttttcccactggctttgatatgctgtggggtgggaggtggggcagcctagaggtttgtgggctttctgctgctgttgagagatttgtacgcttgcctccgctgtttccaaaggagtcggtggctcgaagtgcacgggaaacgttgtcaacagacaccaaagccgaaacccgcggattagcatattg

SEQ ID NO: 6999 - DNA, 16 bp, Homo sapiens
  misc_feature 1..16: note = chr3:137487065-137487081
  misc_feature 1..16: note = hyper
  source 1..16: mol_type = genomic DNA
gaggggcaaaggcctc

SEQ ID NO: 7000 - DNA, 17 bp, Homo sapiens
  misc_feature 1..17: note = chr3:137487082-137487099
  misc_feature 1..17: note = hyper
  source 1..17: mol_type = genomic DNA
gacggtggctgaagctg

SEQ ID NO: 7001 - DNA, 15 bp, Homo sapiens
  misc_feature 1..15: note = chr3:137487989-137488004
  misc_feature 1..15: note = hyper
  source 1..15: mol_type = genomic DNA
gacccaaatacatgc

SEQ ID NO: 7002 - DNA, 75 bp, Homo sapiens
  misc_feature 1..75: note = chr3:137488337-137488412
  misc_feature 1..75: note = hyper
  source 1..75: mol_type = genomic DNA
taatttccttaggcccgatgactttaaagacggaaaagaccagctactttgagtaaattacgctgaggtgtgagt

SEQ ID NO: 7003 - DNA, 519 bp, Homo sapiens; identical to SEQ ID NO: 316
  misc_feature 1..519: note = chr3:137488807-137489326
  misc_feature 1..519: note = hyper
  source 1..519: mol_type = genomic DNA

SEQ ID NO: 7004 - DNA, 15 bp, Homo sapiens
  misc_feature 1..15: note = chr3:137489684-137489699
  misc_feature 1..15: note = hyper
  source 1..15: mol_type = genomic DNA
agagaaagacctgac

SEQ ID NO: 7005 - DNA, 1135 bp, Homo sapiens; identical to SEQ ID NO: 318
  misc_feature 1..1135: note = chr3:137489875-137491010
  misc_feature 1..1135: note = hyper
  source 1..1135: mol_type = genomic DNA

SEQ ID NO: 7006 - DNA, 167 bp, Homo sapiens
  misc_feature 1..167: note = chr3:138154014-138154181
  misc_feature 1..167: note = hyper
  source 1..167: mol_type = genomic DNA
gttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtc

SEQ ID NO: 7007 - DNA, 46 bp, Homo sapiens
  misc_feature 1..46: note = chr3:138656843-138656889
  misc_feature 1..46: note = hyper
  source 1..46: mol_type = genomic DNA
gacccccgatcctgccggtgaggggagggagcgagaaggagtgcgc

SEQ ID NO: 7008 - DNA, 171 bp, Homo sapiens; identical to SEQ ID NO: 2275
  misc_feature 1..171: note = chr3:138657617-138657788
  misc_feature 1..171: note = hyper
  source 1..171: mol_type = genomic DNA

SEQ ID NO: 7009 - DNA, 161 bp, Homo sapiens; identical to SEQ ID NO: 319
  misc_feature 1..161: note = chr3:138658703-138658864
  misc_feature 1..161: note = hyper
  source 1..161: mol_type = genomic DNA

SEQ ID NO: 7010 - DNA, 93 bp, Homo sapiens; identical to SEQ ID NO: 2277
  misc_feature 1..93: note = chr3:138662087-138662180
  misc_feature 1..93: note = hyper
  source 1..93: mol_type = genomic DNA

SEQ ID NO: 7011 - DNA, 167 bp, Homo sapiens; identical to SEQ ID NO: 2278
  misc_feature 1..167: note = chr3:138662281-138662448
  misc_feature 1..167: note = hyper
  source 1..167: mol_type = genomic DNA

SEQ ID NO: 7012 - DNA, 42 bp, Homo sapiens; identical to SEQ ID NO: 2279
  misc_feature 1..42: note = chr3:138664141-138664183
  misc_feature 1..42: note = hyper
  source 1..42: mol_type = genomic DNA

SEQ ID NO: 7013 - DNA, 303 bp, Homo sapiens; identical to SEQ ID NO: 2280
  misc_feature 1..303: note = chr3:138664928-138665231
  misc_feature 1..303: note = hyper
  source 1..303: mol_type = genomic DNA

SEQ ID NO: 7014 - DNA, 668 bp, Homo sapiens; identical to SEQ ID NO: 320
  misc_feature 1..668: note = chr3:138665557-138666225
  misc_feature 1..668: note = hyper
  source 1..668: mol_type = genomic DNA

SEQ ID NO: 7015 - DNA, 352 bp, Homo sapiens; identical to SEQ ID NO: 2282
  misc_feature 1..352: note = chr3:138668757-138669109
  misc_feature 1..352: note = hyper
  source 1..352: mol_type = genomic DNA

SEQ ID NO: 7016 - DNA, 196 bp, Homo sapiens; identical to SEQ ID NO: 2283
  misc_feature 1..196: note = chr3:138669140-138669336
  misc_feature 1..196: note = hyper
  source 1..196: mol_type = genomic DNA

SEQ ID NO: 7017 - DNA, 105 bp, Homo sapiens; identical to SEQ ID NO: 321
  misc_feature 1..105: note = chr3:138679188-138679293
  misc_feature 1..105: note = hyper
  source 1..105: mol_type = genomic DNA

SEQ ID NO: 7018 - DNA, 104 bp, Homo sapiens
  misc_feature 1..104: note = chr3:139258212-139258316
  misc_feature 1..104: note = hyper
  source 1..104: mol_type = genomic DNA
gaggcaggcaggcagcgtctcgggagggctctagggagcggcccggagctgctcggcggggcgcccagggcgcagcgggcagcgcttaccgagggcgcgcaggt

SEQ ID NO: 7019 - DNA, 308 bp, Homo sapiens
  misc_feature 1..308: note = chr3:139396463-139396771
  misc_feature 1..308: note = hyper
  source 1..308: mol_type = genomic DNA
aggggccaggagtcacgtgggcccgggcattcagccgcgatccaggtcctagtgggctgacgaggggcccacgctgcgcttacctgctatttgcagggctcagcaacggcgctcggcgagtctcgggggactgcgggggactaggggacctgctgggcctagcaggggctgtcggtcagcgcgcggcccggcgcccgaggtccgagagggaaacgacgtttggtctcgggactcaaggctgcctccggcccgggcagcctcaggtctagatcccctagtacctgagctggaggcggggccaaggcgaa

SEQ ID NO: 7020 - DNA, 82 bp, Homo sapiens; identical to SEQ ID NO: 322
  misc_feature 1..82: note = chr3:139653491-139653573
  misc_feature 1..82: note = hyper
  source 1..82: mol_type = genomic DNA

SEQ ID NO: 7021 - DNA, 298 bp, Homo sapiens; identical to SEQ ID NO: 323
  misc_feature 1..298: note = chr3:139653574-139653872
  misc_feature 1..298: note = hyper
  source 1..298: mol_type = genomic DNA

SEQ ID NO: 7022 - DNA, 682 bp, Homo sapiens; identical to SEQ ID NO: 324
  misc_feature 1..682: note = chr3:139653873-139654555
  misc_feature 1..682: note = hyper
  source 1..682: mol_type = genomic DNA

SEQ ID NO: 7023 - DNA, 273 bp, Homo sapiens
  misc_feature 1..273: note = chr3:139654788-139655061
  misc_feature 1..273: note = hyper
  source 1..273: mol_type = genomic DNA
ctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtca

SEQ ID NO: 7024 - DNA, 674 bp, Homo sapiens; identical to SEQ ID NO: 325
  misc_feature 1..674: note = chr3:140769628-140770302
  misc_feature 1..674: note = hyper
  source 1..674: mol_type = genomic DNA

SEQ ID NO: 7025 - DNA, 183 bp, Homo sapiens; identical to SEQ ID NO: 326
  misc_feature 1..183: note = chr3:140770407-140770590
  misc_feature 1..183: note = hyper
  source 1..183: mol_type = genomic DNA

SEQ ID NO: 7026 - DNA, 40 bp, Homo sapiens; identical to SEQ ID NO: 327
  misc_feature 1..40: note = chr3:140770643-140770683
  misc_feature 1..40: note = hyper
  source 1..40: mol_type = genomic DNA

SEQ ID NO: 7027 - DNA, 356 bp, Homo sapiens; identical to SEQ ID NO: 328
  misc_feature 1..356: note = chr3:140770684-140771040
  misc_feature 1..356: note = hyper
  source 1..356: mol_type = genomic DNA

SEQ ID NO: 7028 - DNA, 48 bp, Homo sapiens
  misc_feature 1..48: note = chr3:140771752-140771800
  misc_feature 1..48: note = hyper
  source 1..48: mol_type = genomic DNA
gggagtggctgctcccgccggcccatggccaagcgcagacggctgccg

SEQ ID NO: 7029 - DNA, 93 bp, Homo sapiens
  misc_feature 1..93: note = chr3:141516089-141516182
  misc_feature 1..93: note = hyper
  source 1..93: mol_type = genomic DNA
agtggcggcagaaagcgagccctgagaagccaggggcaggagcggcctccgcgcgacactgcggcgctcctgattctgcggcctggggccgag

SEQ ID NO: 7030 - DNA, 355 bp, Homo sapiens; identical to SEQ ID NO: 329
  misc_feature 1..355: note = chr3:141516389-141516744
  misc_feature 1..355: note = hyper
  source 1..355: mol_type = genomic DNA

SEQ ID NO: 7031 - DNA, 192 bp, Homo sapiens
  misc_feature 1..192: note = chr3:142443659-142443851
  misc_feature 1..192: note = hyper
  source 1..192: mol_type = genomic DNA
tccctctgtctcaggcgccgagtgtcttcccgcctcgcctgctgcctcaggcggtcttctcctcaccgcctctgccctgtgagtgtggagctggcgggagagtggagctggggctgcgccctcggagcgctgcaccgtcgggggtggctctggccttggggtccggggtttaggtagcgccttgggagcccc

SEQ ID NO: 7032 - DNA, 41 bp, Homo sapiens
  misc_feature 1..41: note = chr3:142607792-142607833
  misc_feature 1..41: note = hyper
  source 1..41: mol_type = genomic DNA
cccctccgcacccaccgcgctcacaccgccgctcacactgg

SEQ ID NO: 7033 - DNA, 60 bp, Homo sapiens
  misc_feature 1..60: note = chr3:142681935-142681995
  misc_feature 1..60: note = hyper
  source 1..60: mol_type = genomic DNA
ggtaggcttcagcaccgaggctaggcactcctgggccgtgcacggcagacgccggtagcc

SEQ ID NO: 7034 - DNA, 1001 bp, Homo sapiens
  misc_feature 1..1001: note = chr3:142682049-142683050
  misc_feature 1..1001: note = hyper
  source 1..1001: mol_type = genomic DNA
cggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctc

SEQ ID NO: 7035 - DNA, 34 bp, Homo sapiens
  misc_feature 1..34: note = chr3:142683110-142683144
  misc_feature 1..34: note = hyper
  source 1..34: mol_type = genomic DNA
ggcctgtctacgcactacacgaaggcttagttgg

SEQ ID NO: 7036 - DNA, 207 bp, Homo sapiens; identical to SEQ ID NO: 2293
  misc_feature 1..207: note = chr3:142838112-142838319
  misc_feature 1..207: note = hyper
  source 1..207: mol_type = genomic DNA

SEQ ID NO: 7037 - DNA, 168 bp, Homo sapiens; identical to SEQ ID NO: 2294
  misc_feature 1..168: note = chr3:142838479-142838647
  misc_feature 1..168: note = hyper
  source 1..168: mol_type = genomic DNA

SEQ ID NO: 7038 - DNA, 160 bp, Homo sapiens; identical to SEQ ID NO: 2295
  misc_feature 1..160: note = chr3:142838876-142839036
  misc_feature 1..160: note = hyper
  source 1..160: mol_type = genomic DNA

SEQ ID NO: 7039 - DNA, 86 bp, Homo sapiens; identical to SEQ ID NO: 2296
  misc_feature 1..86: note = chr3:142839440-142839526
  misc_feature 1..86: note = hyper
  source 1..86: mol_type = genomic DNA

SEQ ID NO: 7040 - DNA, 16 bp, Homo sapiens
  misc_feature 1..16: note = chr3:142839562-142839578
  misc_feature 1..16: note = hyper
  source 1..16: mol_type = genomic DNA
cggcccgagtcccggc

SEQ ID NO: 7041 - DNA, 110 bp, Homo sapiens; identical to SEQ ID NO: 2298
  misc_feature 1..110: note = chr3:142839579-142839689
  misc_feature 1..110: note = hyper
  source 1..110: mol_type = genomic DNA

SEQ ID NO: 7042 - DNA, 119 bp, Homo sapiens; identical to SEQ ID NO: 2299
  misc_feature 1..119: note = chr3:142839783-142839902
  misc_feature 1..119: note = hyper
  source 1..119: mol_type = genomic DNA

SEQ ID NO: 7043 - DNA, 47 bp, Homo sapiens; identical to SEQ ID NO: 2300
  misc_feature 1..47: note = chr3:142839944-142839991
  misc_feature 1..47: note = hyper
  source 1..47: mol_type = genomic DNA

SEQ ID NO: 7044 - DNA, 136 bp, Homo sapiens; identical to SEQ ID NO: 2301
  misc_feature 1..136: note = chr3:142839992-142840128
  misc_feature 1..136: note = hyper
  source 1..136: mol_type = genomic DNA

SEQ ID NO: 7045 - DNA, 33 bp, Homo sapiens; identical to SEQ ID NO: 2302
  misc_feature 1..33: note = chr3:142840221-142840254
  misc_feature 1..33: note = hyper
  source 1..33: mol_type = genomic DNA

SEQ ID NO: 7046 - DNA, 33 bp, Homo sapiens
  misc_feature 1..33: note = chr3:145878520-145878553
  misc_feature 1..33: note = hyper
  source 1..33: mol_type = genomic DNA
ttctggggaagaccccggcggtcctggagagga

SEQ ID NO: 7047 - DNA, 30 bp, Homo sapiens
  misc_feature 1..30: note = chr3:147072640-147072670
  misc_feature 1..30: note = hyper
  source 1..30: mol_type = genomic DNA
gccgggcgggccggccgctcacaatggagc

SEQ ID NO: 7048 - DNA, 32 bp, Homo sapiens
  misc_feature 1..32: note = chr3:147074974-147075006
  misc_feature 1..32: note = hyper
  source 1..32: mol_type = genomic DNA
gattgggctgtctggcgcggcttccaattcca

SEQ ID NO: 7049 - DNA, 229 bp, Homo sapiens; identical to SEQ ID NO: 330
  misc_feature 1..229: note = chr3:147078959-147079188
  misc_feature 1..229: note = hyper
  source 1..229: mol_type = genomic DNA

SEQ ID NO: 7050 - DNA, 197 bp, Homo sapiens
  misc_feature 1..197: note = chr3:147087395-147087592
  misc_feature 1..197: note = hyper
  source 1..197: mol_type = genomic DNA
tcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaaccccagagtcgcagctgtgcgcatccacaggcaa

SEQ ID NO: 7051 - DNA, 56 bp, Homo sapiens
  misc_feature 1..56: note = chr3:147088467-147088523
  misc_feature 1..56: note = hyper
  source 1..56: mol_type = genomic DNA
acaaaagcggatctgcggcgttatgaaaaatggcctgggcgcggagaatgtcacag

SEQ ID NO: 7052 - DNA, 37 bp, Homo sapiens
  misc_feature 1..37: note = chr3:147088973-147089010
  misc_feature 1..37: note = hyper
  source 1..37: mol_type = genomic DNA
agcgaacgcctgaggcggtaggcgggttcattgcagg

SEQ ID NO: 7053 - DNA, 36 bp, Homo sapiens
  misc_feature 1..36: note = chr3:147090647-147090683
  misc_feature 1..36: note = hyper
  source 1..36: mol_type = genomic DNA
ggcgactgaggatcccgccagcgcacccagcctact

SEQ ID NO: 7054 - DNA, 49 bp, Homo sapiens
  misc_feature 1..49: note = chr3:147096028-147096077
  misc_feature 1..49: note = hyper
  source 1..49: mol_type = genomic DNA
aggagtccctgaccccgtgccttggctggagcgccgtttccctggacga

SEQ ID NO: 7055 - DNA, 49 bp, Homo sapiens
  misc_feature 1..49: note = chr3:147098421-147098470
  misc_feature 1..49: note = hyper
  source 1..49: mol_type = genomic DNA
ttcagactgcaggtgcgaagtgggccggcgcgcccgaccacattatgtc

SEQ ID NO: 7056 - DNA, 30 bp, Homo sapiens
  misc_feature 1..30: note = chr3:147105883-147105913
  misc_feature 1..30: note = hyper
  source 1..30: mol_type = genomic DNA
taaacgtgggcaagtcgggttctagaaagg

SEQ ID NO: 7057 - DNA, 90 bp, Homo sapiens; identical to SEQ ID NO: 2304
  misc_feature 1..90: note = chr3:147108806-147108896
  misc_feature 1..90: note = hyper
  source 1..90: mol_type = genomic DNA

SEQ ID NO: 7058 - DNA, 387 bp, Homo sapiens; identical to SEQ ID NO: 2305
  misc_feature 1..387: note = chr3:147109225-147109612
  misc_feature 1..387: note = hyper
  source 1..387: mol_type = genomic DNA

SEQ ID NO: 7059 - DNA, 497 bp, Homo sapiens; identical to SEQ ID NO: 331
  misc_feature 1..497: note = chr3:147110228-147110725
  misc_feature 1..497: note = hyper
  source 1..497: mol_type = genomic DNA

SEQ ID NO: 7060 - DNA, 84 bp, Homo sapiens
  misc_feature 1..84: note = chr3:147111050-147111134
  misc_feature 1..84: note = hyper
  source 1..84: mol_type = genomic DNA
agtgataccggcagccgggaagttcgcaggcccctaggaggccaggtgaggccgcgccccagcttgctccggagctgcaggagg

SEQ ID NO: 7061 - DNA, 122 bp, Homo sapiens
  misc_feature 1..122: note = chr3:147111988-147112110
  misc_feature 1..122: note = hyper
  source 1..122: mol_type = genomic DNA
ccagactctgtagttcgttgttggtcgtgtttgtttgtttgtttgtttttgtttgttgtttcccccaccccccaccgctaatgaatcaggaccgcgaaccgaaagaacgcacaaaattctgt

SEQ ID NO: 7062 - DNA, 39 bp, Homo sapiens
  misc_feature 1..39: note = chr3:147114179-147114218
  misc_feature 1..39: note = hyper
  source 1..39: mol_type = genomic DNA
ctcctcgtggaggcccgggaacaccgaggggctggaggc

SEQ ID NO: 7063 - DNA, 75 bp, Homo sapiens
  misc_feature 1..75: note = chr3:147126992-147127067
  misc_feature 1..75: note = hyper
  source 1..75: mol_type = genomic DNA
cgggccaatgagctgcgcgcggcgcctcggcgcgccctccgttggcgcggcggctgagggcggggggaatgcggg

SEQ ID NO: 7064 - DNA, 62 bp, Homo sapiens
  misc_feature 1..62: note = chr3:147127850-147127912
  misc_feature 1..62: note = hyper
  source 1..62: mol_type = genomic DNA
cgagggtggggggggcgggggaggccggggctcgccccgagcagccacgatgctcctggacg

SEQ ID NO: 7065 - DNA, 101 bp, Homo sapiens
  misc_feature 1..101: note = chr3:147136900-147137001
  misc_feature 1..101: note = hyper
  source 1..101: mol_type = genomic DNA
caccgaaggctgggtcgtcagcgtttgagggaccctcccgccaccccgcagcctggcggggcgctttccaaatcgtcgcggcaggctctggccgggcaggg

SEQ ID NO: 7066 - DNA, 89 bp, Homo sapiens
  misc_feature 1..89: note = chr3:147137075-147137164
  misc_feature 1..89: note = hyper
  source 1..89: mol_type = genomic DNA
cgcgggctagagagagaaccaagcagaggctccggcctgtgaaagtcgctggctaggctcccaaaatagtgcggcggggtagctgcacg

SEQ ID NO: 7067 - DNA, 231 bp, Homo sapiens; identical to SEQ ID NO: 2307
  misc_feature 1..231: note = chr3:147138768-147138999
  misc_feature 1..231: note = hyper
  source 1..231: mol_type = genomic DNA

SEQ ID NO: 7068 - DNA, 30 bp, Homo sapiens
  misc_feature 1..30: note = chr3:147139541-147139571
  misc_feature 1..30: note = hyper
  source 1..30: mol_type = genomic DNA
ggctccccagtgaggcgggagcgaaaagag

SEQ ID NO: 7069 - DNA, 480 bp, Homo sapiens
  misc_feature 1..480: note = chr3:148415340-148415820
  misc_feature 1..480: note = hyper
  source 1..480: mol_type = genomic DNA
agaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtg

SEQ ID NO: 7070 - DNA, 30 bp, Homo sapiens
  misc_feature 1..30: note = chr3:148416021-148416051
  misc_feature 1..30: note = hyper
  source 1..30: mol_type = genomic DNA
ggaccaaggaaagagcgaccgtagttctgg

SEQ ID NO: 7071 - DNA, 155 bp, Homo sapiens
  misc_feature 1..155: note = chr3:149375236-149375391
  misc_feature 1..155: note = hyper
  source 1..155: mol_type = genomic DNA
atcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaac

SEQ ID NO: 7072 - DNA, 65 bp, Homo sapiens
  misc_feature 1..65: note = chr3:150802935-150803000
  misc_feature 1..65: note = hyper
  source 1..65: mol_type = genomic DNA
atcaagatcctggcacgtagcgaaggctccataaatggcagccatcattcttggccaagtgcggg

SEQ ID NO: 7073 - DNA, 573 bp, Homo sapiens
  misc_feature 1..573: note = chr3:150803025-150803598
  misc_feature 1..573: note = hyper
  source 1..573: mol_type = genomic DNA
cggggtccctcaggacaggccgagcccgcctccgcggctccggtctcgcagagctcgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccggg

SEQ ID NO: 7074 - DNA, 64 bp, Homo sapiens
  misc_feature 1..64: note = chr3:150803966-150804030
  misc_feature 1..64: note = hyper
  source 1..64: mol_type = genomic DNA
agccgccgaggggaccgtagctgcggatgcgccactggaacctggcgggcgtctaggaggcacc

SEQ ID NO: 7075 - DNA, 161 bp, Homo sapiens
  misc_feature 1..161: note = chr3:150804735-150804896
  misc_feature 1..161: note = hyper
  source 1..161: mol_type = genomic DNA
gctatgagcagagaccgctgaagcgcccccggctcgggccgcccgacgtctacccacaggaccccaagcagaaggaggtaagggcgccggcggcctccccggcaaccggggccgcgctctgcagcactgacccggggccaagttggcccagcgggcatcgc

SEQ ID NO: 7076 - DNA, 98 bp, Homo sapiens
  misc_feature 1..98: note = chr3:150804936-150805034
  misc_feature 1..98: note = hyper
  source 1..98: mol_type = genomic DNA
cgggggccaggctgggggtgctgggcgaccccccggcggcggagaccgagcggctgtcagtccccgcgctccactggggcgctcgctttccatgtgcc

SEQ ID NO: 7077 - DNA, 211 bp, Homo sapiens
  misc_feature 1..211: note = chr3:152553275-152553486
  misc_feature 1..211: note = hyper
  source 1..211: mol_type = genomic DNA
cggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggctttt

SEQ ID NO: 7078 - DNA, 226 bp, Homo sapiens; identical to SEQ ID NO: 2308
  misc_feature 1..226: note = chr3:153839727-153839953
  misc_feature 1..226: note = hyper
  source 1..226: mol_type = genomic DNA

SEQ ID NO: 7079 - DNA, 30 bp, Homo sapiens
  misc_feature 1..30: note = chr3:154146133-154146163
  misc_feature 1..30: note = hyper
  source 1..30: mol_type = genomic DNA
atccttggccaccaccgatatggaaaacta

SEQ ID NO: 7080 - DNA, 364 bp, Homo sapiens
  misc_feature 1..364: note = chr3:154146601-154146965
  misc_feature 1..364: note = hyper
  source 1..364: mol_type = genomic DNA
gagcatcccccagagcgccgcagactcgggcctggagcatcctctggggacagggaaaccactctccccgcagtaggaggggtcccaggaattgaagctccacgggaaatttcctggtagttggagtggagtctcggcggctcctccgaacacagcaatcggtgagtgagtgggactgagaggcccacgaggagtccgaaggccaaagcgtacacgatagagaggaatagtacgtaggagctggagcagtccaccaggcagccccagggcgtgcgcacgaaggcgccccagccgcacagcgggagcgccgagagcagcagactggctgcccacacggtcagcaccacgccgagcacctggcccg

SEQ ID NO: 7081 - DNA, 306 bp, Homo sapiens
  misc_feature 1..306: note = chr3:154797472-154797778
  misc_feature 1..306: note = hyper
  source 1..306: mol_type = genomic DNA
gtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcc

SEQ ID NO: 7082 - DNA, 184 bp, Homo sapiens
  misc_feature 1..184: note = chr3:154797835-154798019
  misc_feature 1..184: note = hyper
  source 1..184: mol_type = genomic DNA
cgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctg

SEQ ID NO: 7083 - DNA, 236 bp, Homo sapiens; identical to SEQ ID NO: 332
  misc_feature 1..236: note = chr3:156009064-156009300
  misc_feature 1..236: note = hyper
  source 1..236: mol_type = genomic DNA

SEQ ID NO: 7084 - DNA, 265 bp, Homo sapiens; identical to SEQ ID NO: 333
  misc_feature 1..265: note = chr3:156009318-156009583
  misc_feature 1..265: note = hyper
  source 1..265: mol_type = genomic DNA

SEQ ID NO: 7085 - DNA, 30 bp, Homo sapiens
  misc_feature 1..30: note = chr3:156009875-156009905
  misc_feature 1..30: note = hyper
  source 1..30: mol_type = genomic DNA
tctcaaagagtccaccgcaaagcagactgg

SEQ ID NO: 7086 - DNA, 30 bp, Homo sapiens
  misc_feature 1..30: note = chr3:157155252-157155282
  misc_feature 1..30: note = hyper
  source 1..30: mol_type = genomic DNA
caaggcaggcctgggcgggctgctaacgtg

SEQ ID NO: 7087 - DNA, 30 bp, Homo sapiens
  misc_feature 1..30: note = chr3:157156090-157156120
  misc_feature 1..30: note = hyper
  source 1..30: mol_type = genomic DNA
cgttagggatttccacgtcttctaatttta

SEQ ID NO: 7088 - DNA, 32 bp, Homo sapiens
  misc_feature 1..32: note = chr3:157261124-157261156
  misc_feature 1..32: note = hyper
  source 1..32: mol_type = genomic DNA
acccggtccccgccccgcgtgctcaggctgaa

SEQ ID NO: 7089 - DNA, 101 bp, Homo sapiens; identical to SEQ ID NO: 2311
  misc_feature 1..101: note = chr3:157812157-157812258
  misc_feature 1..101: note = hyper
  source 1..101: mol_type = genomic DNA

SEQ ID NO: 7090 - DNA, 209 bp, Homo sapiens; identical to SEQ ID NO: 2312
  misc_feature 1..209: note = chr3:157812436-157812645
  misc_feature 1..209: note = hyper
  source 1..209: mol_type = genomic DNA

SEQ ID NO: 7091 - DNA, 60 bp, Homo sapiens; identical to SEQ ID NO: 2313
  misc_feature 1..60: note = chr3:157812973-157813033
  misc_feature 1..60: note = hyper
  source 1..60: mol_type = genomic DNA

SEQ ID NO: 7092 - skipped

SEQ ID NO: 7093 - DNA, 126 bp, Homo sapiens; identical to SEQ ID NO: 2315
  misc_feature 1..126: note = chr3:157821536-157821662
  misc_feature 1..126: note = hyper
  source 1..126: mol_type = genomic DNA

SEQ ID NO: 7094 - DNA, 47 bp, Homo sapiens
  misc_feature 1..47: note = chr3:157823073-157823120
  misc_feature 1..47: note = hyper
  source 1..47: mol_type = genomic DNA
ggctagctttagtcccgccgtctggttcagcaccccctcctgcagcc

SEQ ID NO: 7095 - DNA, 239 bp, Homo sapiens
  misc_feature 1..239: note = chr3:157823138-157823377
  misc_feature 1..239: note = hyper
  source 1..239: mol_type = genomic DNA
cgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccc

SEQ ID NO: 7096 - DNA, 106 bp, Homo sapiens
  misc_feature 1..106: note = chr3:157823732-157823838
  misc_feature 1..106: note = hyper
  source 1..106: mol_type = genomic DNA
ctcccggtacgtgatcgcctccttcttctccttcactttctggtcaaaagacttggagacgaacgccgtaagttcttccatcgccgccgcacgtcagcccggcgct

SEQ ID NO: 7097 - DNA, 211 bp, Homo sapiens
  misc_feature 1..211: note = chr3:157824698-157824909
  misc_feature 1..211: note = hyper
  source 1..211: mol_type = genomic DNA
gtcagtcaggtatcccgacactgcatccttccctacagccttgcttcgagtcagggtgcctcgcaatgctcagcttcgcattgcttttcctcgtccctgccctgcatcaaccgcccagcagtttacaggccccgcatcccattcccgcatcctgaccccgcatcccaattctgcatccccgcctctccctcacaatcccacccctgccggc

SEQ ID NO: 7098 - DNA, 59 bp, Homo sapiens; identical to SEQ ID NO: 2316
  misc_feature 1..59: note = chr3:157825176-157825235
  misc_feature 1..59: note = hyper
  source 1..59: mol_type = genomic DNA

SEQ ID NO: 7099 - DNA, 92 bp, Homo sapiens
  misc_feature 1..92: note = chr3:158288920-158289012
  misc_feature 1..92: note = hyper
  source 1..92: mol_type = genomic DNA
aatgggaaagcagctcggtgtcacgcacctcctatcccggcgggcaccgcctgcgccgcggcgagtgaggcgtcgtccgtactggaggctag

SEQ ID NO: 7100 - DNA, 169 bp, Homo sapiens
  misc_feature 1..169: note = chr3:159756687-159756856
  misc_feature 1..169: note = hyper
  source 1..169: mol_type = genomic DNA
tgcgcttacctgctccgcacgacctctgcggcttgggggctctcagctctgtcgctgcggggctccaggctggtgcttgtgctgagaatgactgcgggaggggctcgcgtgcccagcactgcaccgcgaggcgaccaaccgctgacatgtggggcgattgggtggacag

SEQ ID NO: 7101 - DNA, 109 bp, Homo sapiens
  misc_feature 1..109: note = chr3:159944437-159944546
  misc_feature 1..109: note = hyper
  source 1..109: mol_type = genomic DNA
ccctctgccttgcctcgtattgtggttcactagtaagtgcctgcttccctagtcaaagagaacacgtgagccctttggtgcgtcgagagaagggcggtcttctttaggg

SEQ ID NO: 7102 - DNA, 60 bp, Homo sapiens
  misc_feature 1..60: note = chr3:160822815-160822875
  misc_feature 1..60: note = hyper
  source 1..60: mol_type = genomic DNA
gagacccgagacccacggtgcggcggctcaacctgggccacgctccgctctagaggagtg

SEQ ID NO: 7103 - DNA, 30 bp, Homo sapiens
  misc_feature 1..30: note = chr3:164912404-164912434
  misc_feature 1..30: note = hyper
  source 1..30: mol_type = genomic DNA
ctcccccccatcccccgcccagcactttgg

SEQ ID NO: 7104 - DNA, 572 bp, Homo sapiens
  misc_feature 1..572: note = chr3:164913300-164913872
  misc_feature 1..572: note = hyper
  source 1..572: mol_type = genomic DNA
tgcacatcctacatacgagaaatactggtttcaattaggcgaagtaggaaaggatggcggcgagtacctatggtgcagagcgctcaggatctccgaggtttgctgcgaggggctacccagcaggaggggcaaactctctgcgaagctgaattgtatccatcatactgtagccttgtagcttctcctcttctggccaccaactttccgaaaggctaccgaatcacgcttgtaatccgtttaaatgtttccacctttgagacttgcagggaaatggtcgctgcataccaatgggagagcggggcgcgcacctagcgcggcgatgccagcgacagggagctcacgaccacagctccctatgccctcgatggttggtaggcaggcaggcagagtgagtgtcccaggactaggttcctttgatttaaaatctcggtgctctggatcagtggagagcttcgttgttcccgagagcctgagctcagtctctggatttctctctttctctcttcctcaaaggttgtcactcacagcgcaatccctgcccgaggcctccttccatccgagaagatggaatt

SEQ ID NO: 7105 - DNA, 34 bp, Homo sapiens
  misc_feature 1..34: note = chr3:164914188-164914222
  misc_feature 1..34: note = hyper
  source 1..34: mol_type = genomic DNA
agcaccctcacttctcgagcgggagaaggtgcgg

SEQ ID NO: 7106 - DNA, 188 bp, Homo sapiens
  misc_feature 1..188: note = chr3:164915057-164915245
  misc_feature 1..188: note = hyper
  source 1..188: mol_type = genomic DNA
atgatacatgggtgacgatttgaaagtacacatatttcctcatctgtttacatttgccgggggcggggggcataaaactgtagggcacagggagttgggaggggggcatttgcctgagagatgctggataccatttcgcgataaattagatacggacactggaacaattaatacgtgtaataacacgt

SEQ ID NO: 7107 - DNA, 30 bp, Homo sapiens
  misc_feature 1..30: note = chr3:167097947-167097977
  misc_feature 1..30: note = hyper
  source 1..30: mol_type = genomic DNA
ccgcaccaactagcccgggcttgctgcccg

SEQ ID NO: 7108 - DNA, 328 bp, Homo sapiens
  misc_feature 1..328: note = chr3:167968002-167968330
  misc_feature 1..328: note = hyper
  source 1..328: mol_type = genomic DNA
ctagtccttggggagcgccagcccgggagcggagaccgcgaccggggcgggtgtgctctccacccggtacttcctcagcgcctgacagatttttgtcccccgcccccaggtttgggtgtgtgcgcgcgtggtatgtgtgtgttttcgttatttttctgttttaagagtaattggctaatgactaccactttgtgacagggttgtgaatgaaatcctgtcgaacaccgagtttgacatttttttctttgtagagaccaatgagttcgtgcacatgtattctttctttttttgggggaagtatcgccgagtcggacggagtggtttattc

SEQ ID NO: 7109 - DNA, 42 bp, Homo sapiens
  misc_feature 1..42: note = chr3:169376701-169376743
  misc_feature 1..42: note = hyper
  source 1..42: mol_type = genomic DNA
cttgtccttctagcccggggaggagggcgtccccccttcctg

SEQ ID NO: 7110 - DNA, 30 bp, Homo sapiens
  misc_feature 1..30: note = chr3:169530363-169530393
  misc_feature 1..30: note = hyper
  source 1..30: mol_type = genomic DNA
cctgcagctgtgaggcggctacacgagcct

SEQ ID NO: 7111 - DNA, 107 bp, Homo sapiens
  misc_feature 1..107: note = chr3:170136940-170137047
  misc_feature 1..107: note = hyper
  source 1..107: mol_type = genomic DNA
ctgggtggtgacctgcggctacaccatccccacctgccgcaagctggatgagctgggctccaaggggctgtgggccgactgcgtcatggccacggggctgtaccact

SEQ ID NO: 7112 - DNA, 64 bp, Homo sapiens
  misc_feature 1..64: note = chr3:170302590-170302654
  misc_feature 1..64: note = hyper
  source 1..64: mol_type = genomic DNA
cagggtgacatcctgcggcccttgggcaattcgggccagtgacgttcaccgacactcaggcggg

SEQ ID NO: 7113 - DNA, 53 bp, Homo sapiens
  misc_feature 1..53: note = chr3:170303035-170303088
  misc_feature 1..53: note = hyper
  source 1..53: mol_type = genomic DNA
cctggacaccgctcccgtcacgtcctcttcgccgctcccgggagagtcaccac

SEQ ID NO: 7114 - DNA, 44 bp, Homo sapiens
  misc_feature 1..44: note = chr3:170303379-170303423
  misc_feature 1..44: note = hyper
  source 1..44: mol_type = genomic DNA
cggcgccggagccgcgctggcccccgccccgcccggcagctccc

SEQ ID NO: 7115 - DNA, 54 bp, Homo sapiens
  misc_feature 1..54: note = chr3:170303790-170303844
  misc_feature 1..54: note = hyper
  source 1..54: mol_type = genomic DNA
gggaagtggtggtggcggcaaaggaaggcaggaggcagccgctgctgctgaaca

SEQ ID NO: 7116 - DNA, 30 bp, Homo sapiens
  misc_feature 1..30: note = chr3:170625828-170625858
  misc_feature 1..30: note = hyper
  source 1..30: mol_type = genomic DNA
agtcgcagaggagctcgctgagggtgggga

SEQ ID NO: 7117 - DNA, 342 bp, Homo sapiens; identical to SEQ ID NO: 2317
  misc_feature 1..342: note = chr3:172165443-172165785
  misc_feature 1..342: note = hyper
  source 1..342: mol_type = genomic DNA

SEQ ID NO: 7118 - DNA, 368 bp, Homo sapiens; identical to SEQ ID NO: 2318
  misc_feature 1..368: note = chr3:172165866-172166234
  misc_feature 1..368: note = hyper
  source 1..368: mol_type = genomic DNA

SEQ ID NO: 7119 - DNA, 49 bp, Homo sapiens; identical to SEQ ID NO: 2319
  misc_feature 1..49: note = chr3:172166235-172166284
  misc_feature 1..49: note = hyper
  source 1..49: mol_type = genomic DNA

SEQ ID NO: 7120 - DNA, 19 bp, Homo sapiens
  misc_feature 1..19: note = chr3:172166494-172166513
  misc_feature 1..19: note = hyper
  source 1..19: mol_type = genomic DNA
tcccaacacatcctccggc

SEQ ID NO: 7121 - DNA, 15 bp, Homo sapiens
  misc_feature 1..15: note = chr3:172166999-172167014
  misc_feature 1..15: note = hyper
  source 1..15: mol_type = genomic DNA
cggatctcccacccg

SEQ ID NO: 7122 - DNA, 257 bp, Homo sapiens; identical to SEQ ID NO: 2320
  misc_feature 1..257: note = chr3:172167660-172167917
  misc_feature 1..257: note = hyper
  source 1..257: mol_type = genomic DNA

SEQ ID NO: 7123 - DNA, 53 bp, Homo sapiens
  misc_feature 1..53: note = chr3:173114201-173114254
  misc_feature 1..53: note = hyper
  source 1..53: mol_type = genomic DNA
tttacatgcaggaaacgtatatatgtttatataccgaccgcataatatataaa

SEQ ID NO: 7124 - DNA, 87 bp, Homo sapiens
  misc_feature 1..87: note = chr3:173114500-173114587
  misc_feature 1..87: note = hyper
  source 1..87: mol_type = genomic DNA
gcgtccgccgagctccggcgtttaccttaatcccggggattgccgagaacttcctattccctgcctctccttcgccttccccacctt

SEQ ID NO: 7125 - DNA, 120 bp, Homo sapiens; identical to SEQ ID NO: 2321
  misc_feature 1..120: note = chr3:173115047-173115167
  misc_feature 1..120: note = hyper
  source 1..120: mol_type = genomic DNA

SEQ ID NO: 7126 - DNA, 39 bp, Homo sapiens
  misc_feature 1..39: note = chr3:173115655-173115694
  misc_feature 1..39: note = hyper
  source 1..39: mol_type = genomic DNA
gaggccgggagagcccgtccgagccggagagaccggaga

SEQ ID NO: 7127 - DNA, 210 bp, Homo sapiens
  misc_feature 1..210: note = chr3:173115965-173116175
  misc_feature 1..210: note = hyper
  source 1..210: mol_type = genomic DNA
gaaccctcggcggagcgcagaggagctgctttcagccttctgctctccccaggccctccggctagttctggggttggttccgccggttagtttgacagggataagaaagttgctcttcttccccacaacgtttcctgagaggtggttttcagatctgtgtgtttccagtcaagatgtcactccctagatcccccgcgttgagcaactaat

SEQ ID NO: 7128 - DNA, 283 bp, Homo sapiens; identical to SEQ ID NO: 2322
  misc_feature 1..283: note = chr3:173302927-173303210
  misc_feature 1..283: note = hyper
  source 1..283: mol_type = genomic DNA

SEQ ID NO: 7129 - DNA, 858 bp, Homo sapiens; identical to SEQ ID NO: 334
  misc_feature 1..858: note = chr3:179168782-179169640
  misc_feature 1..858: note = hyper
  source 1..858: mol_type = genomic DNA

SEQ ID NO: 7130 - DNA, 255 bp, Homo sapiens; identical to SEQ ID NO: 335
  misc_feature 1..255: note = chr3:179754505-179754760
  misc_feature 1..255: note = hyper
  source 1..255: mol_type = genomic DNA

SEQ ID NO: 7131 - DNA, 70 bp, Homo sapiens; identical to SEQ ID NO: 336
  misc_feature 1..70: note = chr3:179754803-179754873
  misc_feature 1..70: note = hyper
  source 1..70: mol_type = genomic DNA

SEQ ID NO: 7132 - DNA, 286 bp, Homo sapiens; identical to SEQ ID NO: 337
  misc_feature 1..286: note = chr3:179755086-179755372
  misc_feature 1..286: note = hyper
  source 1..286: mol_type = genomic DNA

SEQ ID NO: 7133 - DNA, 308 bp, Homo sapiens
  misc_feature 1..308: note = chr3:180397489-180397797
  misc_feature 1..308: note = hyper
  source 1..308: mol_type = genomic DNA
ggatcgctcccggagcgtgtgaaaactgtggcccccggagctggctggaggaccacggggcagctggctggaagtaaaccacacgatcctccgattgcctgggggaagacgggagccaacagggattataaactaagtttcttttcaaggtgtgtttgctgtgttgtgtagatttcagctactacagtaggtgaaagtagaccgaagtgaactggtgtttggaaacaactctctctctggcatcactgggatgttctgatcgtcgcctgtttcagtcggccagccttcctcaccgcactcaccggccc

SEQ ID NO: 7134 - DNA, 41 bp, Homo sapiens
  misc_feature 1..41: note = chr3:180398001-180398042
  misc_feature 1..41: note = hyper
  source 1..41: mol_type = genomic DNA
caaaaggcaatgttccgctggagaggcgccccctttagacc

SEQ ID NO: 7135 - DNA, 27 bp, Homo sapiens
  misc_feature 1..27: note = chr3:181413421-181413448
  misc_feature 1..27: note = hyper
  source 1..27: mol_type = genomic DNA
gacccacccagccgggcccgatccctc

SEQ ID NO: 7136 - DNA, 449 bp, Homo sapiens
  misc_feature 1..449: note = chr3:181413704-181414153
  misc_feature 1..449: note = hyper
  source 1..449: mol_type = genomic DNA
cgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggt

SEQ ID NO: 7137 - DNA, 46 bp, Homo sapiens
  misc_feature 1..46: note = chr3:181419696-181419742
  misc_feature 1..46: note = hyper
  source 1..46: mol_type = genomic DNA
tgttggctcagaaaccgtgtaatttctcatccgataggagtttctt

SEQ ID NO: 7138 - DNA, 483 bp, Homo sapiens; identical to SEQ ID NO: 2328
  misc_feature 1..483: note = chr3:181419975-181420458
  misc_feature 1..483: note = hyper
  source 1..483: mol_type = genomic DNA

SEQ ID NO: 7139 - DNA, 71 bp, Homo sapiens
  misc_feature 1..71: note = chr3:181421249-181421320
  misc_feature 1..71: note = hyper
  source 1..71: mol_type = genomic DNA
acctcccaaaattagcgaattcgagataacatttcaaggggaattgctatttagtgcgatgagagatgact

SEQ ID NO: 7140 - DNA, 743 bp, Homo sapiens; identical to SEQ ID NO: 338
  misc_feature 1..743: note = chr3:181421539-181422282
  misc_feature 1..743: note = hyper
  source 1..743: mol_type = genomic DNA

SEQ ID NO: 7141 - DNA, 250 bp, Homo sapiens
  misc_feature 1..250: note = chr3:181422925-181423175
  misc_feature 1..250: note = hyper
  source 1..250: mol_type = genomic DNA
tcagagccccagctccgaaggagcctttaaagattatcaggccagcgatctgagaattccattgggatgggtttggaaacccaactccatctgagccaggactggaagaggggcgctgggggcaagcagaagtgggcccctgggaaggccgacttctcaggcatttcttttgaggccggaatagcttttgggagagggttctagatgtcaatgggaggccttgaggatgccagcccgcccaggatgggtg

SEQ ID NO: 7142 - DNA, 422 bp, Homo sapiens; identical to SEQ ID NO: 2330
  misc_feature 1..422: note = chr3:181428388-181428810
  misc_feature 1..422: note = hyper
  source 1..422: mol_type = genomic DNA

SEQ ID NO: 7143 - DNA, 348 bp, Homo sapiens; identical to SEQ ID NO: 2331
  misc_feature 1..348: note = chr3:181430741-181431089
  misc_feature 1..348: note = hyper
  source 1..348: mol_type = genomic DNA

SEQ ID NO: 7144 - DNA, 89 bp, Homo sapiens
  misc_feature 1..89: note = chr3:181437210-181437299
  misc_feature 1..89: note = hyper
  source 1..89: mol_type = genomic DNA
agcgcgccggcctcccgccggctgccctggggagcgcgcagtgcccagtgctgagagccgacgcgcgggcaaattgaggccgagctgac

SEQ ID NO: 7145 - DNA, 161 bp, Homo sapiens
  misc_feature 1..161: note = chr3:181437300-181437461
  misc_feature 1..161: note = hyper
  source 1..161: mol_type = genomic DNA
agctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtcta

SEQ ID NO: 7146 - DNA, 223 bp, Homo sapiens
  misc_feature 1..223: note = chr3:181438200-181438423
  misc_feature 1..223: note = hyper
  source 1..223: mol_type = genomic DNA
ggttcttatcgctggcggccaggccagaagcgggactgcgcccccacccccacctcgtgacgtcagggcctgcagggctccggggatgaaatgattcgtttgagtgttccagaaagggcaatccgaacgcttacagggcgaggccagtgcagcccagctccatcaccactaccaagccccagtttgggaggctcccgaggcccctggccgccccccagacccc

SEQ ID NO: 7147 - DNA, 30 bp, Homo sapiens
  misc_feature 1..30: note = chr3:181440785-181440815
  misc_feature 1..30: note = hyper
  source 1..30: mol_type = genomic DNA
gaccttccaagagttcgttttacatttgtt

SEQ ID NO: 7148 - DNA, 729 bp, Homo sapiens; identical to SEQ ID NO: 339
  misc_feature 1..729: note = chr3:181441019-181441748
  misc_feature 1..729: note = hyper
  source 1..729: mol_type = genomic DNA

SEQ ID NO: 7149 - DNA, 448 bp, Homo sapiens; identical to SEQ ID NO: 340
  misc_feature 1..448: note = chr3:181441962-181442410
  misc_feature 1..448: note = hyper
  source 1..448: mol_type = genomic DNA

SEQ ID NO: 7150 - DNA, 536 bp, Homo sapiens; identical to SEQ ID NO: 2334
  misc_feature 1..536: note = chr3:181443014-181443550
  misc_feature 1..536: note = hyper
  source 1..536: mol_type = genomic DNA

SEQ ID NO: 7151 - DNA, 91 bp, Homo sapiens; identical to SEQ ID NO: 2335
  misc_feature 1..91: note = chr3:181444434-181444525
  misc_feature 1..91: note = hyper
  source 1..91: mol_type = genomic DNA

SEQ ID NO: 7152 - DNA, 157 bp, Homo sapiens; identical to SEQ ID NO: 2336
  misc_feature 1..157: note = chr3:181444612-181444769
  misc_feature 1..157: note = hyper
  source 1..157: mol_type = genomic DNA

SEQ ID NO: 7153 - DNA, 120 bp, Homo sapiens; identical to SEQ ID NO: 2337
  misc_feature 1..120: note = chr3:181444829-181444949
  misc_feature 1..120: note = hyper
  source 1..120: mol_type = genomic DNA

SEQ ID NO: 7154 - skipped

SEQ ID NO: 7155 - DNA, 474 bp, Homo sapiens; identical to SEQ ID NO: 2339
  misc_feature 1..474: note = chr3:181444990-181445464
  misc_feature 1..474: note = hyper
  source 1..474: mol_type = genomic DNA

SEQ ID NO: 7156 - DNA, 15 bp, Homo sapiens
  misc_feature 1..15: note = chr3:181445710-181445725
  misc_feature 1..15: note = hyper
  source 1..15: mol_type = genomic DNA
cgtaacaccatcatc

SEQ ID NO: 7157 - DNA, 62 bp, Homo sapiens; identical to SEQ ID NO: 2341
  misc_feature 1..62: note = chr3:181445799-181445861
  misc_feature 1..62: note = hyper
  source 1..62: mol_type = genomic DNA

SEQ ID NO: 7158 - DNA, 152 bp, Homo sapiens
  misc_feature 1..152: note = chr3:182896884-182897036
  misc_feature 1..152: note = hyper
  source 1..152: mol_type = genomic DNA
cccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctgg

SEQ ID NO: 7159 - DNA, 30 bp, Homo sapiens
  misc_feature 1..30: note = chr3:182897285-182897315
  misc_feature 1..30: note = hyper
  source 1..30: mol_type = genomic DNA
gtcgccctgcaattccgagaagaaagtcag

SEQ ID NO: 7160 - DNA, 165 bp, Homo sapiens
  misc_feature 1..165: note = chr3:183145371-183145536
  misc_feature 1..165: note = hyper
  source 1..165: mol_type = genomic DNA
cacccaccctactcccgtcagaagcagctaacggatggtaacagcccagcagccctcggtttggagctcaacggactcggcaaccacctggtgaaggcaccagcctcggccccccgacccccaccagcggcgcgccccagggatgccccccgctgggcaccgcag

SEQ ID NO: 7161 - DNA, 189 bp, Homo sapiens
  misc_feature 1..189: note = chr3:183980238-183980427
  misc_feature 1..189: note = hyper
  source 1..189: mol_type = genomic DNA
aggaggaatgaatggcggcgtcgcggggggcgccctgggctgcgggtgacgcggggaagctcggagcacctgaggacgcggagcgcgccagtgtgtgccccgagggagtgcggtagagatggagggtgccccccgccctcgttgctttggaccacgggtgagttctcgcctcaccgatgggaacatgcc

SEQ ID NO: 7162 - DNA, 98 bp, Homo sapiens
  misc_feature 1..98: note = chr3:184243116-184243214
  misc_feature 1..98: note = hyper
  source 1..98: mol_type = genomic DNA
ccttgctgctgagggcgcggtgggacccgtcgcagggccagctgctccggcaggtgcccccaaagggtcccgcaggtgatcctcggggactgagcgcc

SEQ ID NO: 7163 - DNA, 76 bp, Homo sapiens
  misc_feature 1..76: note = chr3:184301502-184301578
  misc_feature 1..76: note = hyper
  source 1..76: mol_type = genomic DNA
ccgcgccgccgcagccggcccgggggaggggcgccccgcacggctaagctctctgcgtccccggggcggacgcggg

SEQ ID NO: 7164 - DNA, 182 bp, Homo sapiens
  misc_feature 1..182: note = chr3:184871097-184871279
  misc_feature 1..182: note = hyper
  source 1..182: mol_type = genomic DNA
agtgacactggccaccgagaactgacacacgcgtccacacgctccacggagggctgcgcacacctggcccacgcccacccgaacctcctagtggcccgggccgggtgcatcgcgtagcgaggatctcacacacacagcctgtccccacaggcgtctcacatctccctcgtacacacctcccc

SEQ ID NO: 7165 - DNA, 138 bp, Homo sapiens
  misc_feature 1..138: note = chr3:186078760-186078898
  misc_feature 1..138: note = hyper
  source 1..138: mol_type = genomic DNA
cccacgggttcacagcgctcccgggcaccactgcggcgcagccacagatcgcttcgcgctgcagcagacgctcccgccgcggggggcgactgggggaggggtctcgaccgccaccctgagttccgcagctcatccctc

SEQ ID NO: 7166 - DNA, 127 bp, Homo sapiens; identical to SEQ ID NO: 2342
  misc_feature 1..127: note = chr3:186079204-186079331
  misc_feature 1..127: note = hyper
  source 1..127: mol_type = genomic DNA

SEQ ID NO: 7167 - DNA, 104 bp, Homo sapiens
  misc_feature 1..104: note = chr3:186079667-186079771
  misc_feature 1..104: note = hyper
  source 1..104: mol_type = genomic DNA
accaagttgctgcaccgggtgctccctgagccggggaccccctccgccgcgccggccgccgtcttacctcaccaggcaacacttggttgcgcggtggcccgggg

SEQ ID NO: 7168 - DNA, 83 bp, Homo sapiens
  misc_feature 1..83: note = chr3:186080162-186080245
  misc_feature 1..83: note = hyper
  source 1..83: mol_type = genomic DNA
ttccacacatgcacacgcgtgcgcacacacgaatgtggatccgctcgatgggaacctgaccccctttggtgcaactagggcgc

SEQ ID NO: 7169 - DNA, 49 bp, Homo sapiens
  misc_feature 1..49: note = chr3:186080246-186080295
  misc_feature 1..49: note = hyper
  source 1..49: mol_type = genomic DNA
ggcatcattaggacgctttttactgacagggcttcggtttgggaggagg

SEQ ID NO: 7170 - DNA, 576 bp, Homo sapiens
  misc_feature 1..576: note = chr3:186857096-186857672
  misc_feature 1..576: note = hyper
  source 1..576: mol_type = genomic DNA
aggtctgcgtgtcaccgacccgaacccgctccgtcgtcctgacgcccccggcctagctgcagccaccttgtcgcaggggccttggtgtctctgagactccgagacgcctcgcccccacctggcgttcggaggcggttgcctcgctgggcgcagcaattcaaccgccgcgcgccggatgctaagaccgcgatttccccggatgctagggcggtgatttcccccgtgacaggccccgccccggccccgcccaggcccgggcggtcccgccccactgagctgtggctcggggagccgtgggtccgactcctgcgtgtgatgtgtcaccaagttgactttggggtcccccattcttccttagttctctattttacctcagcgcgttgtctagctgctgcctggccacggtacttagcacacagcgtgacttaatactggataaacgaggaaaggattcgtacgccctggcggggccagaggctcacagcttgggttcccgcgagcacacgagccaggaaccgccaatgcctccagggggcgctctccctcccatcgagccaccgccgggccattggagac

SEQ ID NO: 7171 - DNA, 130 bp, Homo sapiens; identical to SEQ ID NO: 341
  misc_feature 1..130: note = chr3:187387791-187387921
  misc_feature 1..130: note = hyper
  source 1..130: mol_type = genomic DNA

SEQ ID NO: 7172 - DNA, 183 bp, Homo sapiens; identical to SEQ ID NO: 342
  misc_feature 1..183: note = chr3:187388006-187388189
  misc_feature 1..183: note = hyper
  source 1..183: mol_type = genomic DNA

SEQ ID NO: 7173 - DNA, 118 bp, Homo sapiens
  misc_feature 1..118: note = chr3:187456159-187456277
  misc_feature 1..118: note = hyper
  source 1..118: mol_type = genomic DNA
acagaaagccccttccgcctacgttggcaagaacgggaacccagctccacttggtttccgcccaaagtctttagaacaggagctgccaagccgtaaggatttccgaatccgatttccc

SEQ ID NO: 7174 - DNA, 30 bp, Homo sapiens
  misc_feature 1..30: note = chr3:187456549-187456579
  misc_feature 1..30: note = hyper
  source 1..30: mol_type = genomic DNA
cggaagggtcagagtcggtctgcaaagaac

SEQ ID NO: 7175 - DNA, 30 bp, Homo sapiens
  misc_feature 1..30: note = chr3:189838630-189838660
  misc_feature 1..30: note = hyper
  source 1..30: mol_type = genomic DNA
gatctggccgctccgcgagccccaggtgac

SEQ ID NO: 7176 - DNA, 101 bp, Homo sapiens
  misc_feature 1..101: note = chr3:190580811-190580912
  misc_feature 1..101: note = hyper
  source 1..101: mol_type = genomic DNA
cggcgaccccgcagccgggaccgaggcgagggccgggctccctcccgctccacgcgcagcgcggggcagggccgagccgggccgggcgagaagatggtcca

SEQ ID NO: 7177 - skipped

SEQ ID NO: 7178 - DNA, 406 bp, Homo sapiens; identical to SEQ ID NO: 343
  misc_feature 1..406: note = chr3:192126305-192126711
  misc_feature 1..406: note = hyper
  source 1..406: mol_type = genomic DNA

SEQ ID NO: 7179 - DNA, 63 bp, Homo sapiens; identical to SEQ ID NO: 344
  misc_feature 1..63: note = chr3:192126786-192126849
  misc_feature 1..63: note = hyper
  source 1..63: mol_type = genomic DNA

SEQ ID NO: 7180 - DNA, 110 bp, Homo sapiens; identical to SEQ ID NO: 345
  misc_feature 1..110: note = chr3:192126850-192126960
  misc_feature 1..110: note = hyper
  source 1..110: mol_type = genomic DNA

SEQ ID NO: 7181 - DNA, 49 bp, Homo sapiens; identical to SEQ ID NO: 346
  misc_feature 1..49: note = chr3:192126961-192127010
  misc_feature 1..49: note = hyper
  source 1..49: mol_type = genomic DNA

SEQ ID NO: 7182 - DNA, 59 bp, Homo sapiens; identical to SEQ ID NO: 347
  misc_feature 1..59: note = chr3:192127314-192127373
  misc_feature 1..59: note = hyper
  source 1..59: mol_type = genomic DNA

SEQ ID NO: 7183 - DNA, 175 bp, Homo sapiens; identical to SEQ ID NO: 348
  misc_feature 1..175: note = chr3:192127556-192127731
  misc_feature 1..175: note = hyper
  source 1..175: mol_type = genomic DNA

SEQ ID NO: 7184 - DNA, 54 bp, Homo sapiens; identical to SEQ ID NO: 349
  misc_feature 1..54: note = chr3:192127936-192127990
  misc_feature 1..54: note = hyper
  source 1..54: mol_type = genomic DNA

SEQ ID NO: 7185 - DNA, 20 bp, Homo sapiens
  misc_feature 1..20: note = chr3:192232057-192232077
  misc_feature 1..20: note = hyper
  source 1..20: mol_type = genomic DNA
ccctctcctgtggaacgcac

SEQ ID NO: 7186 - DNA, 13 bp, Homo sapiens
  misc_feature 1..13: note = chr3:192232078-192232091
  misc_feature 1..13: note = hyper
  source 1..13: mol_type = genomic DNA
agcaacttttcgg

SEQ ID NO: 7187 - DNA, 21 bp, Homo sapiens
  misc_feature 1..21: note = chr3:192232798-192232819
  misc_feature 1..21: note = hyper
  source 1..21: mol_type = genomic DNA
ccccttgagaccttccggagg

SEQ ID NO: 7188 - DNA, 103 bp, Homo sapiens
  misc_feature 1..103: note = chr3:192232849-192232952
  misc_feature 1..103: note = hyper
  source 1..103: mol_type = genomic DNA
cgtcactgcgggtcggtgcttccttacaggtgccttctggaccggggtccttggcacctcccctgctcctgccctcggtgccggaccctgtgccctgggagcc

SEQ ID NO: 7189 - DNA, 123 bp, Homo sapiens
  misc_feature 1..123: note = chr3:192233094-192233217
  misc_feature 1..123: note = hyper
  source 1..123: mol_type = genomic DNA
gcagggagggctggaccccggaggctgcagagcgtcagaagcgactctagggaactagggggtggggtagggaggcggggacgtggaataaagaaagctcctgggtgccggctatgagaagtc

SEQ ID NO: 7190 - DNA, 103 bp, Homo sapiens
  misc_feature 1..103: note = chr3:193776076-193776179
  misc_feature 1..103: note = hyper
  source 1..103: mol_type = genomic DNA
cggttcctctgcagacgttcagccccttcggaaatgtaaaacccgggaagcgaaagctgcggcgacctcccagagcctctcaggcacgcggcatctctcccca

SEQ ID NO: 7191 - DNA, 100 bp, Homo sapiens; identical to SEQ ID NO: 2352
  misc_feature 1..100: note = chr3:194208467-194208567
  misc_feature 1..100: note = hyper
  source 1..100: mol_type = genomic DNA

SEQ ID NO: 7192 - DNA, 342 bp, Homo sapiens; identical to SEQ ID NO: 2353
  misc_feature 1..342: note = chr3:194408427-194408769
  misc_feature 1..342: note = hyper
  source 1..342: mol_type = genomic DNA

SEQ ID NO: 7193 - DNA, 220 bp, Homo sapiens; identical to SEQ ID NO: 2354
  misc_feature 1..220: note = chr3:194408838-194409058
  misc_feature 1..220: note = hyper
  source 1..220: mol_type = genomic DNA

SEQ ID NO: 7194 - DNA, 60 bp, Homo sapiens
  misc_feature 1..60: note = chr3:196366801-196366861
  misc_feature 1..60: note = hyper
  source 1..60: mol_type = genomic DNA
gtgggcgagctcgagcgaggttgggtggtaggaggtcagcgtccgcggcccgcagctcag

SEQ ID NO: 7195 - DNA, 102 bp, Homo sapiens
  misc_feature 1..102: note = chr3:197840446-197840548
  misc_feature 1..102: note = hyper
  source 1..102: mol_type = genomic DNA
gaaaggcaggggaggcgcgacggggcgagggacggggaggaaagcggtctcccgcctccagggcgggccgagggctgggcccgcggggcgctcacgtccctc

SEQ ID NO: 7196 - DNA, 114 bp, Homo sapiens; identical to SEQ ID NO: 2355
  misc_feature 1..114: note = chr4:568539-568653
  misc_feature 1..114: note = hyper
  source 1..114: mol_type = genomic DNA

SEQ ID NO: 7197 - DNA, 69 bp, Homo sapiens; identical to SEQ ID NO: 2356
  misc_feature 1..69: note = chr4:569047-569116
  misc_feature 1..69: note = hyper
  source 1..69: mol_type = genomic DNA

SEQ ID NO: 7198 - DNA, 162 bp, Homo sapiens; identical to SEQ ID NO: 2357
  misc_feature 1..162: note = chr4:569274-569436
  misc_feature 1..162: note = hyper
  source 1..162: mol_type = genomic DNA

SEQ ID NO: 7199 - DNA, 36 bp, Homo sapiens; identical to SEQ ID NO: 2358
  misc_feature 1..36: note = chr4:569460-569496
  misc_feature 1..36: note = hyper
  source 1..36: mol_type = genomic DNA

SEQ ID NO: 7200 - DNA, 15 bp, Homo sapiens
  misc_feature 1..15: note = chr4:570242-570257
  misc_feature 1..15: note = hyper
  source 1..15: mol_type = genomic DNA
ttcctcctcccggag

SEQ ID NO: 7201 - DNA, 203 bp, Homo sapiens
  misc_feature 1..203: note = chr4:570298-570501
  misc_feature 1..203: note = hyper
  source 1..203: mol_type = genomic DNA
cgcgcccctatccggcgcgggccgctgcggaaacgcagctctccacccccagctggctctcccggaccccctgggccccaccctcagcgctccccaccgctcggcgcccctgcgtctgcgctcccctctctcccctctctatccactgggtctgggccgcacttcccgcccacccgcctgccagcggccgggaagcctgtgga

SEQ ID NO: 7202 - DNA, 853 bp, Homo sapiens; identical to SEQ ID NO: 2359
  misc_feature 1..853: note = chr4:570836-571689
  misc_feature 1..853: note = hyper
  source 1..853: mol_type = genomic DNA

SEQ ID NO: 7203 - DNA, 44 bp, Homo sapiens
  misc_feature 1..44: note = chr4:788891-788935
  misc_feature 1..44: note = hyper
  source 1..44: mol_type = genomic DNA
gagcgtcacagatgccgcccacgcccccccgcttttcggcccgg

SEQ ID NO: 7204 - DNA, 102 bp, Homo sapiens
  misc_feature 1..102: note = chr4:789169-789271
  misc_feature 1..102: note = hyper
  source 1..102: mol_type = genomic DNA
gcatgagctgcatcccgcatccgcaggagggcggcgctgcgacccacccccgcccccgtttccagaggaggccgctgcggcgcggggcggtcccacgtggtg

SEQ ID NO: 7205 - skipped

SEQ ID NO: 7206 - DNA, 75 bp, Homo sapiens
  misc_feature 1..75: note = chr4:996100-996175
  misc_feature 1..75: note = hyper
  source 1..75: mol_type = genomic DNA
cgccttcccctacgcgctcctgagcaacgacaatgccttcctgagctaccacccgcaccccttcgcgcagcgcac

SEQ ID NO: 7207 - DNA, 44 bp, Homo sapiens
  misc_feature 1..44: note = chr4:996495-996539
  misc_feature 1..44: note = hyper
  source 1..44: mol_type = genomic DNA
cgacggcccccccccgccccgcagatgaggagcagctctgggcc

SEQ ID NO: 7208 - DNA, 21 bp, Homo sapiens
  misc_feature 1..21: note = chr4:1165449-1165470
  misc_feature 1..21: note = hyper
  source 1..21: mol_type = genomic DNA
cgtgagcgccccctgccccca

SEQ ID NO: 7209 - DNA, 139 bp, Homo sapiens
  misc_feature 1..139: note = chr4:1166167-1166306
  misc_feature 1..139: note = hyper
  source 1..139: mol_type = genomic DNA
acccggggccttggccgactggctgcccccgggactagacccttaaagctcggtcgcagccagtcctgggggtccctctggaggtgccacaaggttctgggccgcggggaaagtgcaggaggcccgggccctctctggg

SEQ ID NO: 7210 - DNA, 99 bp, Homo sapiens
  misc_feature 1..99: note = chr4:1397396-1397495
  misc_feature 1..99: note = hyper
  source 1..99: mol_type = genomic DNA
cgcgggccccgaggccgccgccgcctccccgcgcctcctccgcgcctcgcgccgcctccgtctcgggcgcttcgtcctcgtcgtcgtcctcgtcgtcgg

SEQ ID NO: 7211 - DNA, 65 bp, Homo sapiens
  misc_feature 1..65: note = chr4:1398277-1398342
  misc_feature 1..65: note = hyper
  source 1..65: mol_type = genomic DNA
gggtagggccctgctcggcctcaccaggagggctgggcgggcgtgcaggtcggagtggctccccg

SEQ ID NO: 7212 - DNA, 72 bp, Homo sapiens
  misc_feature 1..72: note = chr4:1399065-1399137
  misc_feature 1..72: note = hyper
  source 1..72: mol_type = genomic DNA
aggtcgaatgcaattcgcgatcaatagcggcccctaataagtgtaataggttttaatcgagtaattatccga

SEQ ID NO: 7213 - DNA, 92 bp, Homo sapiens
  misc_feature 1..92: note = chr4:1400248-1400340
  misc_feature 1..92: note = hyper
  source 1..92: mol_type = genomic DNA
cggcggctcgggccccgccacctactgggctcccatccctggcggcccccgcacctccacacgaccccgcgcaggcggccgctgctccgctc

SEQ ID NO: 7214 - DNA, 372 bp, Homo sapiens
  misc_feature 1..372: note = chr4:1401106-1401478
  misc_feature 1..372: note = hyper
  source 1..372: mol_type = genomic DNA
cgcccgcccctttcacgtcgtcaaattagggcccgacctggagtgccagcagaggggcggagccggcggtccccgggccgctcattagaagtggaatcgaaaatgagagactgcttgtccctcttaacccgcccccaaaagggggaccgacaaattgcacacacagcaggcggcctacataaaatcgatcctcttcaagtaaggagaaaatgtgtgtttcttccaaaaagaatacgacaaatgcccccttctccacatctggataaataggaagccccgcggcctgagtctttatttgggtacgttttatctacagcggcggtgtttgcaggacagggccctgcggcccgcggccctcggccctcgaggatt

SEQ ID NO: 7215 - DNA, 141 bp, Homo sapiens
  misc_feature 1..141: note = chr4:1401683-1401824
  misc_feature 1..141: note = hyper
  source 1..141: mol_type = genomic DNA
ccccggagcctgttccgcgcgcagggcggtcctttgcaattaccgcgggcaatgatcctttggaagcagaaattaaaagttgggagaaataatggtggaccgatcggctgtaatttgggccaagctcggacacgctgagcc

SEQ ID NO: 7216 - DNA, 30 bp, Homo sapiens
  misc_feature 1..30: note = chr4:1404132-1404162
  misc_feature 1..30: note = hyper
  source 1..30: mol_type = genomic DNA
acccatgttgatcaccggagtttgggaagt

SEQ ID NO: 7217 - DNA, 99 bp, Homo sapiens
  misc_feature 1..99: note = chr4:1404368-1404467
  misc_feature 1..99: note = hyper
  source 1..99: mol_type = genomic DNA
gaacagcgccagcaccgcggacagcgcgctcccacctcgcccccggaggccacgggctcgggccgtgttcagcaccgcggacagcgccagcaactccga

SEQ ID NO: 7218 - DNA, 68 bp, Homo sapiens
  misc_feature 1..68: note = chr4:1408020-1408088
  misc_feature 1..68: note = hyper
  source 1..68: mol_type = genomic DNA
gggagtcggggtgggcgcgtgtccgcgggagggagtcggggtgggcgcgtgtccgcgggagggagtcg

SEQ ID NO: 7219 - DNA, 42 bp, Homo sapiens
  misc_feature 1..42: note = chr4:1811789-1811831
  misc_feature 1..42: note = hyper
  source 1..42: mol_type = genomic DNA
gcagagcatggggctcgaagcgcgggccgggagcgcccccta

SEQ ID NO: 7220 - skipped

SEQ ID NO: 7221 - DNA, 73 bp, Homo sapiens
  misc_feature 1..73: note = chr4:2042168-2042241
  misc_feature 1..73: note = hyper
  source 1..73: mol_type = genomic DNA
cgagcgggcgcagcgtgggaccgaaggggagaaggacgcctgcggcccggcgcgtccccggaggcacgtcccc

SEQ ID NO: 7222 - DNA, 14 bp, Homo sapiens
  misc_feature 1..14: note = chr4:2042655-2042669
  misc_feature 1..14: note = hyper
  source 1..14: mol_type = genomic DNA
gcagtcccagcttg

SEQ ID NO: 7223 - DNA, 43 bp, Homo sapiens
  misc_feature 1..43: note = chr4:2060112-2060155
  misc_feature 1..43: note = hyper
  source 1..43: mol_type = genomic DNA
gcacaacgcagactgcgggtccccaggcctggacccctggccc

SEQ ID NO: 7224 - DNA, 41 bp, Homo sapiens
  misc_feature 1..41: note = chr4:2060173-2060214
  misc_feature 1..41: note = hyper
  source 1..41: mol_type = genomic DNA
cggggaagctctgctccggcagccctcggggtggtgctggg

SEQ ID NO: 7225 - DNA, 82 bp, Homo sapiens
  misc_feature 1..82: note = chr4:2062004-2062086
  misc_feature 1..82: note = hyper
  source 1..82: mol_type = genomic DNA
tgaggggaagacagccggcgccgcggggggtgcgcgcgcctggcacagccggggcggtcgcagagggcggccccttcagcgt

SEQ ID NO: 7226 - DNA, 174 bp, Homo sapiens
  misc_feature 1..174: note = chr4:2765778-2765952
  misc_feature 1..174: note = hyper
  source 1..174: mol_type = genomic DNA
tggtatgggaccctccgggtgggcgcggccccgcggggccttgcggccacaccgccaccgtgcccagcggccccatcagcgcatattcaggatgaaccccggacacgcgcccagaaccgtctggtgacccagtgatgaaagctcgaatcttataggatccgtattcatttcccg

SEQ ID NO: 7227 - DNA, 42 bp, Homo sapiens
  misc_feature 1..42: note = chr4:2766173-2766215
  misc_feature 1..42: note = hyper
  source 1..42: mol_type = genomic DNA
cactttgctccccagcgtgggcccctgagcgctgggggaagt

SEQ ID NO: 7228 - DNA, 30 bp, Homo sapiens
  misc_feature 1..30: note = chr4:3767309-3767339
  misc_feature 1..30: note = hyper
  source 1..30: mol_type = genomic DNA
gcgcgcccccgcctgcgcccatgcctgcgc

SEQ ID NO: 7229 - DNA, 45 bp, Homo sapiens
  misc_feature 1..45: note = chr4:3767848-3767893
  misc_feature 1..45: note = hyper
  source 1..45: mol_type = genomic DNA
ggcgccccggcgcgccgagccctagccggccggatgggaggcgga

SEQ ID NO: 7230 - DNA, 183 bp, Homo sapiens; identical to SEQ ID NO: 2361
  misc_feature 1..183: note = chr4:3769007-3769190
  misc_feature 1..183: note = hyper
  source 1..183: mol_type = genomic DNA

SEQ ID NO: 7231 - DNA, 620 bp, Homo sapiens
  misc_feature 1..620: note = chr4:3873083-3873703
  misc_feature 1..620: note = hyper
  source 1..620: mol_type = genomic DNA
actggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccccactgccat

SEQ ID NO: 7232 - DNA, 50 bp, Homo sapiens
  misc_feature 1..50: note = chr4:3882155-3882205
  misc_feature 1..50: note = hyper
  source 1..50: mol_type = genomic DNA
tgcctgaggagggtccgcagaagttccctctcgagcgggaggaggggatt

SEQ ID NO: 7233 - DNA, 15 bp, Homo sapiens
  misc_feature 1..15: note = chr4:4145386-4145401
  misc_feature 1..15: note = hyper
  source 1..15: mol_type = genomic DNA
cgggatgtggggcta

SEQ ID NO: 7234 - DNA, 84 bp, Homo sapiens
  misc_feature 1..84: note = chr4:4228084-4228168
  misc_feature 1..84: note = hyper
  source 1..84: mol_type = genomic DNA
aggctgaagggaagacggcagcggtaggaagggcgcagagcagcctcaggatgcagccagcgggcgaggaggcggagacccgct

SEQ ID NO: 7235 - DNA, 87 bp, Homo sapiens
  misc_feature 1..87: note = chr4:4228188-4228275
  misc_feature 1..87: note = hyper
  source 1..87: mol_type = genomic DNA
cgcgcagccagccggcacccgcgtgcgtgtccttgaggcggaagaggcggcggtgcgcggagctgcggcccacgtaccacagcatcc

SEQ ID NO: 7236 - DNA, 99 bp, Homo sapiens
  misc_feature 1..99: note = chr4:4229682-4229781
  misc_feature 1..99: note = hyper
  source 1..99: mol_type = genomic DNA
ccccttccaaagccccggtgcccgcctggcacccgcctgctcccggaaggggactgagtctgccagggagccccgctcgggtgccgctaagtggaggtc

SEQ ID NO: 7237 - DNA, 54 bp, Homo sapiens
  misc_feature 1..54: note = chr4:4387592-4387646
  misc_feature 1..54: note = hyper
  source 1..54: mol_type = genomic DNA
acggctgatggaaaacgccccggaccctccgtagtgccgcggggaagtccccgg

SEQ ID NO: 7238 - DNA, 578 bp, Homo sapiens
  misc_feature 1..578: note = chr4:4387927-4388505
  misc_feature 1..578: note = hyper
  source 1..578: mol_type = genomic DNA
caccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggc

SEQ ID NO: 7239 - DNA, 50 bp, Homo sapiens
  misc_feature 1..50: note = chr4:4388506-4388556
  misc_feature 1..50: note = hyper
  source 1..50: mol_type = genomic DNA
cagcccgcagccctcccgctccgggcgccctccgccgctccgagaccccc

SEQ ID NO: 7240 - DNA, 46 bp, Homo sapiens
  misc_feature 1..46: note = chr4:4388772-4388818
  misc_feature 1..46: note = hyper
  source 1..46: mol_type = genomic DNA
gccgtggagcccaatcgttcgctccccttcccgggtccgcgcgcgg

SEQ ID NO: 7241 - DNA, 82 bp, Homo sapiens
  misc_feature 1..82: note = chr4:4854669-4854751
  misc_feature 1..82: note = hyper
  source 1..82: mol_type = genomic DNA
ctctcctgcctgggccgacccggcgctttactgcttctcacgaaggtgcgccggctgctccagaaatcgcagactgcctcca

SEQ ID NO: 7242 - DNA, 238 bp, Homo sapiens
  misc_feature 1..238: note = chr4:4854954-4855192
  misc_feature 1..238: note = hyper
  source 1..238: mol_type = genomic DNA
agagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactcccacacaccaggctgtccgcgggccgccttgtcacagaaaggcagctccccagccccgcagagtcccgacagctgcccccgcgaaggtgggg

SEQ ID NO: 7243 - DNA, 44 bp, Homo sapiens
  misc_feature 1..44: note = chr4:4858727-4858771
  misc_feature 1..44: note = hyper
  source 1..44: mol_type = genomic DNA
cacattgtttatccccgcaattagcgatgcggcccttttcaggc

SEQ ID NO: 7244 - DNA, 259 bp, Homo sapiens
  misc_feature 1..259: note = chr4:4862186-4862445
  misc_feature 1..259: note = hyper
  source 1..259: mol_type = genomic DNA
ctgcgtacctgcagccggtgctagggagccgtgggctgcaaggccgggtcttgcgcctccctccactcccacccaggaagaaggttccagacctcctcgccttggcccagagacgctgcgggtgggagttaacggataggacaccgatgtctgggcaccctgtcctcctgcccccaccaaacgacctcaggggtccatgatccctcatctgatcccaaactctgtttcatcggcttcaccccagcggatgaatgtgtgt

SEQ ID NO: 7245 - DNA, 262 bp, Homo sapiens
  misc_feature 1..262: note = chr4:4862799-4863061
  misc_feature 1..262: note = hyper
  source 1..262: mol_type = genomic DNA
tctactcagagaacacgctcggagatatttcaggagcacgggaaattcccaagttttcctcgtttcctccgattattttgctcggcataatagcagccagatttcaatggcgtgatgctgaggaatgatttttatctggggattaaacgtctttgaaaggccagtccctccctaagcctaatggccggagaaggtggccccgctctgggttgtcgccgctgaagggagtgacgtttctctcggcgcccgcccctcgggcggc

SEQ ID NO: 7246 - DNA, 151 bp, Homo sapiens
  misc_feature 1..151: note = chr4:4867591-4867742
  misc_feature 1..151: note = hyper
  source 1..151: mol_type = genomic DNA
agagcaacataattgcggtaatgagcaacggctcaccctctgcagacgcgtcgcggctccagcgaggcggtagctgcaggcgaggcgggcgcgcctccccgccccctccctgcgccgcagcccgggtgcgagggcccggcctccctgggac

SEQ ID NO: 7247 - DNA, 30 bp, Homo sapiens
  misc_feature 1..30: note = chr4:4868050-4868080
  misc_feature 1..30: note = hyper
  source 1..30: mol_type = genomic DNA
ccctggtttatcaaccgagggcggagtggg

SEQ ID NO: 7248 - DNA, 238 bp, Homo sapiens; identical to SEQ ID NO: 2362
  misc_feature 1..238: note = chr4:4868555-4868793
  misc_feature 1..238: note = hyper
  source 1..238: mol_type = genomic DNA

SEQ ID NO: 7249 - DNA, 172 bp, Homo sapiens; identical to SEQ ID NO: 2363
  misc_feature 1..172: note = chr4:4868828-4869000
  misc_feature 1..172: note = hyper
  source 1..172: mol_type = genomic DNA

SEQ ID NO: 7250 - DNA, 127 bp, Homo sapiens; identical to SEQ ID NO: 2364
  misc_feature 1..127: note = chr4:4869131-4869258
  misc_feature 1..127: note = hyper
  source 1..127: mol_type = genomic DNA

SEQ ID NO: 7251 - DNA, 30 bp, Homo sapiens
  misc_feature 1..30: note = chr4:4870173-4870203
  misc_feature 1..30: note = hyper
  source 1..30: mol_type = genomic DNA
aatcgcctgagggaacgctgggagttcccc

SEQ ID NO: 7252 - DNA, 15 bp, Homo sapiens
  misc_feature 1..15: note = chr4:4872017-4872032
  misc_feature 1..15: note = hyper
  source 1..15: mol_type = genomic DNA
gggtgagaaggggag

SEQ ID NO: 7253 - DNA, 77 bp, Homo sapiens
  misc_feature 1..77: note = chr4:4872059-4872136
  misc_feature 1..77: note = hyper
  source 1..77: mol_type = genomic DNA
cggagcatagaggcaggatggtgacctgagcgctctttgctggccggctctgctctccgcagcgccattggaattcc

SEQ ID NO: 7254 - DNA, 1175 bp, Homo sapiens; identical to SEQ ID NO: 2365
  misc_feature 1..1175: note = chr4:5052930-5054105
  misc_feature 1..1175: note = hyper
  source 1..1175: mol_type = genomic DNA

SEQ ID NO: 7255 - DNA, 79 bp, Homo sapiens
  misc_feature 1..79: note = chr4:5709906-5709985
  misc_feature 1..79: note = hyper
  source 1..79: mol_type = genomic DNA
cttcctcattctttgcgaaatactaagggtcctccctgccaccgccggtgtagacaaagtcaaaccactacagtcagac

SEQ ID NO: 7256 - DNA, 253 bp, Homo sapiens; identical to SEQ ID NO: 2366
  misc_feature 1..253: note = chr4:5712979-5713232
  misc_feature 1..253: note = hyper
  source 1..253: mol_type = genomic DNA

SEQ ID NO: 7257 - DNA, 194 bp, Homo sapiens
  misc_feature 1..194: note = chr4:5889144-5889338
  misc_feature 1..194: note = hyper
  source 1..194: mol_type = genomic DNA
aacagtcaggctccacgctgatgccaggcaggaactggggcggagggccagctcctgaccgctgcgccctcagctccccaccccgagacaaagcgtaaagacggggattcctttgtttccggccacacccagggacgcagcccggctgttctgcctccaccaccgtccccaccctctcgcggcccagcgtcggg

SEQ ID NO: 7258 - DNA, 784 bp, Homo sapiens
  misc_feature 1..784: note = chr4:5889545-5890329
  misc_feature 1..784: note = hyper
  source 1..784: mol_type = genomic DNA
ggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggccgcttaccgtgatgtgcgggatgctcttcttgccctggtacgacatggccccctctggcgccctcggcccggccgctgacctgcggggctgtctgactggaaccggcgctctcggccccgctcccagcgggcgcgctgacaaaggcccgggagggatagagacacggacggaggctcggcgcccgtggatgcccacgcgcggctgccccggctgctcggcccgcccgccgccgctccggctgccagcaccgcccggatcggcgaggagggcgggagaaggaggagggagaggcgagggcgggaggagggggctgcagacagctcctcccggcggcgcggagcgaagccggattcgcccctctcggctcgaaccaggaagcgc

SEQ ID NO: 7259 - DNA, 30 bp, Homo sapiens
  misc_feature 1..30: note = chr4:5890534-5890564
  misc_feature 1..30: note = hyper
  source 1..30: mol_type = genomic DNA
tccccggaacatctgcgggggtgtgggggg

SEQ ID NO: 7260 - DNA, 116 bp, Homo sapiens; identical to SEQ ID NO: 2367
  misc_feature 1..116: note = chr4:5891966-5892082
  misc_feature 1..116: note = hyper
  source 1..116: mol_type = genomic DNA

SEQ ID NO: 7261 - DNA, 56 bp, Homo sapiens; identical to SEQ ID NO: 2368
  misc_feature 1..56: note = chr4:5892109-5892165
  misc_feature 1..56: note = hyper
  source 1..56: mol_type = genomic DNA

SEQ ID NO: 7262 - DNA, 234 bp, Homo sapiens
  misc_feature 1..234: note = chr4:5893517-5893751
  misc_feature 1..234: note = hyper
  source 1..234: mol_type = genomic DNA
tcaagagagaatacccgcagggcccaagccctagcgttccctctccctgatcctcccggccccatgctcaggtccgggaggccagagaccccagttcaaatcccagctctacctccaccttgctctgtgaagcaggcacatcggtgtgtgctgtggagctcaggagtgccccttgaatctactggcgcttgagggtaggggtttacggctccaactgcccgacgaactaaatcc

SEQ ID NO: 7263 - DNA, 52 bp, Homo sapiens
  misc_feature 1..52: note = chr4:5894812-5894864
  misc_feature 1..52: note = hyper
  source 1..52: mol_type = genomic DNA
cggcccagggaggggaggggcggggcgtggcgcgcgccggggcggggccggg

SEQ ID NO: 7264 - DNA, 415 bp, Homo sapiens
  misc_feature 1..415: note = chr4:6200878-6201293
  misc_feature 1..415: note = hyper
  source 1..415: mol_type = genomic DNA
aggacagtgtgcctgcgagtgtgcgcagatggggcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgc

SEQ ID NO: 7265 - DNA, 138 bp, Homo sapiens
  misc_feature 1..138: note = chr4:6201349-6201487
  misc_feature 1..138: note = hyper
  source 1..138: mol_type = genomic DNA
cggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctcca

SEQ ID NO: 7266 - DNA, 645 bp, Homo sapiens; identical to SEQ ID NO: 2369
  misc_feature 1..645: note = chr4:6201895-6202540
  misc_feature 1..645: note = hyper
  source 1..645: mol_type = genomic DNA

SEQ ID NO: 7267 - DNA, 366 bp, Homo sapiens
  misc_feature 1..366: note = chr4:6247351-6247717
  misc_feature 1..366: note = hyper
  source 1..366: mol_type = genomic DNA
aaagcacagggactgcgcagtcgggaggcgcttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 7268 - DNA, 30 bp, Homo sapiens
  misc_feature 1..30: note = chr4:6473934-6473964
  misc_feature 1..30: note = hyper
  source 1..30: mol_type = genomic DNA
gcgtgtccgtgtcctcgcccattgaaggcc

SEQ ID NO: 7269 - DNA, 277 bp, Homo sapiens
  misc_feature 1..277: note = chr4:6473965-6474242
  misc_feature 1..277: note = hyper
  source 1..277: mol_type = genomic DNA
tgcccggtgctctgggcatgccccgccgccacacaccgatgcaatccgcagaggtcgcgccgggcgcgcgggccatgccgccgcagcctagcaggggcgcgggccgccggggccccgaagggagggcatcgcggcagggggacgggcgggggcggccgggggcgggcgccgcggtcaagcgagcgcgcggtgggcgggcggcggccgcgggttcgggcgggccggggcccaggcgcgcatcccggccggcccgtgcgcgctgcgtccgtgcgcccgg

SEQ ID NO: 7270 - DNA, 45 bp, Homo sapiens
  misc_feature 1..45: note = chr4:6565004-6565049
  misc_feature 1..45: note = hyper
  source 1..45: mol_type = genomic DNA
gttccctcaagaccccgagagcacgcgctccggagggaccccggc

SEQ ID NO: 7271 - DNA, 101 bp, Homo sapiens
  misc_feature 1..101: note = chr4:7194437-7194538
  misc_feature 1..101: note = hyper
  source 1..101: mol_type = genomic DNA
ccggggctccgccgccgccgcgctcgccgcgctcgcggccgctcctgctgctgctgctgctgctgggcgcctgcggggcggcggggcgctcccctgagccc

SEQ ID NO: 7272 - DNA, 30 bp, Homo sapiens
  misc_feature 1..30: note = chr4:7195153-7195183
  misc_feature 1..30: note = hyper
  source 1..30: mol_type = genomic DNA
ggaccccagaaccttcggaagcctgcaggt

SEQ ID NO: 7273 - DNA, 38 bp, Homo sapiens
  misc_feature 1..38: note = chr4:8271520-8271558
  misc_feature 1..38: note = hyper
  source 1..38: mol_type = genomic DNA
tggggatgcccctgccgccctgacgcccgccagcctga

SEQ ID NO: 7274 - DNA, 290 bp, Homo sapiens; identical to SEQ ID NO: 350
  misc_feature 1..290: note = chr4:8858758-8859048
  misc_feature 1..290: note = hyper
  source 1..290: mol_type = genomic DNA

SEQ ID NO: 7275 - DNA, 557 bp, Homo sapiens; identical to SEQ ID NO: 351
  misc_feature 1..557: note = chr4:8859381-8859938
  misc_feature 1..557: note = hyper
  source 1..557: mol_type = genomic DNA

SEQ ID NO: 7276 - DNA, 30 bp, Homo sapiens
  misc_feature 1..30: note = chr4:8860523-8860553
  misc_feature 1..30: note = hyper
  source 1..30: mol_type = genomic DNA
aaactctcggagcatcgtcactgggaggtc

SEQ ID NO: 7277 - DNA, 66 bp, Homo sapiens
  misc_feature 1..66: note = chr4:8861687-8861753
  misc_feature 1..66: note = hyper
  source 1..66: mol_type = genomic DNA
ggaggcacaactgcccgtggtgggagtggagggcttaggtccccattagaaccggcagagccccga

SEQ ID NO: 7278 - DNA, 96 bp, Homo sapiens
  misc_feature 1..96: note = chr4:8861918-8862014
  misc_feature 1..96: note = hyper
  source 1..96: mol_type = genomic DNA
cgccaaatggaagtgggggcgccccctggcctttcctatacccggggccaaaaccgctgggaccgatatactgcaggagtccgggcacaggctgag

SEQ ID NO: 7279 - DNA, 408 bp, Homo sapiens
  misc_feature 1..408: note = chr4:8862404-8862812
  misc_feature 1..408: note = hyper
  source 1..408: mol_type = genomic DNA
ccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtc

SEQ ID NO: 7280 - DNA, 155 bp, Homo sapiens
  misc_feature 1..155: note = chr4:8863372-8863527
  misc_feature 1..155: note = hyper
  source 1..155: mol_type = genomic DNA
cgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcgggg

SEQ ID NO: 7281 - DNA, 55 bp, Homo sapiens
  misc_feature 1..55: note = chr4:8864543-8864598
  misc_feature 1..55: note = hyper
  source 1..55: mol_type = genomic DNA
gtgaggctggctcttcgaccacttagctgttctcggcgcccgatcctgtgtgtcc

SEQ ID NO: 7282 - DNA, 106 bp, Homo sapiens
  misc_feature 1..106: note = chr4:8868710-8868816
  misc_feature 1..106: note = hyper
  source 1..106: mol_type = genomic DNA
agggacggcacccagcgcagcttgagctgtctctgccctcgtgatcacaaagcagtgaaactgtccagaaaatgtccctttttattccatacgcaaataagtagat

SEQ ID NO: 7283 - DNA, 156 bp, Homo sapiens; identical to SEQ ID NO: 352
  misc_feature 1..156: note = chr4:8869115-8869271
  misc_feature 1..156: note = hyper
  source 1..156: mol_type = genomic DNA

SEQ ID NO: 7284 - DNA, 445 bp, Homo sapiens; identical to SEQ ID NO: 353
  misc_feature 1..445: note = chr4:8869368-8869813
  misc_feature 1..445: note = hyper
  source 1..445: mol_type = genomic DNA

SEQ ID NO: 7285 - DNA, 30 bp, Homo sapiens
  misc_feature 1..30: note = chr4:8872946-8872976
  misc_feature 1..30: note = hyper
  source 1..30: mol_type = genomic DNA
tgtcaggactgaggccgcctccatagccac

SEQ ID NO: 7286 - DNA, 211 bp, Homo sapiens
  misc_feature 1..211: note = chr4:8873773-8873984
  misc_feature 1..211: note = hyper
  source 1..211: mol_type = genomic DNA
gggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgt

SEQ ID NO: 7287 - DNA, 59 bp, Homo sapiens
  misc_feature 1..59: note = chr4:8874476-8874535
  misc_feature 1..59: note = hyper
  source 1..59: mol_type = genomic DNA
ctcccatatctgcagcgggaagttcgggaacataacgcaccctggagctgtctccgttc

SEQ ID NO: 7288 - DNA, 124 bp, Homo sapiens
  misc_feature 1..124: note = chr4:8875773-8875897
  misc_feature 1..124: note = hyper
  source 1..124: mol_type = genomic DNA
ggtggtggccctgagcgcataacgctcgcgggtgtcttcccactgcctctggggggcgcgcatgagaggggcgcttccacacactgccgcgtggggcctgggatgggagcgaagaggggcggtg

SEQ ID NO: 7289 - DNA, 76 bp, Homo sapiens
  misc_feature 1..76: note = chr4:8878569-8878645
  misc_feature 1..76: note = hyper
  source 1..76: mol_type = genomic DNA
ttagtctgatccccacgtcgcagccagcaggaaatgtccttgcagctgtggagatgtggatcggaactagggcacc

SEQ ID NO: 7290 - DNA, 60 bp, Homo sapiens
  misc_feature 1..60: note = chr4:8879491-8879551
  misc_feature 1..60: note = hyper
  source 1..60: mol_type = genomic DNA
cctggagcctggaaccgccggggccagctgagaagccgcctccgccgctggagtccctgg

SEQ ID NO: 7291 - DNA, 41 bp, Homo sapiens
  misc_feature 1..41: note = chr4:8893958-8893999
  misc_feature 1..41: note = hyper
  source 1..41: mol_type = genomic DNA
gggttgcatgggacccgcggttaccccgcaaacacagacgc

SEQ ID NO: 7292 - DNA, 116 bp, Homo sapiens; identical to SEQ ID NO: 2374
  misc_feature 1..116: note = chr4:8894842-8894958
  misc_feature 1..116: note = hyper
  source 1..116: mol_type = genomic DNA

SEQ ID NO: 7293 - DNA, 134 bp, Homo sapiens; identical to SEQ ID NO: 2375
  misc_feature 1..134: note = chr4:8895964-8896098
  misc_feature 1..134: note = hyper
  source 1..134: mol_type = genomic DNA

SEQ ID NO: 7294 - DNA, 205 bp, Homo sapiens; identical to SEQ ID NO: 2376
  misc_feature 1..205: note = chr4:8896117-8896322
  misc_feature 1..205: note = hyper
  source 1..205: mol_type = genomic DNA

SEQ ID NO: 7295 - DNA, 139 bp, Homo sapiens
  misc_feature 1..139: note = chr4:9783202-9783341
  misc_feature 1..139: note = hyper
  source 1..139: mol_type = genomic DNA
gctcggggggcgggacgcggggcctgggagcggccagggaccgcggcagcgcctcagtgccagcctggcgcccgcgactgcctgccccagcccctcagtggcggcttgctctcttctctcgctccgaaccagacacagc

SEQ ID NO: 7296 - DNA, 726 bp, Homo sapiens; identical to SEQ ID NO: 2377
  misc_feature 1..726: note = chr4:10458395-10459121
  misc_feature 1..726: note = hyper
  source 1..726: mol_type = genomic DNA

SEQ ID NO: 7297 - DNA, 273 bp, Homo sapiens; identical to SEQ ID NO: 354
  misc_feature 1..273: note = chr4:10462775-10463048
  misc_feature 1..273: note = hyper
  source 1..273: mol_type = genomic DNA

SEQ ID NO: 7298 - DNA, 184 bp, Homo sapiens; identical to SEQ ID NO: 355
  misc_feature 1..184: note = chr4:10463072-10463256
  misc_feature 1..184: note = hyper
  source 1..184: mol_type = genomic DNA

SEQ ID NO: 7299 - DNA, 280 bp, Homo sapiens; identical to SEQ ID NO: 356
  misc_feature 1..280: note = chr4:10463257-10463537
  misc_feature 1..280: note = hyper
  source 1..280: mol_type = genomic DNA

SEQ ID NO: 7300 - DNA, 51 bp, Homo sapiens
  misc_feature 1..51: note = chr4:11429636-11429687
  misc_feature 1..51: note = hyper
  source 1..51: mol_type = genomic DNA
tccctcacctccatccgctgccactacccaagggcccggaaatagaaaacc

SEQ ID NO: 7301 - DNA, 30 bp, Homo sapiens
  misc_feature 1..30: note = chr4:13523948-13523978
  misc_feature 1..30: note = hyper
  source 1..30: mol_type = genomic DNA
tccctaccttcctcccgagggagaggcaga

SEQ ID NO: 7302 - DNA, 64 bp, Homo sapiens
  misc_feature 1..64: note = chr4:13524188-13524252
  misc_feature 1..64: note = hyper
  source 1..64: mol_type = genomic DNA
tccgcaagaagaaggcggcctccgggtgtcggccgcagccaggctactgtgctccggggcaaac

SEQ ID NO: 7303 - DNA, 69 bp, Homo sapiens
  misc_feature 1..69: note = chr4:13537673-13537742
  misc_feature 1..69: note = hyper
  source 1..69: mol_type = genomic DNA
cggcaccagggactgcgagcaggggcatggagtgggagggaaagctgaggagagcgggctttgagcctg

SEQ ID NO: 7304 - DNA, 83 bp, Homo sapiens; identical to SEQ ID NO: 357
  misc_feature 1..83: note = chr4:13545940-13546023
  misc_feature 1..83: note = hyper
  source 1..83: mol_type = genomic DNA

SEQ ID NO: 7305 - DNA, 86 bp, Homo sapiens
  misc_feature 1..86: note = chr4:13546466-13546552
  misc_feature 1..86: note = hyper
  source 1..86: mol_type = genomic DNA
tcgcctgcaggatttcgctcctggcccgtcctccccttccctgctgggcaggctcttccggagcccacccccggcggcggcggcgg

SEQ ID NO: 7306 - DNA, 35 bp, Homo sapiens; identical to SEQ ID NO: 358
  misc_feature 1..35: note = chr4:13548555-13548590
  misc_feature 1..35: note = hyper
  source 1..35: mol_type = genomic DNA

SEQ ID NO: 7307 - DNA, 328 bp, Homo sapiens; identical to SEQ ID NO: 359
  misc_feature 1..328: note = chr4:13548634-13548962
  misc_feature 1..328: note = hyper
  source 1..328: mol_type = genomic DNA

SEQ ID NO: 7308 - DNA, 30 bp, Homo sapiens
  misc_feature 1..30: note = chr4:13549282-13549312
  misc_feature 1..30: note = hyper
  source 1..30: mol_type = genomic DNA
ttcggtccccggaaccgcccgggctggggg

SEQ ID NO: 7309 - DNA, 89 bp, Homo sapiens
  misc_feature 1..89: note = chr4:13549546-13549635
  misc_feature 1..89: note = hyper
  source 1..89: mol_type = genomic DNA
ccagcggccggaggtcgcgcgcgccgggtgctgcccagcaacgaaaggccatgcggggttcgtccctcagatgccggtgaccttgattg

SEQ ID NO: 7310 - DNA, 145 bp, Homo sapiens
  misc_feature 1..145: note = chr4:15780307-15780452
  misc_feature 1..145: note = hyper
  source 1..145: mol_type = genomic DNA
gggacagcagggccccgcgcgcagggaagccgcccggatcgcccggaaccgggcatcttccgtggcgggtcagccgagagcccgccgggtggtgctgagtagggagtcccgggctcggggctccgcgggccgctttcaggagcag

SEQ ID NO: 7311 - DNA, 30 bp, Homo sapiens
  misc_feature 1..30: note = chr4:16083935-16083965
  misc_feature 1..30: note = hyper
  source 1..30: mol_type = genomic DNA
cccaacatatcgcagcggttgttcgtgtcg

SEQ ID NO: 7312 - DNA, 60 bp, Homo sapiens
  misc_feature 1..60: note = chr4:16084408-16084468
  misc_feature 1..60: note = hyper
  source 1..60: mol_type = genomic DNA
ttcctccctccgatccgactccctgcccctccagacacgggctttcggggaaactgatcc

SEQ ID NO: 7313 - DNA, 78 bp, Homo sapiens; identical to SEQ ID NO: 2384
  misc_feature 1..78: note = chr4:16084741-16084819
  misc_feature 1..78: note = hyper
  source 1..78: mol_type = genomic DNA

SEQ ID NO: 7314 - DNA, 14 bp, Homo sapiens
  misc_feature 1..14: note = chr4:16085166-16085180
  misc_feature 1..14: note = hyper
  source 1..14: mol_type = genomic DNA
cgcagagcgaaccc

SEQ ID NO: 7315 - DNA, 121 bp, Homo sapiens; identical to SEQ ID NO: 2386
  misc_feature 1..121: note = chr4:16085181-16085302
  misc_feature 1..121: note = hyper
  source 1..121: mol_type = genomic DNA

SEQ ID NO: 7316 - DNA, 48 bp, Homo sapiens; identical to SEQ ID NO: 2387
  misc_feature 1..48: note = chr4:16085351-16085399
  misc_feature 1..48: note = hyper
  source 1..48: mol_type = genomic DNA

SEQ ID NO: 7317 - DNA, 26 bp, Homo sapiens
  misc_feature 1..26: note = chr4:16085674-16085700
  misc_feature 1..26: note = hyper
  source 1..26: mol_type = genomic DNA
cgagccctggacgcactctgattgga

SEQ ID NO: 7318 - DNA, 291 bp, Homo sapiens; identical to SEQ ID NO: 2388
  misc_feature 1..291: note = chr4:17783003-17783294
  misc_feature 1..291: note = hyper
  source 1..291: mol_type = genomic DNA

SEQ ID NO: 7319 - DNA, 27 bp, Homo sapiens
  misc_feature 1..27: note = chr4:17783295-17783322
  misc_feature 1..27: note = hyper
  source 1..27: mol_type = genomic DNA
gtgggcgggcactgcgctcttggacac

SEQ ID NO: 7320 - DNA, 158 bp, Homo sapiens; identical to SEQ ID NO: 2390
  misc_feature 1..158: note = chr4:17783323-17783481
  misc_feature 1..158: note = hyper
  source 1..158: mol_type = genomic DNA

SEQ ID NO: 7321 - DNA, 30 bp, Homo sapiens
  misc_feature 1..30: note = chr4:20253853-20253883
  misc_feature 1..30: note = hyper
  source 1..30: mol_type = genomic DNA
ttccttccagacaagcgagacttgggctgc

SEQ ID NO: 7322 - DNA, 40 bp, Homo sapiens
  misc_feature 1..40: note = chr4:20254263-20254303
  misc_feature 1..40: note = hyper
  source 1..40: mol_type = genomic DNA
ccatcaggtgtctgccgcggagctgcggcttatctgggag

SEQ ID NO: 7323 - DNA, 51 bp, Homo sapiens
  misc_feature 1..51: note = chr4:20255045-20255096
  misc_feature 1..51: note = hyper
  source 1..51: mol_type = genomic DNA
cctccccacaacaaccggcccctgcatcttagcagccgttggaagccccag

SEQ ID NO: 7324 - DNA, 675 bp, Homo sapiens
  misc_feature 1..675: note = chr4:20255611-20256286
  misc_feature 1..675: note = hyper
  source 1..675: mol_type = genomic DNA
gagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcag

SEQ ID NO: 7325 - DNA, 28 bp, Homo sapiens
  misc_feature 1..28: note = chr4:20256841-20256869
  misc_feature 1..28: note = hyper
  source 1..28: mol_type = genomic DNA
gctctgacccgcacgtctccacccgcgc

SEQ ID NO: 7326 - DNA, 48 bp, Homo sapiens
  misc_feature 1..48: note = chr4:21950248-21950296
  misc_feature 1..48: note = hyper
  source 1..48: mol_type = genomic DNA
attcatgtctagggacgcagggtgcagaagcgagactcgagagtccac

SEQ ID NO: 7327 - DNA, 122 bp, Homo sapiens
  misc_feature 1..122: note = chr4:30720054-30720176
  misc_feature 1..122: note = hyper
  source 1..122: mol_type = genomic DNA
cgctacatctgctcgttgactttattggtgtttgtcttgtttaaatcattctgcctcgtcacccaggtctcgtaaagaatacccacactggacagattttattttttcggctttaaattttt

SEQ ID NO: 7328 - DNA, 161 bp, Homo sapiens
  misc_feature 1..161: note = chr4:30724292-30724453
  misc_feature 1..161: note = hyper
  source 1..161: mol_type = genomic DNA
atccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagct

SEQ ID NO: 7329 - DNA, 45 bp, Homo sapiens; identical to SEQ ID NO: 2391
  misc_feature 1..45: note = chr4:37245537-37245582
  misc_feature 1..45: note = hyper
  source 1..45: mol_type = genomic DNA

SEQ ID NO: 7330 - DNA, 525 bp, Homo sapiens; identical to SEQ ID NO: 2392
  misc_feature 1..525: note = chr4:37245836-37246361
  misc_feature 1..525: note = hyper
  source 1..525: mol_type = genomic DNA

SEQ ID NO: 7331 - DNA, 211 bp, Homo sapiens; identical to SEQ ID NO: 2393
  misc_feature 1..211: note = chr4:37246489-37246700
  misc_feature 1..211: note = hyper
  source 1..211: mol_type = genomic DNA

SEQ ID NO: 7332 - DNA, 111 bp, Homo sapiens; identical to SEQ ID NO: 2394
  misc_feature 1..111: note = chr4:37247015-37247126
  misc_feature 1..111: note = hyper
  source 1..111: mol_type = genomic DNA

SEQ ID NO: 7333 - DNA, 37 bp, Homo sapiens
  misc_feature 1..37: note = chr4:37247355-37247392
  misc_feature 1..37: note = hyper
  source 1..37: mol_type = genomic DNA
cagacttttgtgaaccggaggtcgagggggacaccct

SEQ ID NO: 7334 - DNA, 80 bp, Homo sapiens
  misc_feature 1..80: note = chr4:39047287-39047367
  misc_feature 1..80: note = hyper
  source 1..80: mol_type = genomic DNA
gggatcagaagctggcggtaaaagtttgctatgtcagagagtaaagcgttactgtcgttttttatcgcttcatttcattt

SEQ ID NO: 7335 - DNA, 73 bp, Homo sapiens; identical to SEQ ID NO: 360
  misc_feature 1..73: note = chr4:41258716-41258789
  misc_feature 1..73: note = hyper
  source 1..73: mol_type = genomic DNA

SEQ ID NO: 7336 - DNA, 381 bp, Homo sapiens; identical to SEQ ID NO: 361
  misc_feature 1..381: note = chr4:41259085-41259466
  misc_feature 1..381: note = hyper
  source 1..381: mol_type = genomic DNA

SEQ ID NO: 7337 - DNA, 403 bp, Homo sapiens
  misc_feature 1..403: note = chr4:41746833-41747236
  misc_feature 1..403: note = hyper
  source 1..403: mol_type = genomic DNA
tgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatggcgggatggtgttcagcgaggtgggacaggcaagggggtgcgagaaagtcactccggccgccgggacagtctgagcaagtcgtcgccgcagtgacccgaacccaaggacacgataggaaggggggctggaacggcgtccctactcttccctgaagaagagccccaagagaatccgtgctgttaggagggagcggatttaggggttcacaagatcgagccttcagctcc

SEQ ID NO: 7338 - DNA, 124 bp, Homo sapiens
  misc_feature 1..124: note = chr4:41747888-41748012
  misc_feature 1..124: note = hyper
  source 1..124: mol_type = genomic DNA
cgctggcgaagggacccccaagcgaatccgggatggaggtgatggggccggggccgggagcccagccttgtccagggcccccagccgcagccaggcctccagctgccgccgctgccgctgccgc

SEQ ID NO: 7339 - DNA, 194 bp, Homo sapiens
  misc_feature 1..194: note = chr4:41748143-41748337
  misc_feature 1..194: note = hyper
  source 1..194: mol_type = genomic DNA
cgcagctgggggtggggttgggattgggacctgggcccccagtgctgtccgggtcagtgctcttggcctctttgctctcgtcgtccctggaagagtcagactttttgcccgaggagccgttcttggccgcggccgctgcggctgccgctgcgcgctcctgcttgcgaaacttggcgcggcggttctggaaccac

SEQ ID NO: 7340 - DNA, 266 bp, Homo sapiens
  misc_feature 1..266: note = chr4:41749474-41749740
  misc_feature 1..266: note = hyper
  source 1..266: mol_type = genomic DNA
ctggtgaaagtggtgcggatgcgccgctgcttgcgcttctcgttgaggccgccgtggtccgtgaagagtttgtaaggaactagagtatgacagaggagacagaaagtgagcaaatcagccggcagctcgccggccgtggagctagaatgtgaggactccaaggtcaggtcatacggcagccgctacctacacccgcgcgagagagttgccgagagaagctgcgggaagaaaccgaggaaatttgttatctgcggaaacctgggctc

SEQ ID NO: 7341 - DNA, 333 bp, Homo sapiens; identical to SEQ ID NO: 362
  misc_feature 1..333: note = chr4:41750266-41750599
  misc_feature 1..333: note = hyper
  source 1..333: mol_type = genomic DNA

SEQ ID NO: 7342 - DNA, 30 bp, Homo sapiens
  misc_feature 1..30: note = chr4:41751870-41751900
  misc_feature 1..30: note = hyper
  source 1..30: mol_type = genomic DNA
gcaagggctccaggtcgggcacctttcttg

SEQ ID NO: 7343 - DNA, 758 bp, Homo sapiens; identical to SEQ ID NO: 2398
  misc_feature 1..758: note = chr4:41752954-41753712
  misc_feature 1..758: note = hyper
  source 1..758: mol_type = genomic DNA

SEQ ID NO: 7344 - DNA, 90 bp, Homo sapiens; identical to SEQ ID NO: 2399
  misc_feature 1..90: note = chr4:41753713-41753803
  misc_feature 1..90: note = hyper
  source 1..90: mol_type = genomic DNA

SEQ ID NO: 7345 - DNA, 113 bp, Homo sapiens; identical to SEQ ID NO: 2400
  misc_feature 1..113: note = chr4:41753804-41753917
  misc_feature 1..113: note = hyper
  source 1..113: mol_type = genomic DNA

SEQ ID NO: 7346 - DNA, 41 bp, Homo sapiens; identical to SEQ ID NO: 2401
  misc_feature 1..41: note = chr4:41754030-41754071
  misc_feature 1..41: note = hyper
  source 1..41: mol_type = genomic DNA

SEQ ID NO: 7347 - DNA, 32 bp, Homo sapiens
  misc_feature 1..32: note = chr4:41867804-41867836
  misc_feature 1..32: note = hyper
  source 1..32: mol_type = genomic DNA
caataaaggagagcgcgcggaaatgggacttc

SEQ ID NO: 7348 - DNA, 341 bp, Homo sapiens; identical to SEQ ID NO: 363
  misc_feature 1..341: note = chr4:41875410-41875751
  misc_feature 1..341: note = hyper
  source 1..341: mol_type = genomic DNA

SEQ ID NO: 7349 - DNA, 46 bp, Homo sapiens; identical to SEQ ID NO: 2403
  misc_feature 1..46: note = chr4:41881385-41881431
  misc_feature 1..46: note = hyper
  source 1..46: mol_type = genomic DNA

SEQ ID NO: 7350 - DNA, 689 bp, Homo sapiens; identical to SEQ ID NO: 364
  misc_feature 1..689: note = chr4:41882935-41883624
  misc_feature 1..689: note = hyper
  source 1..689: mol_type = genomic DNA

SEQ ID NO: 7351 - DNA, 60 bp, Homo sapiens
  misc_feature 1..60: note = chr4:41883886-41883946
  misc_feature 1..60: note = hyper
  source 1..60: mol_type = genomic DNA
ccccggagaccccaccgagcccagcgcccgcccccgccccctgggcgccctgccccattt

SEQ ID NO: 7352 - DNA, 82 bp, Homo sapiens
  misc_feature 1..82: note = chr4:41884164-41884246
  misc_feature 1..82: note = hyper
  source 1..82: mol_type = genomic DNA
cccctcccccacccccggaggcgggtgcagtgcagggcgggggcggcggtcgcagcggctcagaagccgaccctccttgaac

SEQ ID NO: 7353 - DNA, 451 bp, Homo sapiens; identical to SEQ ID NO: 365
  misc_feature 1..451: note = chr4:42152961-42153412
  misc_feature 1..451: note = hyper
  source 1..451: mol_type = genomic DNA

SEQ ID NO: 7354 - DNA, 101 bp, Homo sapiens; identical to SEQ ID NO: 366
  misc_feature 1..101: note = chr4:42153532-42153633
  misc_feature 1..101: note = hyper
  source 1..101: mol_type = genomic DNA

SEQ ID NO: 7355 - DNA, 504 bp, Homo sapiens; identical to SEQ ID NO: 367
  misc_feature 1..504: note = chr4:42153881-42154385
  misc_feature 1..504: note = hyper
  source 1..504: mol_type = genomic DNA

SEQ ID NO: 7356 - DNA, 611 bp, Homo sapiens; identical to SEQ ID NO: 368
  misc_feature 1..611: note = chr4:42154386-42154997
  misc_feature 1..611: note = hyper
  source 1..611: mol_type = genomic DNA

SEQ ID NO: 7357 - DNA, 346 bp, Homo sapiens
  misc_feature 1..346: note = chr4:42399099-42399445
  misc_feature 1..346: note = hyper
  source 1..346: mol_type = genomic DNA
cttcaatgactgcaccgcattcatgcattatatccattgaaaagtaaatccagcgtctccactcgcgcgcccacgtgcgtggataaacgcgggaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaa

SEQ ID NO: 7358 - DNA, 743 bp, Homo sapiens
  misc_feature 1..743: note = chr4:42399735-42400478
  misc_feature 1..743: note = hyper
  source 1..743: mol_type = genomic DNA
tggccggggggttggcgcgcccctcgcgcggggagcgctatgagccgggcgaagggcggcagcgacagccccagcaactgcctctgccggcgcctcccgcaggccctcgccaactcgccccgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcg

SEQ ID NO: 7359 - DNA, 147 bp, Homo sapiens
  misc_feature 1..147: note = chr4:42400901-42401048
  misc_feature 1..147: note = hyper
  source 1..147: mol_type = genomic DNA
ttcaattctctgcatcgaattaccctctccggcccaccccctattgtcacgcctttcagaaatgcccaggtcttcgaggtggagatttagaaacaagggtcgaaggggcttccccgccccctattctcacttcggaaaacacgggtc

SEQ ID NO: 7360 - DNA, 30 bp, Homo sapiens
  misc_feature 1..30: note = chr4:44449013-44449043
  misc_feature 1..30: note = hyper
  source 1..30: mol_type = genomic DNA
tgggggcacctttatcgcttctcccctgcc

SEQ ID NO: 7361 - DNA, 27 bp, Homo sapiens
  misc_feature 1..27: note = chr4:44449652-44449679
  misc_feature 1..27: note = hyper
  source 1..27: mol_type = genomic DNA
cgaggagttacacgccaccatgtggaa

SEQ ID NO: 7362 - DNA, 127 bp, Homo sapiens; identical to SEQ ID NO: 2409
  misc_feature 1..127: note = chr4:44450050-44450177
  misc_feature 1..127: note = hyper
  source 1..127: mol_type = genomic DNA

SEQ ID NO: 7363 - DNA, 223 bp, Homo sapiens; identical to SEQ ID NO: 2410
  misc_feature 1..223: note = chr4:44450741-44450964
  misc_feature 1..223: note = hyper
  source 1..223: mol_type = genomic DNA

SEQ ID NO: 7364 - DNA, 660 bp, Homo sapiens; identical to SEQ ID NO: 2411
  misc_feature 1..660: note = chr4:46995161-46995821
  misc_feature 1..660: note = hyper
  source 1..660: mol_type = genomic DNA

SEQ ID NO: 7365 - DNA, 567 bp, Homo sapiens; identical to SEQ ID NO: 2412
  misc_feature 1..567: note = chr4:46995822-46996389
  misc_feature 1..567: note = hyper
  source 1..567: mol_type = genomic DNA

SEQ ID NO: 7366 - DNA, 341 bp, Homo sapiens
  misc_feature 1..341: note = chr4:47034412-47034753
  misc_feature 1..341: note = hyper
  source 1..341: mol_type = genomic DNA
tgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgcc

SEQ ID NO: 7367 - DNA, 184 bp, Homo sapiens
  misc_feature 1..184: note = chr4:47034754-47034938
  misc_feature 1..184: note = hyper
  source 1..184: mol_type = genomic DNA
tggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggcaatccccatggccctcgcagtccgcgagcc

SEQ ID NO: 7368 - DNA, 16 bp, Homo sapiens
  misc_feature 1..16: note = chr4:48485273-48485289
  misc_feature 1..16: note = hyper
  source 1..16: mol_type = genomic DNA
ttcacaggaggggacc

SEQ ID NO: 7369 - DNA, 216 bp, Homo sapiens; identical to SEQ ID NO: 2414
  misc_feature 1..216: note = chr4:48485589-48485805
  misc_feature 1..216: note = hyper
  source 1..216: mol_type = genomic DNA

SEQ ID NO: 7370 - DNA, 114 bp, Homo sapiens
  misc_feature 1..114: note = chr4:48987949-48988063
  misc_feature 1..114: note = hyper
  source 1..114: mol_type = genomic DNA
cctcgcagagcaccccgtgggcctagtctaaacgagggcaccactggtccggagttgcacttgttcgctccctcctgggctctggcagcgctgcatccccggggttgcttcggg

SEQ ID NO: 7371 - DNA, 30 bp, Homo sapiens
  misc_feature 1..30: note = chr4:48988465-48988495
  misc_feature 1..30: note = hyper
  source 1..30: mol_type = genomic DNA
aaatcctcttggagtcgctgctgggtaagc

SEQ ID NO: 7372 - DNA, 88 bp, Homo sapiens
  misc_feature 1..88: note = chr4:53617427-53617515
  misc_feature 1..88: note = hyper
  source 1..88: mol_type = genomic DNA
aagctcgaggggacacggggcgagcccagaccctgcctgggagccctccccgccggagaccaaagggcagaaacgcactcacagtgca

SEQ ID NO: 7373 - DNA, 30 bp, Homo sapiens
  misc_feature 1..30: note = chr4:53728192-53728222
  misc_feature 1..30: note = hyper
  source 1..30: mol_type = genomic DNA
ctctcttcctggccccgcagccacagcagc

SEQ ID NO: 7374 - DNA, 112 bp, Homo sapiens
  misc_feature 1..112: note = chr4:53728705-53728817
  misc_feature 1..112: note = hyper
  source 1..112: mol_type = genomic DNA
ccgagtaccccgcgccgggcaacgccgcggcctccgactgctgtgtgggcgccgccggccgccgcctggtcaagatcgccgtggtgggcgccagcggcgtgggcaagaccgg

SEQ ID NO: 7375 - DNA, 78 bp, Homo sapiens
  misc_feature 1..78: note = chr4:54965843-54965921
  misc_feature 1..78: note = hyper
  source 1..78: mol_type = genomic DNA
cgactgccagtccgtcgcccgcacaatcctgctccaaaccgcaggcctcacacttcaccgcgccgcagccacccctac

SEQ ID NO: 7376 - DNA, 450 bp, Homo sapiens
  misc_feature 1..450: note = chr4:54966521-54966971
  misc_feature 1..450: note = hyper
  source 1..450: mol_type = genomic DNA
ccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcag

SEQ ID NO: 7377 - DNA, 162 bp, Homo sapiens; identical to SEQ ID NO: 2415
  misc_feature 1..162: note = chr4:54967330-54967492
  misc_feature 1..162: note = hyper
  source 1..162: mol_type = genomic DNA

SEQ ID NO: 7378 - DNA, 682 bp, Homo sapiens
  misc_feature 1..682: note = chr4:54969833-54970515
  misc_feature 1..682: note = hyper
  source 1..682: mol_type = genomic DNA
aggaaaatccctcttcgttccgtcaagggacatagggaggagggcccgcactgtgtgaggctgaaaagggagctgccggcgctttgtgcaatgtgctgagctctgtcctgcgcagaggtcccagacagccggctcactactgcctggcctgggaagctcaggcctctggatctctttcctcctgtctctcacgcgcagagctccgggctcttcgccctgcccgccacgaaagggaggaggcgcaggccggctgcctttccaaaagattctgtctcccttcttcccaagaagcaggcctctccgcgcgcgagaacagaggtgggaggacgggagtttgcaggcgcaaagaacaggagtttaagcagactatttccaccaggggaaataagaagcacaaagagcgcctgctgcagctctttgcgctcttgcccaaagctaagcttcctctgggctgtggggagactcctctggtccccgttccatctacccagcccggcccctctggggctcagcgcttgggtttagccctcccctatgtccatgactagccccgatcacagtctcttaagcctctcccggcccccggctcccaggccctgcggagccaagcacttggaacaccaggtaccgcgcgcggtggacccagctctgccatgccgcagatagccgcagtgccaaccct

SEQ ID NO: 7379 - DNA, 130 bp, Homo sapiens; identical to SEQ ID NO: 369
  misc_feature 1..130: note = chr4:54975802-54975932
  misc_feature 1..130: note = hyper
  source 1..130: mol_type = genomic DNA

SEQ ID NO: 7380 - DNA, 126 bp, Homo sapiens; identical to SEQ ID NO: 370
  misc_feature 1..126: note = chr4:54975990-54976116
  misc_feature 1..126: note = hyper
  source 1..126: mol_type = genomic DNA

SEQ ID NO: 7381 - DNA, 30 bp, Homo sapiens
  misc_feature 1..30: note = chr4:55093200-55093230
  misc_feature 1..30: note = hyper
  source 1..30: mol_type = genomic DNA
gtttaaggaaccaaccgcctcggttcgagg

SEQ ID NO: 7382 - DNA, 15 bp, Homo sapiens
  misc_feature 1..15: note = chr4:55093818-55093833
  misc_feature 1..15: note = hyper
  source 1..15: mol_type = genomic DNA
ttttgccttttattc

SEQ ID NO: 7383 - DNA, 123 bp, Homo sapiens
  misc_feature 1..123: note = chr4:55093888-55094011
  misc_feature 1..123: note = hyper
  source 1..123: mol_type = genomic DNA
cggtatcctgttagcattccgaacaaggggctgttcatatatttgccttcaatgatttcctgaagggacatgtggaagtaatagcgagcggtgcagtcacccaagctgaagatgcacgagagc

SEQ ID NO: 7384 - DNA, 63 bp, Homo sapiens
  misc_feature 1..63: note = chr4:55094012-55094075
  misc_feature 1..63: note = hyper
  source 1..63: mol_type = genomic DNA
ggtcgcgtagaagaactgcggcaatgggacccccagcgcagccccaggcgccctgttttcgag

SEQ ID NO: 7385 - DNA, 33 bp, Homo sapiens
  misc_feature 1..33: note = chr4:55096239-55096272
  misc_feature 1..33: note = hyper
  source 1..33: mol_type = genomic DNA
cgcgtgattactggacggcgctgctctgggaga

SEQ ID NO: 7386 - DNA, 72 bp, Homo sapiens
  misc_feature 1..72: note = chr4:55096538-55096610
  misc_feature 1..72: note = hyper
  source 1..72: mol_type = genomic DNA
ggatttgaggaatttcgaaccgcacaccaaggggccctcattgtgctccgtggcccccgcccccgcctgtct

SEQ ID NO: 7387 - DNA, 30 bp, Homo sapiens
  misc_feature 1..30: note = chr4:55097411-55097441
  misc_feature 1..30: note = hyper
  source 1..30: mol_type = genomic DNA
gtccctaccgccccgcgtccgaaaagccgc

SEQ ID NO: 7388 - DNA, 107 bp, Homo sapiens
  misc_feature 1..107: note = chr4:55098637-55098744
  misc_feature 1..107: note = hyper
  source 1..107: mol_type = genomic DNA
cctactgcagtttctcggcccccgcgaaaggggagcgacaagcgcgggtgggcgcggactcttgagggggcagaggcggctatggcgcgtgtcgggcaaggtggcac

SEQ ID NO: 7389 - DNA, 131 bp, Homo sapiens
  misc_feature 1..131: note = chr4:55099042-55099173
  misc_feature 1..131: note = hyper
  source 1..131: mol_type = genomic DNA
gcgcccggccaggaacggttcttaaatgccgagagggcgcatgctagctctcctcagcattcccggtgagccgctacccacggccgtgcggctctcgtgcccataggaggcgctggcgagctcctgtaacc

SEQ ID NO: 7390 - DNA, 62 bp, Homo sapiens
  misc_feature 1..62: note = chr4:55523652-55523714
  misc_feature 1..62: note = hyper
  source 1..62: mol_type = genomic DNA
cacctccacgagcagcggcgtccagcctcctcccgcccgaacgtgctcgaggggcgggcagt

SEQ ID NO: 7391 - DNA, 30 bp, Homo sapiens
  misc_feature 1..30: note = chr4:55991067-55991097
  misc_feature 1..30: note = hyper
  source 1..30: mol_type = genomic DNA
cctgccaaccccaggcgccttcccacccca

SEQ ID NO: 7392 - DNA, 30 bp, Homo sapiens
  misc_feature 1..30: note = chr4:56501660-56501690
  misc_feature 1..30: note = hyper
  source 1..30: mol_type = genomic DNA
ctagtgcctgaaaaccgataaggcacaaag

SEQ ID NO: 7393 - DNA, 50 bp, Homo sapiens
  misc_feature 1..50: note = chr4:56659934-56659984
  misc_feature 1..50: note = hyper
  source 1..50: mol_type = genomic DNA
cgcactccccgggtatgctgcgggccctctccatccggggaggcggggtc

SEQ ID NO: 7394 - DNA, 16 bp, Homo sapiens
  misc_feature 1..16: note = chr4:57371852-57371868
  misc_feature 1..16: note = hyper
  source 1..16: mol_type = genomic DNA
ccgcgaggtaagcggc

SEQ ID NO: 7395 - DNA, 145 bp, Homo sapiens
  misc_feature 1..145: note = chr4:57371869-57372014
  misc_feature 1..145: note = hyper
  source 1..145: mol_type = genomic DNA
gttggcggcggtgccggggttggcagcgcccgcgggttgtctacgccgcggggcctacgtctctgtcgggcgtgcacctcgggagccacacctggggcccagagccaccgctcagcacgcgggcacgcggcgggagggaaggaaa

SEQ ID NO: 7396 - DNA, 171 bp, Homo sapiens
  misc_feature 1..171: note = chr4:57396480-57396651
  misc_feature 1..171: note = hyper
  source 1..171: mol_type = genomic DNA
acagggtcagcatctcgtctcctatctccaccgacctgtctctggcttttcttagtccccagatgcgcccagaaggtcctggagagtggtgcgtccccttggcaaccgtacaacgcgcaggaaggcggagtgagatgaggctgagtccggccggggcggggctgtgtggga

SEQ ID NO: 7397 - DNA, 110 bp, Homo sapiens
  misc_feature 1..110: note = chr4:57397172-57397282
  misc_feature 1..110: note = hyper
  source 1..110: mol_type = genomic DNA
aaactcctcaaggcccgtgaaccccgccagctccgccacacccgtgagccccgcaagtcccgcgaggccaaggaaaccgagttgcttcccagcgccgcagtaatgatctc

SEQ ID NO: 7398 - skipped

SEQ ID NO: 7399 - DNA, 159 bp, Homo sapiens; identical to SEQ ID NO: 372
  misc_feature 1..159: note = chr4:57521505-57521664
  misc_feature 1..159: note = hyper
  source 1..159: mol_type = genomic DNA

SEQ ID NO: 7400 - DNA, 683 bp, Homo sapiens; identical to SEQ ID NO: 373
  misc_feature 1..683: note = chr4:57521700-57522383
  misc_feature 1..683: note = hyper
  source 1..683: mol_type = genomic DNA

SEQ ID NO: 7401 - DNA, 396 bp, Homo sapiens; identical to SEQ ID NO: 374
  misc_feature 1..396: note = chr4:57522419-57522815
  misc_feature 1..396: note = hyper
  source 1..396: mol_type = genomic DNA

SEQ ID NO: 7402 - DNA, 50 bp, Homo sapiens
  misc_feature 1..50: note = chr4:57687669-57687719
  misc_feature 1..50: note = hyper
  source 1..50: mol_type = genomic DNA
gtcgccgaggccgcccggagcagggcagggtccgccgccggtctgactcc

SEQ ID NO: 7403 - DNA, 30 bp, Homo sapiens
  misc_feature 1..30: note = chr4:57976081-57976111
  misc_feature 1..30: note = hyper
  source 1..30: mol_type = genomic DNA
tctccccgcggctctcggccctctggctgg

SEQ ID NO: 7404 - DNA, 264 bp, Homo sapiens
  misc_feature 1..264: note = chr4:57976405-57976669
  misc_feature 1..264: note = hyper
  source 1..264: mol_type = genomic DNA
ccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggcccc

SEQ ID NO: 7405 - DNA, 30 bp, Homo sapiens
  misc_feature 1..30: note = chr4:57977077-57977107
  misc_feature 1..30: note = hyper
  source 1..30: mol_type = genomic DNA
actaaaaggacaaaccgttgccaaccactt

SEQ ID NO: 7406 - DNA, 18 bp, Homo sapiens
  misc_feature 1..18: note = chr4:62065800-62065818
  misc_feature 1..18: note = hyper
  source 1..18: mol_type = genomic DNA
cgccgaggcgggcctcga

SEQ ID NO: 7407 - DNA, 30 bp, Homo sapiens
  misc_feature 1..30: note = chr4:62066303-62066333
  misc_feature 1..30: note = hyper
  source 1..30: mol_type = genomic DNA
ccgccgcctgtgactcgccccctccccttt

SEQ ID NO: 7408 - DNA, 290 bp, Homo sapiens
  misc_feature 1..290: note = chr4:62066913-62067203
  misc_feature 1..290: note = hyper
  source 1..290: mol_type = genomic DNA
actggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcga

SEQ ID NO: 7409 - DNA, 184 bp, Homo sapiens; identical to SEQ ID NO: 2422
  misc_feature 1..184: note = chr4:62067440-62067624
  misc_feature 1..184: note = hyper
  source 1..184: mol_type = genomic DNA

SEQ ID NO: 7410 - DNA, 30 bp, Homo sapiens
  misc_feature 1..30: note = chr4:66535107-66535137
  misc_feature 1..30: note = hyper
  source 1..30: mol_type = genomic DNA
aaccgcagaggggagcgaaaaggccagtgg

SEQ ID NO: 7411 - DNA, 108 bp, Homo sapiens
  misc_feature 1..108: note = chr4:71600516-71600624
  misc_feature 1..108: note = hyper
  source 1..108: mol_type = genomic DNA
atactcttgcactagcgttggcttcagtgcactgtcattaaccacagtgccttacagtattttcttctattggtgagccttttctggacctttcgtgaaacagagctt

SEQ ID NO: 7412 - DNA, 39 bp, Homo sapiens
  misc_feature 1..39: note = chr4:73434048-73434087
  misc_feature 1..39: note = hyper
  source 1..39: mol_type = genomic DNA
agaacttcattcaagcgcccagaccgccctccagaaagg

SEQ ID NO: 7413 - DNA, 252 bp, Homo sapiens
  misc_feature 1..252: note = chr4:73434964-73435216
  misc_feature 1..252: note = hyper
  source 1..252: mol_type = genomic DNA
acgcagaggtgggggcgggaggagcgaaggggaggaggagaaggcaggcggaggaggtgggaggagtgggccgctcgccggctcctgttgctcgcagcgcggcagtctgctggctgctggcgacccgcggggcgctaataaggcgtccggagctccccggactgcccctcccgccgtggcgcccacgtcatgcggggcccgaacccgcgccccccgcaccgtgtcaggattggagaccgctcgggggctggt

SEQ ID NO: 7414 - DNA, 42 bp, Homo sapiens
  misc_feature 1..42: note = chr4:75231005-75231047
  misc_feature 1..42: note = hyper
  source 1..42: mol_type = genomic DNA
agcgcccgctcccatcgccgatgaccgcggggaggaggatgg

SEQ ID NO: 7415 - DNA, 45 bp, Homo sapiens
  misc_feature 1..45: note = chr4:76555668-76555713
  misc_feature 1..45: note = hyper
  source 1..45: mol_type = genomic DNA
ccaactacccctgggcgaaggcgttggccgcggagctgcaagggg

SEQ ID NO: 7416 - DNA, 218 bp, Homo sapiens; identical to SEQ ID NO: 2423
  misc_feature 1..218: note = chr4:81106163-81106381
  misc_feature 1..218: note = hyper
  source 1..218: mol_type = genomic DNA

SEQ ID NO: 7417 - DNA, 92 bp, Homo sapiens
  misc_feature 1..92: note = chr4:81123206-81123298
  misc_feature 1..92: note = hyper
  source 1..92: mol_type = genomic DNA
gggcaccaaggaccacgggggcggcggcggcggtggcaaagaccagcagcagcagcagcaggaggcacctttaggcccgggtcccaagtttt

SEQ ID NO: 7418 - DNA, 279 bp, Homo sapiens; identical to SEQ ID NO: 2424
  misc_feature 1..279: note = chr4:81123625-81123904
  misc_feature 1..279: note = hyper
  source 1..279: mol_type = genomic DNA

SEQ ID NO: 7419 - DNA, 347 bp, Homo sapiens; identical to SEQ ID NO: 2425
  misc_feature 1..347: note = chr4:81124121-81124468
  misc_feature 1..347: note = hyper
  source 1..347: mol_type = genomic DNA

SEQ ID NO: 7420 - DNA, 36 bp, Homo sapiens
  misc_feature 1..36: note = chr4:81124695-81124731
  misc_feature 1..36: note = hyper
  source 1..36: mol_type = genomic DNA
gaccccagctttccacgcgcgcgcaagcacagttaa

SEQ ID NO: 7421 - DNA, 363 bp, Homo sapiens
  misc_feature 1..363: note = chr4:81187040-81187403
  misc_feature 1..363: note = hyper
  source 1..363: mol_type = genomic DNA
cgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcaca

SEQ ID NO: 7422 - DNA, 16 bp, Homo sapiens
  misc_feature 1..16: note = chr4:81187782-81187798
  misc_feature 1..16: note = hyper
  source 1..16: mol_type = genomic DNA
gcgttataaatatccc

SEQ ID NO: 7423 - DNA, 271 bp, Homo sapiens
  misc_feature 1..271: note = chr4:81187799-81188070
  misc_feature 1..271: note = hyper
  source 1..271: mol_type = genomic DNA
gtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggca

SEQ ID NO: 7424 - DNA, 40 bp, Homo sapiens
  misc_feature 1..40: note = chr4:81188276-81188316
  misc_feature 1..40: note = hyper
  source 1..40: mol_type = genomic DNA
atctgcagatctacccggatggcaaagtcaatggatccca

SEQ ID NO: 7425 - DNA, 143 bp, Homo sapiens
  misc_feature 1..143: note = chr4:81188384-81188527
  misc_feature 1..143: note = hyper
  source 1..143: mol_type = genomic DNA
cgggagggacagcaggtattcgccgggacacaggctcaccttcctgagcccaggccactgggaccaagctgatactcagaaacagccgggcgggttgggtggagatgcatctatatggcgtgcgcacacgcacccctctcctg

SEQ ID NO: 7426 - DNA, 37 bp, Homo sapiens
  misc_feature 1..37: note = chr4:81189854-81189891
  misc_feature 1..37: note = hyper
  source 1..37: mol_type = genomic DNA
tgattcagcagcctgcggcgcacgtggtgagggcgcc

SEQ ID NO: 7427 - DNA, 214 bp, Homo sapiens
  misc_feature 1..214: note = chr4:81257025-81257239
  misc_feature 1..214: note = hyper
  source 1..214: mol_type = genomic DNA
acctggaggtaagggcggagcgcggcagagtagccgccgccgcgcgtccctcggtccctcctcgagttcccgcttcgtgggctggtcgccccctggcgctggacagctcagctgtcaggcgccgcggtttcgggaccgcgacactaaagccgctggcgaggtgaattgccgcgtccttaccgccccgcgctccccggtccggacagaacttggg

SEQ ID NO: 7428 - DNA, 65 bp, Homo sapiens; identical to SEQ ID NO: 2426
  misc_feature 1..65: note = chr4:81951421-81951486
  misc_feature 1..65: note = hyper
  source 1..65: mol_type = genomic DNA

SEQ ID NO: 7429 - DNA, 17 bp, Homo sapiens
  misc_feature 1..17: note = chr4:81951832-81951849
  misc_feature 1..17: note = hyper
  source 1..17: mol_type = genomic DNA
agatcagctagagagcg

SEQ ID NO: 7430 - DNA, 137 bp, Homo sapiens
  misc_feature 1..137: note = chr4:81951909-81952046
  misc_feature 1..137: note = hyper
  source 1..137: mol_type = genomic DNA
cgcacacacacacacacgtacactaaaaaactcggaccagccgcgccgcagctgctccaatccctggaaaaggcaatcgagcgccctccggaccgctgcgcacagccccggctccgacctggcgcccaaaacagagc

SEQ ID NO: 7431 - DNA, 43 bp, Homo sapiens
  misc_feature 1..43: note = chr4:81952269-81952312
  misc_feature 1..43: note = hyper
  source 1..43: mol_type = genomic DNA
gcaagtggggctggccgctatctcgctgcacccggccgcgtcc

SEQ ID NO: 7432 - DNA, 157 bp, Homo sapiens
  misc_feature 1..157: note = chr4:81952727-81952884
  misc_feature 1..157: note = hyper
  source 1..157: mol_type = genomic DNA
ttcgcagctttcgggcggcagcagcaggtgagtgcgcgaggtgagactcccttcccgcggtcccgccccagctttctcccgggaccccccacagcttccttgtctgccccttgcttggtggcgctgcctagggacctttctccgccctcctcagctg

SEQ ID NO: 7433 - DNA, 123 bp, Homo sapiens
  misc_feature 1..123: note = chr4:82136082-82136205
  misc_feature 1..123: note = hyper
  source 1..123: mol_type = genomic DNA
acctcaccagacagccgggtaactttccaggtgcgcagcttgtcacctcggcgcggccgcccctgcgtctcagcgtcctctcccacgccgccctccccagccgcctgcggcgccggagcccag

SEQ ID NO: 7434 - DNA, 37 bp, Homo sapiens
  misc_feature 1..37: note = chr4:82136243-82136280
  misc_feature 1..37: note = hyper
  source 1..37: mol_type = genomic DNA
cgcagcgtgggcccggggctgccggctcagtcgctcc

SEQ ID NO: 7435 - DNA, 286 bp, Homo sapiens
  misc_feature 1..286: note = chr4:82136635-82136921
  misc_feature 1..286: note = hyper
  source 1..286: mol_type = genomic DNA
ttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggc

SEQ ID NO: 7436 - DNA, 659 bp, Homo sapiens; identical to SEQ ID NO: 2427
  misc_feature 1..659: note = chr4:85402764-85403423
  misc_feature 1..659: note = hyper
  source 1..659: mol_type = genomic DNA

SEQ ID NO: 7437 - DNA, 30 bp, Homo sapiens; identical to SEQ ID NO: 375
  misc_feature 1..30: note = chr4:85404111-85404141
  misc_feature 1..30: note = hyper
  source 1..30: mol_type = genomic DNA

SEQ ID NO: 7438 - DNA, 252 bp, Homo sapiens; identical to SEQ ID NO: 376
  misc_feature 1..252: note = chr4:85404224-85404476
  misc_feature 1..252: note = hyper
  source 1..252: mol_type = genomic DNA

SEQ ID NO: 7439 - DNA, 44 bp, Homo sapiens; identical to SEQ ID NO: 377
  misc_feature 1..44: note = chr4:85404649-85404693
  misc_feature 1..44: note = hyper
  source 1..44: mol_type = genomic DNA

SEQ ID NO: 7440 - DNA, 189 bp, Homo sapiens
  misc_feature 1..189: note = chr4:85414148-85414337
  misc_feature 1..189: note = hyper
  source 1..189: mol_type = genomic DNA
cggctgggaccgtggcccggctgcgggtttcagtagcgacatttacgcagtgcatttggtggtctttcttgccttatcaaccccggagtctctctcccctacatcccctcccacaacttcaaggttaaaaaaatagatatgtacatctcaaaaatagcaaagggtccccgcaggcagggccgggtcctc

SEQ ID NO: 7441 - DNA, 25 bp, Homo sapiens
  misc_feature 1..25: note = chr4:85414457-85414482
  misc_feature 1..25: note = hyper
  source 1..25: mol_type = genomic DNA
ggctcggacgcgtgcagtaggaggc

SEQ ID NO: 7442 - DNA, 121 bp, Homo sapiens; identical to SEQ ID NO: 2431
  misc_feature 1..121: note = chr4:85414725-85414846
  misc_feature 1..121: note = hyper
  source 1..121: mol_type = genomic DNA

SEQ ID NO: 7443 - DNA, 431 bp, Homo sapiens
  misc_feature 1..431: note = chr4:85416935-85417366
  misc_feature 1..431: note = hyper
  source 1..431: mol_type = genomic DNA
ggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctcgcctcctaatccagtcggtgctcgttcggc

SEQ ID NO: 7444 - DNA, 53 bp, Homo sapiens
  misc_feature 1..53: note = chr4:85417666-85417719
  misc_feature 1..53: note = hyper
  source 1..53: mol_type = genomic DNA
tcccgcagttactgccgctcagccgcactaaggaggtccggagacttggaaga

SEQ ID NO: 7445 - DNA, 87 bp, Homo sapiens
  misc_feature 1..87: note = chr4:85417972-85418059
  misc_feature 1..87: note = hyper
  source 1..87: mol_type = genomic DNA
gtccccaaatgtgcccggacgcagcgtgtgccagcccccagagtggaggcaggtgggaaagcgcgggcccagcgctggtgagcggct

SEQ ID NO: 7446 - DNA, 37 bp, Homo sapiens
  misc_feature 1..37: note = chr4:85418265-85418302
  misc_feature 1..37: note = hyper
  source 1..37: mol_type = genomic DNA
gaaggcggaatggggcgctggacgacagggaggagcc

SEQ ID NO: 7447 - DNA, 123 bp, Homo sapiens; identical to SEQ ID NO: 378
  misc_feature 1..123: note = chr4:85419120-85419243
  misc_feature 1..123: note = hyper
  source 1..123: mol_type = genomic DNA

SEQ ID NO: 7448 - DNA, 87 bp, Homo sapiens
  misc_feature 1..87: note = chr4:85419695-85419782
  misc_feature 1..87: note = hyper
  source 1..87: mol_type = genomic DNA
tagctgttcaaagtgcgctacttctcatcttctgcccccgggaaataagcaaaacaaaacccaggctggctccggagagtttgtagc

SEQ ID NO: 7449 - DNA, 262 bp, Homo sapiens; identical to SEQ ID NO: 2433
  misc_feature 1..262: note = chr4:85422188-85422450
  misc_feature 1..262: note = hyper
  source 1..262: mol_type = genomic DNA

SEQ ID NO: 7450 - DNA, 30 bp, Homo sapiens
  misc_feature 1..30: note = chr4:85424453-85424483
  misc_feature 1..30: note = hyper
  source 1..30: mol_type = genomic DNA
tagagtcgcagaatacgtacctgggagtta

SEQ ID NO: 7451 - DNA, 86 bp, Homo sapiens
  misc_feature 1..86: note = chr4:87281209-87281295
  misc_feature 1..86: note = hyper
  source 1..86: mol_type = genomic DNA
acctaccagaggagacggacagagggcttggggaatggggttgctatggcaaccgaaaggagcacacatgacgtcaaagcccagag

SEQ ID NO: 7452 - DNA, 75 bp, Homo sapiens
  misc_feature 1..75: note = chr4:87515552-87515627
  misc_feature 1..75: note = hyper
  source 1..75: mol_type = genomic DNA
cgtagctccccggtccgcctcggcagcggtcagagtcgcctacaggagttgagccgcccgcgccagaaggttttg

SEQ ID NO: 7453 - DNA, 136 bp, Homo sapiens
  misc_feature 1..136: note = chr4:89378373-89378509
  misc_feature 1..136: note = hyper
  source 1..136: mol_type = genomic DNA
ggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccggg

SEQ ID NO: 7454 - DNA, 152 bp, Homo sapiens
  misc_feature 1..152: note = chr4:90757517-90757669
  misc_feature 1..152: note = hyper
  source 1..152: mol_type = genomic DNA
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagccta

SEQ ID NO: 7455 - DNA, 122 bp, Homo sapiens
  misc_feature 1..122: note = chr4:90758478-90758600
  misc_feature 1..122: note = hyper
  source 1..122: mol_type = genomic DNA
gccatcaactccagccgcctgcctggccgcgcaaggcgggaaagtgggggcgcttttgcgcctcacgttaagtttagggtcacgagcactcttgtggagatcgggagcggttgggctaggga

SEQ ID NO: 7456 - DNA, 40 bp, Homo sapiens; identical to SEQ ID NO: 2434
  misc_feature 1..40: note = chr4:90758843-90758883
  misc_feature 1..40: note = hyper
  source 1..40: mol_type = genomic DNA

SEQ ID NO: 7457 - DNA, 30 bp, Homo sapiens
  misc_feature 1..30: note = chr4:90759319-90759349
  misc_feature 1..30: note = hyper
  source 1..30: mol_type = genomic DNA
cccccacccaccacacgcacatgcacacag

SEQ ID NO: 7458 - DNA, 30 bp, Homo sapiens
  misc_feature 1..30: note = chr4:93225390-93225420
  misc_feature 1..30: note = hyper
  source 1..30: mol_type = genomic DNA
ggaagggggcacatccggcgtgaggggggt

SEQ ID NO: 7459 - DNA, 30 bp, Homo sapiens
  misc_feature 1..30: note = chr4:93226479-93226509
  misc_feature 1..30: note = hyper
  source 1..30: mol_type = genomic DNA
gtgtagtctttgagacggtggcaggagggg

SEQ ID NO: 7460 - DNA, 133 bp, Homo sapiens; identical to SEQ ID NO: 2435
  misc_feature 1..133: note = chr4:94750906-94751039
  misc_feature 1..133: note = hyper
  source 1..133: mol_type = genomic DNA

SEQ ID NO: 7461 - DNA, 231 bp, Homo sapiens
  misc_feature 1..231: note = chr4:94751368-94751599
  misc_feature 1..231: note = hyper
  source 1..231: mol_type = genomic DNA
aaattgtgtcctttccgcccaccttctgctccccctttagatagatacggtataattgtaggtacccgtatatggcatcattattctagttccctgctgccaatacgctgctaaaacgtcgcatcttctctgtcactggtttgggtttaatttattttacgccctgggcatccatccttgtgtgttgcgcactcaagtgtgggagatttagtcttccgaagttgttttcca

SEQ ID NO: 7462 - DNA, 114 bp, Homo sapiens
  misc_feature 1..114: note = chr4:94753279-94753393
  misc_feature 1..114: note = hyper
  source 1..114: mol_type = genomic DNA
taatgcactagggagcgcaggttctggtctccttaagtaagaaactgcagaaccagctttttactgaccacctgggtatctgtggctttcagcggaagccgaccaagagatgca

SEQ ID NO: 7463 - DNA, 30 bp, Homo sapiens
  misc_feature 1..30: note = chr4:94756066-94756096
  misc_feature 1..30: note = hyper
  source 1..30: mol_type = genomic DNA
gcaaccagcccagcacgcaaagaagctgcg

SEQ ID NO: 7464 - DNA, 55 bp, Homo sapiens
  misc_feature 1..55: note = chr4:95678866-95678921
  misc_feature 1..55: note = hyper
  source 1..55: mol_type = genomic DNA
gtcggctccgcactccgcacacaggcggcggcgctggggccgctccaagtgcgtt

SEQ ID NO: 7465 - DNA, 30 bp, Homo sapiens
  misc_feature 1..30: note = chr4:95679715-95679745
  misc_feature 1..30: note = hyper
  source 1..30: mol_type = genomic DNA
ggcacccacctgccccggacgcctcccgag

SEQ ID NO: 7466 - DNA, 30 bp, Homo sapiens
  misc_feature 1..30: note = chr4:96469039-96469069
  misc_feature 1..30: note = hyper
  source 1..30: mol_type = genomic DNA
ttcccaacccggcttcgcccagggccccgg

SEQ ID NO: 7467 - DNA, 221 bp, Homo sapiens; identical to SEQ ID NO: 2436
  misc_feature 1..221: note = chr4:101111366-101111587
  misc_feature 1..221: note = hyper
  source 1..221: mol_type = genomic DNA

SEQ ID NO: 7468 - DNA, 46 bp, Homo sapiens
  misc_feature 1..46: note = chr4:101111826-101111872
  misc_feature 1..46: note = hyper
  source 1..46: mol_type = genomic DNA
ttccagggtagatctcgggccactgggaccgcaattccgggtgcac

SEQ ID NO: 7469 - DNA, 68 bp, Homo sapiens
  misc_feature 1..68: note = chr4:101111873-101111941
  misc_feature 1..68: note = hyper
  source 1..68: mol_type = genomic DNA
actcgtcaaagcctgaacctgattgttcagtgcgacccctccccgagcgtccgcgctttcacactcag

SEQ ID NO: 7470 - DNA, 365 bp, Homo sapiens; identical to SEQ ID NO: 379
  misc_feature 1..365: note = chr4:107955250-107955615
  misc_feature 1..365: note = hyper
  source 1..365: mol_type = genomic DNA

SEQ ID NO: 7471 - DNA, 357 bp, Homo sapiens; identical to SEQ ID NO: 2438
  misc_feature 1..357: note = chr4:107956676-107957033
  misc_feature 1..357: note = hyper
  source 1..357: mol_type = genomic DNA

SEQ ID NO: 7472 - DNA, 113 bp, Homo sapiens
  misc_feature 1..113: note = chr4:107957249-107957362
  misc_feature 1..113: note = hyper
  source 1..113: mol_type = genomic DNA
ttcaaagttagcaggcgctttagtaggggatcaggagacgtccccggaccgaatcctcgagatctgaagagaatcgaggtcccccacacgcgcactcacagttgccccgaagc

SEQ ID NO: 7473 - DNA, 188 bp, Homo sapiens
  misc_feature 1..188: note = chr4:107957363-107957551
  misc_feature 1..188: note = hyper
  source 1..188: mol_type = genomic DNA
ttgtcccctgactcacaagagacagcgaatcgctgccagcgcagcgatgcctagggagcggacttgcgctacgctcgccgcgggctcccgctttctctctctctgctctctccccagtcctctttgctttttatagcttcccacagtgaggactttttttttttttttacctccgcccccaattcaag

SEQ ID NO: 7474 - DNA, 30 bp, Homo sapiens
  misc_feature 1..30: note = chr4:107957963-107957993
  misc_feature 1..30: note = hyper
  source 1..30: mol_type = genomic DNA
ttctttgtgagctcacgtttggttttagac

SEQ ID NO: 7475 - DNA, 30 bp, Homo sapiens
  misc_feature 1..30: note = chr4:107958442-107958472
  misc_feature 1..30: note = hyper
  source 1..30: mol_type = genomic DNA
ggtcgaaggctgctccgggaacgactggga

SEQ ID NO: 7476 - DNA, 213 bp, Homo sapiens
  misc_feature 1..213: note = chr4:109088250-109088463
  misc_feature 1..213: note = hyper
  source 1..213: mol_type = genomic DNA
cctttggtggtttaacgcacttttgcagagacatctaccaagagatagcgtgtgcactttgttttccgtcccacggaagaatttatcagtagcgttattcagccctactcgctttaaagcacggcacccctcagcccaacaaaaagaccgaaggcgaaacattgtgggttcctgcccgcgaaccaaccgttcagccaccgaaccccctaaact

SEQ ID NO: 7477 - DNA, 207 bp, Homo sapiens
  misc_feature 1..207: note = chr4:109093307-109093514
  misc_feature 1..207: note = hyper
  source 1..207: mol_type = genomic DNA
tcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctattt

SEQ ID NO: 7478 - DNA, 117 bp, Homo sapiens
  misc_feature 1..117: note = chr4:109093806-109093923
  misc_feature 1..117: note = hyper
  source 1..117: mol_type = genomic DNA
ccagcgagcggggtccgccacccctcgcgccctcctgcggctttcccagcgctgggccagtgcaggccgagccctgcgtccctgcctcgctgggtgggggtccggggcgcggctgtc

SEQ ID NO: 7479 - DNA, 89 bp, Homo sapiens
  misc_feature 1..89: note = chr4:109094183-109094272
  misc_feature 1..89: note = hyper
  source 1..89: mol_type = genomic DNA
ggggaatgcctagaacggagctagaatggaggtgggagctggagtcattttgcgggccacaggactgctcatttcgtgggcaggacgtg

SEQ ID NO: 7480 - DNA, 30 bp, Homo sapiens
  misc_feature 1..30: note = chr4:109683691-109683721
  misc_feature 1..30: note = hyper
  source 1..30: mol_type = genomic DNA
gctagggctattggccgtcatccaccaacc

SEQ ID NO: 7481 - DNA, 70 bp, Homo sapiens
  misc_feature 1..70: note = chr4:109684016-109684086
  misc_feature 1..70: note = hyper
  source 1..70: mol_type = genomic DNA
agccccagagtgtcccgcttactgtacagctcgcacatggtggcggggtgcagggcgctgcgaaggtgca

SEQ ID NO: 7482 - DNA, 104 bp, Homo sapiens
  misc_feature 1..104: note = chr4:110223324-110223428
  misc_feature 1..104: note = hyper
  source 1..104: mol_type = genomic DNA
ccctgccttgctcagcgtccagacccgcaggcgtgcaccatccccgctttcttctctcctcccagctggaagtgaaaagcaccctccgtccggggactgggtgg

SEQ ID NO: 7483 - DNA, 20 bp, Homo sapiens
  misc_feature 1..20: note = chr4:110223578-110223598
  misc_feature 1..20: note = hyper
  source 1..20: mol_type = genomic DNA
cggaggaccggacctgttgc

SEQ ID NO: 7484 - DNA, 245 bp, Homo sapiens
  misc_feature 1..245: note = chr4:110223599-110223844
  misc_feature 1..245: note = hyper
  source 1..245: mol_type = genomic DNA
cctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaata

SEQ ID NO: 7485 - DNA, 37 bp, Homo sapiens
  misc_feature 1..37: note = chr4:110224118-110224155
  misc_feature 1..37: note = hyper
  source 1..37: mol_type = genomic DNA
tgcaaatagctggagcggccaccgtgattggagagga

SEQ ID NO: 7486 - DNA, 306 bp, Homo sapiens; identical to SEQ ID NO: 2439
  misc_feature 1..306: note = chr4:111532704-111533010
  misc_feature 1..306: note = hyper
  source 1..306: mol_type = genomic DNA

SEQ ID NO: 7487 - DNA, 132 bp, Homo sapiens
  misc_feature 1..132: note = chr4:111536561-111536693
  misc_feature 1..132: note = hyper
  source 1..132: mol_type = genomic DNA
cgaggggactgactgcaccggctctgggagctaggtttctctcgctggatgggaaaaggaggtgcggaaaggggcaggcggcctgcgggctagcggggatgagagttgtggggagaacggaggagagagtaa

SEQ ID NO: 7488 - DNA, 30 bp, Homo sapiens
  misc_feature 1..30: note = chr4:111540349-111540379
  misc_feature 1..30: note = hyper
  source 1..30: mol_type = genomic DNA
ccccaccccctggtacgtgctcccttaaca

SEQ ID NO: 7489 - skipped

SEQ ID NO: 7490 - DNA, 114 bp, Homo sapiens; identical to SEQ ID NO: 2440
  misc_feature 1..114: note = chr4:111543232-111543346
  misc_feature 1..114: note = hyper
  source 1..114: mol_type = genomic DNA

SEQ ID NO: 7491 - DNA, 47 bp, Homo sapiens; identical to SEQ ID NO: 2441
  misc_feature 1..47: note = chr4:111543403-111543450
  misc_feature 1..47: note = hyper
  source 1..47: mol_type = genomic DNA

SEQ ID NO: 7492 - DNA, 105 bp, Homo sapiens; identical to SEQ ID NO: 2442
  misc_feature 1..105: note = chr4:111544076-111544181
  misc_feature 1..105: note = hyper
  source 1..105: mol_type = genomic DNA

SEQ ID NO: 7493 - DNA, 285 bp, Homo sapiens; identical to SEQ ID NO: 2443
  misc_feature 1..285: note = chr4:111544298-111544583
  misc_feature 1..285: note = hyper
  source 1..285: mol_type = genomic DNA

SEQ ID NO: 7494 - DNA, 30 bp, Homo sapiens
  misc_feature 1..30: note = chr4:111549993-111550023
  misc_feature 1..30: note = hyper
  source 1..30: mol_type = genomic DNA
gtaccgagtcagcagcgaggaacgcgacct

SEQ ID NO: 7495 - DNA, 215 bp, Homo sapiens
  misc_feature 1..215: note = chr4:111550629-111550844
  misc_feature 1..215: note = hyper
  source 1..215: mol_type = genomic DNA
ggaccgagctgctgccgcgtgtgaaggtgtgtgtcgcggctgggggtgccacaacgggccatggagcccacctcccagagggaggaagtctgtgcacaccagcgacttgggtcgaacactttcagcccatccactgggccaaagctatttaacaattaatgcgttcctgggggaggccgggggaagtacccgccccttgtcgggacgcaaagcca

SEQ ID NO: 7496 - DNA, 701 bp, Homo sapiens
  misc_feature 1..701: note = chr4:111552994-111553695
  misc_feature 1..701: note = hyper
  source 1..701: mol_type = genomic DNA
cttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaa

SEQ ID NO: 7497 - DNA, 35 bp, Homo sapiens
  misc_feature 1..35: note = chr4:111555308-111555343
  misc_feature 1..35: note = hyper
  source 1..35: mol_type = genomic DNA
agtaccgtttccctgcgtctcggcctctcctgaag

SEQ ID NO: 7498 - DNA, 133 bp, Homo sapiens
  misc_feature 1..133: note = chr4:111557898-111558031
  misc_feature 1..133: note = hyper
  source 1..133: mol_type = genomic DNA
tatctcacatccctgcgggatagatggcctccacttaccggctaccgggagagagctgctgtctccgcgtcccactgcttcccggggcgatttccagcgagccgagcctccggctgcacggcaagcgcccgaa

SEQ ID NO: 7499 - DNA, 416 bp, Homo sapiens
  misc_feature 1..416: note = chr4:111558835-111559251
  misc_feature 1..416: note = hyper
  source 1..416: mol_type = genomic DNA
gagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaa

SEQ ID NO: 7500 - DNA, 194 bp, Homo sapiens
  misc_feature 1..194: note = chr4:111560442-111560636
  misc_feature 1..194: note = hyper
  source 1..194: mol_type = genomic DNA
gtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcc

SEQ ID NO: 7501 - DNA, 65 bp, Homo sapiens
  misc_feature 1..65: note = chr4:111562583-111562648
  misc_feature 1..65: note = hyper
  source 1..65: mol_type = genomic DNA
cgtggccccgcaagtcgccaggccaagcttgctttttctgtctgcccctccggcaggctgggcgc

SEQ ID NO: 7502 - DNA, 32 bp, Homo sapiens
  misc_feature 1..32: note = chr4:113430640-113430672
  misc_feature 1..32: note = hyper
  source 1..32: mol_type = genomic DNA
gccgagcatctctcacgcggttgacacctctc

SEQ ID NO: 7503 - DNA, 45 bp, Homo sapiens; identical to SEQ ID NO: 2444
  misc_feature 1..45: note = chr4:113431810-113431855
  misc_feature 1..45: note = hyper
  source 1..45: mol_type = genomic DNA

SEQ ID NO: 7504 - DNA, 240 bp, Homo sapiens; identical to SEQ ID NO: 2445
  misc_feature 1..240: note = chr4:113431915-113432155
  misc_feature 1..240: note = hyper
  source 1..240: mol_type = genomic DNA

SEQ ID NO: 7505 - DNA, 114 bp, Homo sapiens; identical to SEQ ID NO: 2446
  misc_feature 1..114: note = chr4:113432226-113432340
  misc_feature 1..114: note = hyper
  source 1..114: mol_type = genomic DNA

SEQ ID NO: 7506 - DNA, 30 bp, Homo sapiens
  misc_feature 1..30: note = chr4:113432579-113432609
  misc_feature 1..30: note = hyper
  source 1..30: mol_type = genomic DNA
cagcgcgctagctggcgttggaaagatcta

SEQ ID NO: 7507 - DNA, 556 bp, Homo sapiens
  misc_feature 1..556: note = chr4:113435837-113436393
  misc_feature 1..556: note = hyper
  source 1..556: mol_type = genomic DNA
aggtgaggtgcatagcggtgcttgtcgggaggtgggggctgccaatagtccatgtctgacccggccgggctggcgggcgataaagtgcagctgtagggggaggtggaattggaggacacggaggaggacggcgcggggctgttggtgcaactccacgtggaggcgggcgaggggctgtctccgctgctgctcagggcggcgctggctcctcccgggctcagcaacactgcctcggagaagagcgcccccggcaggcccccgccgccgcccccgcagtgatccgccaggcgcagggtctcggtgagtgcccagatgtagttgtgggcgaagcgcagggtctcgatcttggtgagcttggcgtcctcggggaacgtggggagcacctcgcgcagcgcgtccagtgccgcgttgaggttgtgcatgcggtttcgctcgcggttgttggccttcagtctacgggtcttcttgatgcgctgcaccgtctcggccgtcttggcgcctcgggagacggcccgcgcccgggaagggcgccgtttgcaatcgtgtaccagaccca

SEQ ID NO: 7508 - DNA, 342 bp, Homo sapiens
  misc_feature 1..342: note = chr4:113437629-113437971
  misc_feature 1..342: note = hyper
  source 1..342: mol_type = genomic DNA
tggagctccgggctgcggccggagctggcgaagccgcagcggccgcagaggctcaagctgcggctgttgtcgccgccgctgtccattgtgattggtggctcgcgctcggctggagcgtgccgctaatttattaatgaatggaggtcgcgaggcgcagctggccaatcagggcgccctggactccgggaggcctgcgagccacgcgcaccggagcccgctccctttcagcagctcattaggggcccgagcgctgggggcggatggggggacccgtgctaccgcccccgccttcgtcctcgctgccgccgaggctccccccgcccggcgcgcgcgcaggcaccg

SEQ ID NO: 7509 - DNA, 30 bp, Homo sapiens
  misc_feature 1..30: note = chr4:113438171-113438201
  misc_feature 1..30: note = hyper
  source 1..30: mol_type = genomic DNA
gagatgtggacacctcgtgaacaagtgtgt

SEQ ID NO: 7510 - DNA, 198 bp, Homo sapiens
  misc_feature 1..198: note = chr4:113438506-113438704
  misc_feature 1..198: note = hyper
  source 1..198: mol_type = genomic DNA
tcctgcaagcaaatgcgctgcgctgacatttctgtgacctctgctccgcgctggggggcgttgtagggacaaggggcccatcttcccaattctgcttttcaatgagaaaaaagagctgaagggctactggacctcgggggaaacttgttctcaattgctcgttagccctccccactttccccacgttcatgcccaccc

SEQ ID NO: 7511 - DNA, 119 bp, Homo sapiens
  misc_feature 1..119: note = chr4:113441598-113441717
  misc_feature 1..119: note = hyper
  source 1..119: mol_type = genomic DNA
ggtgactgtcgggggcgcgaaagagggcgcccttccctgagaggacaaaagccaaggtttggctatccagcgagcctgtcccccaattcacagtaaaccaccgtcggccaaaggagatg

SEQ ID NO: 7512 - DNA, 239 bp, Homo sapiens; identical to SEQ ID NO: 380
  misc_feature 1..239: note = chr4:113441947-113442186
  misc_feature 1..239: note = hyper
  source 1..239: mol_type = genomic DNA

SEQ ID NO: 7513 - DNA, 237 bp, Homo sapiens; identical to SEQ ID NO: 381
  misc_feature 1..237: note = chr4:113442246-113442483
  misc_feature 1..237: note = hyper
  source 1..237: mol_type = genomic DNA

SEQ ID NO: 7514 - DNA, 275 bp, Homo sapiens; identical to SEQ ID NO: 382
  misc_feature 1..275: note = chr4:113444020-113444295
  misc_feature 1..275: note = hyper
  source 1..275: mol_type = genomic DNA

SEQ ID NO: 7515 - DNA, 133 bp, Homo sapiens; identical to SEQ ID NO: 383
  misc_feature 1..133: note = chr4:113444296-113444429
  misc_feature 1..133: note = hyper
  source 1..133: mol_type = genomic DNA

SEQ ID NO: 7516 - DNA, 32 bp, Homo sapiens
  misc_feature 1..32: note = chr4:113626580-113626612
  misc_feature 1..32: note = hyper
  source 1..32: mol_type = genomic DNA
aacaaagaatgtgtgcgcgtggaggctagagg

SEQ ID NO: 7517 - DNA, 153 bp, Homo sapiens
  misc_feature 1..153: note = chr4:117847306-117847459
  misc_feature 1..153: note = hyper
  source 1..153: mol_type = genomic DNA
cgacccctcccatctcgctccccacatccccgcggacacagctggtggcgactcagacctctcgggcagcggctgcagggcgagcacagaggggactccgatgcgaaccgaggccccgggacccgccaggccacccgcgccgccgcccctctc

SEQ ID NO: 7518 - DNA, 11 bp, Homo sapiens
  misc_feature 1..11: note = chr4:117847469-117847480
  misc_feature 1..11: note = hyper
  source 1..11: mol_type = genomic DNA
cgggcccgctc

SEQ ID NO: 7519 - DNA, 146 bp, Homo sapiens
  misc_feature 1..146: note = chr4:121844007-121844153
  misc_feature 1..146: note = hyper
  source 1..146: mol_type = genomic DNA
gggcgcgggcctgggcgctgcgggcgccgggacgccgctcgctgattggcccgaagttggcggctctgacccgcgcccgggcgcgaagcccggagcagggctgaccccagggcctcaaacccggaggcccgcgagctgcgcgggcc

SEQ ID NO: 7520 - DNA, 114 bp, Homo sapiens
  misc_feature 1..114: note = chr4:121992426-121992540
  misc_feature 1..114: note = hyper
  source 1..114: mol_type = genomic DNA
gaagaaagtatgagccggtcccaggccacctcgctcagcccaaggaagtttctataacgatgctcgcctaccacgcagaggacaaatgaggagccagagcggttgggggtcggg

SEQ ID NO: 7521 - DNA, 249 bp, Homo sapiens
  misc_feature 1..249: note = chr4:121993436-121993685
  misc_feature 1..249: note = hyper
  source 1..249: mol_type = genomic DNA
atcccggggcagcgccgagaagcggcgggaggtccttttaaactgcagggagcgtgcgggggctgggcggcgggaggatgccgcagcgacccgcggggctggcgcgggcttcgccggccgccgctagtcgcacaggcgcctggctggagcgccgcgcggggtgctgggagagccgggcgcacggggcggcagcggccgtggcgggtgcgctgctcagttagctccactctctcgcggctggaagtgggg

SEQ ID NO: 7522 - DNA, 80 bp, Homo sapiens
  misc_feature 1..80: note = chr4:121993995-121994075
  misc_feature 1..80: note = hyper
  source 1..80: mol_type = genomic DNA
cccaaacaggaccctcgcgggcggcatcgcgagggacacgctgctgtcctaaccttagcgccactcggggagaatgaagg

SEQ ID NO: 7523 - DNA, 30 bp, Homo sapiens
  misc_feature 1..30: note = chr4:121994303-121994333
  misc_feature 1..30: note = hyper
  source 1..30: mol_type = genomic DNA
ccttcactcagggagcgcttccccctcggc

SEQ ID NO: 7524 - DNA, 251 bp, Homo sapiens; identical to SEQ ID NO: 384
  misc_feature 1..251: note = chr4:122301462-122301713
  misc_feature 1..251: note = hyper
  source 1..251: mol_type = genomic DNA

SEQ ID NO: 7525 - DNA, 48 bp, Homo sapiens; identical to SEQ ID NO: 385
  misc_feature 1..48: note = chr4:122301962-122302010
  misc_feature 1..48: note = hyper
  source 1..48: mol_type = genomic DNA

SEQ ID NO: 7526 - DNA, 60 bp, Homo sapiens
  misc_feature 1..60: note = chr4:122302243-122302303
  misc_feature 1..60: note = hyper
  source 1..60: mol_type = genomic DNA
acccagcttcagtggcgccaacgccgcttccccgcaccctcagggcgagggaagacttcc

SEQ ID NO: 7527 - DNA, 244 bp, Homo sapiens; identical to SEQ ID NO: 386
  misc_feature 1..244: note = chr4:122686209-122686453
  misc_feature 1..244: note = hyper
  source 1..244: mol_type = genomic DNA

SEQ ID NO: 7528 - DNA, 16 bp, Homo sapiens
  misc_feature 1..16: note = chr4:122686454-122686470
  misc_feature 1..16: note = hyper
  source 1..16: mol_type = genomic DNA
gcgcagactctcccag

SEQ ID NO: 7529 - DNA, 1201 bp, Homo sapiens; identical to SEQ ID NO: 2455
  misc_feature 1..1201: note = chr4:122871251-122872452
  misc_feature 1..1201: note = hyper
  source 1..1201: mol_type = genomic DNA

SEQ ID NO: 7530 - DNA, 258 bp, Homo sapiens
  misc_feature 1..258: note = chr4:123747826-123748084
  misc_feature 1..258: note = hyper
  source 1..258: mol_type = genomic DNA
cttgcgtgttgtggccgaaccgccgaactcagaggccggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccat

SEQ ID NO: 7531 - DNA, 354 bp, Homo sapiens
  misc_feature 1..354: note = chr4:123748540-123748894
  misc_feature 1..354: note = hyper
  source 1..354: mol_type = genomic DNA
catttcgtgggttctcgcccgctctctcccctccagcctgcaccctcctcccggatcttcactgcgaccctagcgctccgtgtggtttctggccgcgcggccctcggcggtttcgggttcaccactcaccccctcctttccgggctgcggcgtaggcccgggtgtcccctgggctttggggtgtgccaatttgccctgtaaaccagtacccccggcccggagccgcggcgcgccggggcctcgcggactggctgtcttcccgcggacaacctgtcgcgtcggggatgcccgcggccccgccatgcagctctggccgcttctatctgctgcgtgctgtcccggggacaaagacag

SEQ ID NO: 7532 - DNA, 208 bp, Homo sapiens
  misc_feature 1..208: note = chr4:126238000-126238208
  misc_feature 1..208: note = hyper
  source 1..208: mol_type = genomic DNA
ggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccg

SEQ ID NO: 7533 - DNA, 143 bp, Homo sapiens
  misc_feature 1..143: note = chr4:128544048-128544191
  misc_feature 1..143: note = hyper
  source 1..143: mol_type = genomic DNA
tgtccctggccaaggcggcctcgctgtcctggaagggagggtgaagagctgcatcccgcactaggcggcgaaagagggcagcgccaagcggcggggtccggaggcgctcgacggctcgcgcccagcgccggagacgggctgtg

SEQ ID NO: 7534 - DNA, 30 bp, Homo sapiens
  misc_feature 1..30: note = chr4:134067929-134067959
  misc_feature 1..30: note = hyper
  source 1..30: mol_type = genomic DNA
agagcccccaaaaggcgagctctccaaagc

SEQ ID NO: 7535 - DNA, 61 bp, Homo sapiens
  misc_feature 1..61: note = chr4:134068338-134068399
  misc_feature 1..61: note = hyper
  source 1..61: mol_type = genomic DNA
gcattagaaaattaccgtcattttttaaaaggctccaggattctgacgagtcagcttgaag

SEQ ID NO: 7536 - DNA, 43 bp, Homo sapiens
  misc_feature 1..43: note = chr4:134068856-134068899
  misc_feature 1..43: note = hyper
  source 1..43: mol_type = genomic DNA
aggaggaaatggcaacgtatctccaggtcggaaaacgactcta

SEQ ID NO: 7537 - DNA, 103 bp, Homo sapiens
  misc_feature 1..103: note = chr4:134069793-134069896
  misc_feature 1..103: note = hyper
  source 1..103: mol_type = genomic DNA
ccccacatcctttagcgtgaattcctccgctttttaggagtcacctccaccccctactccgtatgcttcgcgcctttcctcacggccccgtcagaccccctca

SEQ ID NO: 7538 - DNA, 101 bp, Homo sapiens
  misc_feature 1..101: note = chr4:134071103-134071204
  misc_feature 1..101: note = hyper
  source 1..101: mol_type = genomic DNA
aatgaggctggattgcgggaagctctaaaatgaagcaaaaggagtaagatttttaaagacagaaagccacaggagcccccacgtagcgcacttttatttgt

SEQ ID NO: 7539 - DNA, 30 bp, Homo sapiens
  misc_feature 1..30: note = chr4:134071425-134071455
  misc_feature 1..30: note = hyper
  source 1..30: mol_type = genomic DNA
acattacaaaactttcggctcgcgggtttc

SEQ ID NO: 7540 - DNA, 761 bp, Homo sapiens; identical to SEQ ID NO: 388
  misc_feature 1..761: note = chr4:134071850-134072611
  misc_feature 1..761: note = hyper
  source 1..761: mol_type = genomic DNA

SEQ ID NO: 7541 - DNA, 304 bp, Homo sapiens; identical to SEQ ID NO: 389
  misc_feature 1..304: note = chr4:134072676-134072980
  misc_feature 1..304: note = hyper
  source 1..304: mol_type = genomic DNA

SEQ ID NO: 7542 - DNA, 301 bp, Homo sapiens; identical to SEQ ID NO: 2458
  misc_feature 1..301: note = chr4:134073340-134073641
  misc_feature 1..301: note = hyper
  source 1..301: mol_type = genomic DNA

SEQ ID NO: 7543 - DNA, 52 bp, Homo sapiens
  misc_feature 1..52: note = chr4:134074051-134074103
  misc_feature 1..52: note = hyper
  source 1..52: mol_type = genomic DNA
gggagcagagatgggcggtcaccttctcccactccttcgtgtgtaacctaac

SEQ ID NO: 7544 - DNA, 565 bp, Homo sapiens; identical to SEQ ID NO: 390
  misc_feature 1..565: note = chr4:140200592-140201157
  misc_feature 1..565: note = hyper
  source 1..565: mol_type = genomic DNA

SEQ ID NO: 7545 - DNA, 270 bp, Homo sapiens; identical to SEQ ID NO: 391
  misc_feature 1..270: note = chr4:140201192-140201462
  misc_feature 1..270: note = hyper
  source 1..270: mol_type = genomic DNA

SEQ ID NO: 7546 - DNA, 38 bp, Homo sapiens
  misc_feature 1..38: note = chr4:140657110-140657148
  misc_feature 1..38: note = hyper
  source 1..38: mol_type = genomic DNA
gcatttcccaggccccgccacatcgtgtgtgttagtgg

SEQ ID NO: 7547 - DNA, 47 bp, Homo sapiens
  misc_feature 1..47: note = chr4:141294349-141294396
  misc_feature 1..47: note = hyper
  source 1..47: mol_type = genomic DNA
tttctctgcttggttcgcaaacgctcttttctcgaacttgaatgact

SEQ ID NO: 7548 - DNA, 143 bp, Homo sapiens
  misc_feature 1..143: note = chr4:141348038-141348181
  misc_feature 1..143: note = hyper
  source 1..143: mol_type = genomic DNA
ctttcgcccgccccccggcggcgcacaatgggctctgcgcgggtatcgagggagcggccaacagtccctggccccaccgccgtgaagtggggtcccttcgcttccacataggtggagactgagacagccgagcctattttgat

SEQ ID NO: 7549 - DNA, 510 bp, Homo sapiens; identical to SEQ ID NO: 392
  misc_feature 1..510: note = chr4:141418921-141419431
  misc_feature 1..510: note = hyper
  source 1..510: mol_type = genomic DNA

SEQ ID NO: 7550 - DNA, 173 bp, Homo sapiens
  misc_feature 1..173: note = chr4:141488870-141489043
  misc_feature 1..173: note = hyper
  source 1..173: mol_type = genomic DNA
ctttttggaacagagcggagcccaaggcttttctgcccctcccaggaacgctcacggcttactttctttccctgcggtgaggaactcctggaccgtgtcgtagaggccgatcctgagagaggcggagctgatttgccgctgaagccccgcaggcagcccgctgtagagtttca

SEQ ID NO: 7551 - DNA, 142 bp, Homo sapiens
  misc_feature 1..142: note = chr4:142054074-142054216
  misc_feature 1..142: note = hyper
  source 1..142: mol_type = genomic DNA
ccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaa

SEQ ID NO: 7552 - DNA, 134 bp, Homo sapiens
  misc_feature 1..134: note = chr4:143766796-143766930
  misc_feature 1..134: note = hyper
  source 1..134: mol_type = genomic DNA
aaaaaacaaggcaaccgggaccaccaacatcagtcaccctcactccccaccactgcctctattccttaaggacttcttcccaggccggcggcggcggcggcggcggcggcggcagcttgcgatcatcaggattg

SEQ ID NO: 7553 - DNA, 104 bp, Homo sapiens; identical to SEQ ID NO: 393
  misc_feature 1..104: note = chr4:144621336-144621440
  misc_feature 1..104: note = hyper
  source 1..104: mol_type = genomic DNA

SEQ ID NO: 7554 - DNA, 383 bp, Homo sapiens; identical to SEQ ID NO: 394
  misc_feature 1..383: note = chr4:144621514-144621897
  misc_feature 1..383: note = hyper
  source 1..383: mol_type = genomic DNA

SEQ ID NO: 7555 - DNA, 173 bp, Homo sapiens; identical to SEQ ID NO: 395
  misc_feature 1..173: note = chr4:144621981-144622154
  misc_feature 1..173: note = hyper
  source 1..173: mol_type = genomic DNA

SEQ ID NO: 7556 - DNA, 269 bp, Homo sapiens
  misc_feature 1..269: note = chr4:145568334-145568603
  misc_feature 1..269: note = hyper
  source 1..269: mol_type = genomic DNA
atctctgaaaacagacgtttctgcggtacccgcaccctgggctgggtaaatattttaaaagaatcgcgatgaacagtgtgttttggatcgaatggggcattggctgcggtgaaactgtaaattaaggtggctgtggtttccggcttatttttctagggtaaaaagatttgtgctgttttctccacgtgctcggttagggagaggattgaatcgtaaaggatgttgaagcatggttggtttatgatccccagccccgtcagaggggggtg

SEQ ID NO: 7557 - DNA, 30 bp, Homo sapiens; identical to SEQ ID NO: 2465
  misc_feature 1..30: note = chr4:147558352-147558382
  misc_feature 1..30: note = hyper
  source 1..30: mol_type = genomic DNA

SEQ ID NO: 7558 - DNA, 140 bp, Homo sapiens; identical to SEQ ID NO: 2466
  misc_feature 1..140: note = chr4:147558476-147558616
  misc_feature 1..140: note = hyper
  source 1..140: mol_type = genomic DNA

SEQ ID NO: 7559 - DNA, 889 bp, Homo sapiens; identical to SEQ ID NO: 396
  misc_feature 1..889: note = chr4:147559190-147560079
  misc_feature 1..889: note = hyper
  source 1..889: mol_type = genomic DNA

SEQ ID NO: 7560 - DNA, 286 bp, Homo sapiens; identical to SEQ ID NO: 397
  misc_feature 1..286: note = chr4:147560133-147560419
  misc_feature 1..286: note = hyper
  source 1..286: mol_type = genomic DNA

SEQ ID NO: 7561 - DNA, 52 bp, Homo sapiens; identical to SEQ ID NO: 398
  misc_feature 1..52: note = chr4:147560459-147560511
  misc_feature 1..52: note = hyper
  source 1..52: mol_type = genomic DNA

SEQ ID NO: 7562 - DNA, 525 bp, Homo sapiens
  misc_feature 1..525: note = chr4:147561425-147561950
  misc_feature 1..525: note = hyper
  source 1..525: mol_type = genomic DNA
gctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgc

SEQ ID NO: 7563 - DNA, 96 bp, Homo sapiens
  misc_feature 1..96: note = chr4:147561999-147562095
  misc_feature 1..96: note = hyper
  source 1..96: mol_type = genomic DNA
cgctcttttctctcctctcttctgcctcttttcacttttggcgactagaaacaattccagtaaatgtgaatctcgacaaatcgaggactgaagagg

SEQ ID NO: 7564 - DNA, 46 bp, Homo sapiens
  misc_feature 1..46: note = chr4:147568636-147568682
  misc_feature 1..46: note = hyper
  source 1..46: mol_type = genomic DNA
ttttcaggaacaaatcgatgagatagggatgcgagagagggaagat

SEQ ID NO: 7565 - DNA, 41 bp, Homo sapiens
  misc_feature 1..41: note = chr4:147569117-147569158
  misc_feature 1..41: note = hyper
  source 1..41: mol_type = genomic DNA
ctcgctggaggagctcgcccggtccccgaggggcccccaga

SEQ ID NO: 7566 - DNA, 515 bp, Homo sapiens; identical to SEQ ID NO: 2470
  misc_feature 1..515: note = chr4:147576329-147576844
  misc_feature 1..515: note = hyper
  source 1..515: mol_type = genomic DNA

SEQ ID NO: 7567 - DNA, 30 bp, Homo sapiens
  misc_feature 1..30: note = chr4:151000206-151000236
  misc_feature 1..30: note = hyper
  source 1..30: mol_type = genomic DNA
gagcactttgaggaacgggacaaaaggccg

SEQ ID NO: 7568 - DNA, 157 bp, Homo sapiens
  misc_feature 1..157: note = chr4:154143837-154143994
  misc_feature 1..157: note = hyper
  source 1..157: mol_type = genomic DNA
agagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcag

SEQ ID NO: 7569 - DNA, 46 bp, Homo sapiens
  misc_feature 1..46: note = chr4:154144430-154144476
  misc_feature 1..46: note = hyper
  source 1..46: mol_type = genomic DNA
gtcgcggacctctgccgtcctcagtcacccgcgtcatgcaggatag

SEQ ID NO: 7570 - DNA, 76 bp, Homo sapiens
  misc_feature 1..76: note = chr4:154680788-154680864
  misc_feature 1..76: note = hyper
  source 1..76: mol_type = genomic DNA
ttccagaaggtcatgcgtccgtccccacgtctttccagggccggttctccccggtggggcccggggtcttggagac

SEQ ID NO: 7571 - DNA, 30 bp, Homo sapiens
  misc_feature 1..30: note = chr4:154709169-154709199
  misc_feature 1..30: note = hyper
  source 1..30: mol_type = genomic DNA
tatttttttttaaaccgccgttcagttctt

SEQ ID NO: 7572 - DNA, 135 bp, Homo sapiens; identical to SEQ ID NO: 399
  misc_feature 1..135: note = chr4:154709476-154709611
  misc_feature 1..135: note = hyper
  source 1..135: mol_type = genomic DNA

SEQ ID NO: 7573 - DNA, 70 bp, Homo sapiens; identical to SEQ ID NO: 400
  misc_feature 1..70: note = chr4:154709758-154709828
  misc_feature 1..70: note = hyper
  source 1..70: mol_type = genomic DNA

SEQ ID NO: 7574 - DNA, 675 bp, Homo sapiens; identical to SEQ ID NO: 401
  misc_feature 1..675: note = chr4:154709829-154710504
  misc_feature 1..675: note = hyper
  source 1..675: mol_type = genomic DNA

SEQ ID NO: 7575 - DNA, 66 bp, Homo sapiens; identical to SEQ ID NO: 2474
  misc_feature 1..66: note = chr4:154710734-154710800
  misc_feature 1..66: note = hyper
  source 1..66: mol_type = genomic DNA

SEQ ID NO: 7576 - DNA, 684 bp, Homo sapiens; identical to SEQ ID NO: 2475
  misc_feature 1..684: note = chr4:154712024-154712708
  misc_feature 1..684: note = hyper
  source 1..684: mol_type = genomic DNA

SEQ ID NO: 7577 - DNA, 30 bp, Homo sapiens
  misc_feature 1..30: note = chr4:154713980-154714010
  misc_feature 1..30: note = hyper
  source 1..30: mol_type = genomic DNA
cgagaccagagtctgcgtctggagagcctt

SEQ ID NO: 7578 - DNA, 171 bp, Homo sapiens
  misc_feature 1..171: note = chr4:155254130-155254301
  misc_feature 1..171: note = hyper
  source 1..171: mol_type = genomic DNA
cgcgtttctcgataacgactgtcagcaccagcagggctgcctgaggatgcacgccttggtcctcggccctgagagtcagcgtgagctcccgctgctcgcccgcgcccaggctgccgttgaggaacagcacccccagggctctgtcgatggcaaagacgcctggctgcgggc

SEQ ID NO: 7579 - DNA, 56 bp, Homo sapiens
  misc_feature 1..56: note = chr4:155411438-155411494
  misc_feature 1..56: note = hyper
  source 1..56: mol_type = genomic DNA
cgaagtaggccgcgtcgcccagtgccccgccgccgctacccgccccaggcacttgc

SEQ ID NO: 7580 - DNA, 104 bp, Homo sapiens; identical to SEQ ID NO: 2476
  misc_feature 1..104: note = chr4:155412085-155412189
  misc_feature 1..104: note = hyper
  source 1..104: mol_type = genomic DNA

SEQ ID NO: 7581 - DNA, 143 bp, Homo sapiens
  misc_feature 1..143: note = chr4:155413374-155413517
  misc_feature 1..143: note = hyper
  source 1..143: mol_type = genomic DNA
gcctgactcttggctcgcgctgagccaagagggtagaggttatcatcactttggggtgccaaacttgtgttctccatttggcgagagggactcccgtccgcagcggaaggacagatggagtcaaaggccgatgcatagctggg

SEQ ID NO: 7582 - DNA, 149 bp, Homo sapiens; identical to SEQ ID NO: 402
  misc_feature 1..149: note = chr4:155663475-155663624
  misc_feature 1..149: note = hyper
  source 1..149: mol_type = genomic DNA

SEQ ID NO: 7583 - DNA, 110 bp, Homo sapiens
  misc_feature 1..110: note = chr4:155664194-155664304
  misc_feature 1..110: note = hyper
  source 1..110: mol_type = genomic DNA
acaggtgcctaggagcgcagagaggcctcgggttcaaatcaccggcgcgcagggactggactcgcgggtagcgacccccccaacccccccccccccgccctacacacaca

SEQ ID NO: 7584 - DNA, 63 bp, Homo sapiens
  misc_feature 1..63: note = chr4:155665385-155665448
  misc_feature 1..63: note = hyper
  source 1..63: mol_type = genomic DNA
cgcagcacccctgcccggcgagcttaacttgcccagcccggcccctgccggagtggcaccggc

SEQ ID NO: 7585 - DNA, 30 bp, Homo sapiens
  misc_feature 1..30: note = chr4:155665748-155665778
  misc_feature 1..30: note = hyper
  source 1..30: mol_type = genomic DNA
gtggtctccaacaagcgtctcatcctgggc

SEQ ID NO: 7586 - DNA, 480 bp, Homo sapiens; identical to SEQ ID NO: 2478
  misc_feature 1..480: note = chr4:156129606-156130086
  misc_feature 1..480: note = hyper
  source 1..480: mol_type = genomic DNA

SEQ ID NO: 7587 - DNA, 140 bp, Homo sapiens
  misc_feature 1..140: note = chr4:156297416-156297556
  misc_feature 1..140: note = hyper
  source 1..140: mol_type = genomic DNA
ggccatcaaaaggatcgtcggcgtaaaaattatgagcaccaccaccaaaaaaaaaatgtatctatatatttgcatacagcgctattcaaagaaaaagatcgtaatgctaacccgcaaacagccagcgagatgtattgcaa

SEQ ID NO: 7588 - DNA, 27 bp, Homo sapiens
  misc_feature 1..27: note = chr4:156297941-156297968
  misc_feature 1..27: note = hyper
  source 1..27: mol_type = genomic DNA
cgcccgcagagccggtcctggaccgag

SEQ ID NO: 7589 - DNA, 162 bp, Homo sapiens
  misc_feature 1..162: note = chr4:156588521-156588683
  misc_feature 1..162: note = hyper
  source 1..162: mol_type = genomic DNA
gagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtac

SEQ ID NO: 7590 - DNA, 130 bp, Homo sapiens
  misc_feature 1..130: note = chr4:156588684-156588814
  misc_feature 1..130: note = hyper
  source 1..130: mol_type = genomic DNA
ctcccagttgcccagccctgggaagccagcatcgggttcccacgctggggaggagcgagaggaaaggagaggacgcccgaggggccggcccagggcccgggggacccgcggcgcccgagggaggagcaca

SEQ ID NO: 7591 - DNA, 70 bp, Homo sapiens
  misc_feature 1..70: note = chr4:156680699-156680769
  misc_feature 1..70: note = hyper
  source 1..70: mol_type = genomic DNA
agggtgggaagatagcgtgggggtggggcggatggtgacggggagaatccaccagggattggggggttgc

SEQ ID NO: 7592 - DNA, 200 bp, Homo sapiens
  misc_feature 1..200: note = chr4:156680770-156680970
  misc_feature 1..200: note = hyper
  source 1..200: mol_type = genomic DNA
cccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgct

SEQ ID NO: 7593 - DNA, 32 bp, Homo sapiens
  misc_feature 1..32: note = chr4:158142980-158143012
  misc_feature 1..32: note = hyper
  source 1..32: mol_type = genomic DNA
ctttcgggtgctgcacgcggaaggccagcgag

SEQ ID NO: 7594 - DNA, 97 bp, Homo sapiens
  misc_feature 1..97: note = chr4:158143369-158143466
  misc_feature 1..97: note = hyper
  source 1..97: mol_type = genomic DNA
gttggacaaatcccacgagggactgccggagcccagtggcctcctgccccagcagctgccgctctcgcccgctgcccccagtttagatccgcagcac

SEQ ID NO: 7595 - DNA, 30 bp, Homo sapiens
  misc_feature 1..30: note = chr4:158144242-158144272
  misc_feature 1..30: note = hyper
  source 1..30: mol_type = genomic DNA
actgcagttttcccacgtcacacaaacaac

SEQ ID NO: 7596 - DNA, 16 bp, Homo sapiens
  misc_feature 1..16: note = chr4:164253191-164253207
  misc_feature 1..16: note = hyper
  source 1..16: mol_type = genomic DNA
cccagccagttactcc

SEQ ID NO: 7597 - DNA, 120 bp, Homo sapiens
  misc_feature 1..120: note = chr4:164253208-164253328
  misc_feature 1..120: note = hyper
  source 1..120: mol_type = genomic DNA
cgaaaactccggtgcggccagagccagcgcctccagccagctcaagacacgtaaggaaaatgagcgggtgtgggataggcgaactcgggcgccttcccagtgcctcggccttttaaagag

SEQ ID NO: 7598 - DNA, 30 bp, Homo sapiens
  misc_feature 1..30: note = chr4:164264670-164264700
  misc_feature 1..30: note = hyper
  source 1..30: mol_type = genomic DNA
ataaaacctgagagtcgaagcttgttctca

SEQ ID NO: 7599 - DNA, 98 bp, Homo sapiens; identical to SEQ ID NO: 2479
  misc_feature 1..98: note = chr4:164265532-164265630
  misc_feature 1..98: note = hyper
  source 1..98: mol_type = genomic DNA

SEQ ID NO: 7600 - DNA, 167 bp, Homo sapiens
  misc_feature 1..167: note = chr4:165304472-165304639
  misc_feature 1..167: note = hyper
  source 1..167: mol_type = genomic DNA
cgactcagggttgagcgcatcagcgctaaacccaagacaaaggctgccctgtgtcttccgtactcagcgctctcctttggtaatcggtccccgtccccttcaagcccacactaggagcgcgtgagcctgtgaagtggctgtcatcgactccgcgctttccgaggggt

SEQ ID NO: 7601 - DNA, 95 bp, Homo sapiens; identical to SEQ ID NO: 2480
  misc_feature 1..95: note = chr4:165305095-165305190
  misc_feature 1..95: note = hyper
  source 1..95: mol_type = genomic DNA

SEQ ID NO: 7602 - DNA, 61 bp, Homo sapiens
  misc_feature 1..61: note = chr4:166300073-166300134
  misc_feature 1..61: note = hyper
  source 1..61: mol_type = genomic DNA
gccctcccagatccacgccggcccgtctctccgccggccccctcctcgcagtggtttctcc

SEQ ID NO: 7603 - DNA, 43 bp, Homo sapiens
  misc_feature 1..43: note = chr4:166300367-166300410
  misc_feature 1..43: note = hyper
  source 1..43: mol_type = genomic DNA
gcagcgatggccgggcgagggggcagcgcgctgctggctctgt

SEQ ID NO: 7604 - DNA, 30 bp, Homo sapiens
  misc_feature 1..30: note = chr4:166793825-166793855
  misc_feature 1..30: note = hyper
  source 1..30: mol_type = genomic DNA
ctgcaatctgtaactcgattttggattttt

SEQ ID NO: 7605 - DNA, 466 bp, Homo sapiens
  misc_feature 1..466: note = chr4:166794697-166795163
  misc_feature 1..466: note = hyper
  source 1..466: mol_type = genomic DNA
cggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacac

SEQ ID NO: 7606 - DNA, 148 bp, Homo sapiens
  misc_feature 1..148: note = chr4:166796117-166796265
  misc_feature 1..148: note = hyper
  source 1..148: mol_type = genomic DNA
cggctcgtgtccgggcttcgggagctcctggttccttgctctattgggctgtggctgaggtgatccgcgctcagtgtggacgcacaagtaacttcgtaaaggttgcatggtggttggggctaacctagcagagcggtttgtaagcgga

SEQ ID NO: 7607 - DNA, 383 bp, Homo sapiens
  misc_feature 1..383: note = chr4:168155125-168155508
  misc_feature 1..383: note = hyper
  source 1..383: mol_type = genomic DNA
cggaacttacgtctcggaatttgttccactgtccgacttccttgtcatactgagagattgtggtgagccattgtttatcatccagaaaattaccgccgtccgaccgccccccggctgcagccaccgccgcggcagctgcgagagactgactgcaccaagcggctgcacacacacacagtacggctgacaccttgagcatctgggagaggagacacaacggggggtgggggggcatgtcagtgtcaaataaggggtacgaagccaggagcgaccctggaaaacatgcattagcaacgacgagggtagagggaggaggagacaagcagaggcaagcgtgtcccctccccgcaggctttacccccaaaagccgggcactcacacac

SEQ ID NO: 7608 - DNA, 98 bp, Homo sapiens; identical to SEQ ID NO: 2481
  misc_feature 1..98: note = chr4:172733771-172733869
  misc_feature 1..98: note = hyper
  source 1..98: mol_type = genomic DNA

SEQ ID NO: 7609 - DNA, 88 bp, Homo sapiens; identical to SEQ ID NO: 403
  misc_feature 1..88: note = chr4:172734188-172734276
  misc_feature 1..88: note = hyper
  source 1..88: mol_type = genomic DNA

SEQ ID NO: 7610 - DNA, 115 bp, Homo sapiens; identical to SEQ ID NO: 404
  misc_feature 1..115: note = chr4:172734277-172734392
  misc_feature 1..115: note = hyper
  source 1..115: mol_type = genomic DNA

SEQ ID NO: 7611 - DNA, 14 bp, Homo sapiens
  misc_feature 1..14: note = chr4:172734591-172734605
  misc_feature 1..14: note = hyper
  source 1..14: mol_type = genomic DNA
ggggagtggggcgc

SEQ ID NO: 7612 - DNA, 30 bp, Homo sapiens
  misc_feature 1..30: note = chr4:174429648-174429678
  misc_feature 1..30: note = hyper
  source 1..30: mol_type = genomic DNA
cggacctctgcagtccgtcgcaggacgccc

SEQ ID NO: 7613 - DNA, 244 bp, Homo sapiens; identical to SEQ ID NO: 406
  misc_feature 1..244: note = chr4:174430310-174430554
  misc_feature 1..244: note = hyper
  source 1..244: mol_type = genomic DNA

SEQ ID NO: 7614 - DNA, 279 bp, Homo sapiens; identical to SEQ ID NO: 407
  misc_feature 1..279: note = chr4:174430793-174431072
  misc_feature 1..279: note = hyper
  source 1..279: mol_type = genomic DNA

SEQ ID NO: 7615 - DNA, 30 bp, Homo sapiens
  misc_feature 1..30: note = chr4:174438209-174438239
  misc_feature 1..30: note = hyper
  source 1..30: mol_type = genomic DNA
ggaaggagaggaccacgaggctcccggcgc

SEQ ID NO: 7616 - DNA, 299 bp, Homo sapiens; identical to SEQ ID NO: 2487
  misc_feature 1..299: note = chr4:174439888-174440187
  misc_feature 1..299: note = hyper
  source 1..299: mol_type = genomic DNA

SEQ ID NO: 7617 - DNA, 66 bp, Homo sapiens
  misc_feature 1..66: note = chr4:174440647-174440713
  misc_feature 1..66: note = hyper
  source 1..66: mol_type = genomic DNA
ccacgcacacagccacggcccctcgcgtcttcgcggcacgttaattaaatgcggaaaacagacaga

SEQ ID NO: 7618 - DNA, 383 bp, Homo sapiens; identical to SEQ ID NO: 2488
  misc_feature 1..383: note = chr4:174443551-174443934
  misc_feature 1..383: note = hyper
  source 1..383: mol_type = genomic DNA

SEQ ID NO: 7619 - DNA, 360 bp, Homo sapiens; identical to SEQ ID NO: 2489
  misc_feature 1..360: note = chr4:174449950-174450310
  misc_feature 1..360: note = hyper
  source 1..360: mol_type = genomic DNA

SEQ ID NO: 7620 - DNA, 162 bp, Homo sapiens; identical to SEQ ID NO: 2490
  misc_feature 1..162: note = chr4:174450565-174450727
  misc_feature 1..162: note = hyper
  source 1..162: mol_type = genomic DNA

SEQ ID NO: 7621 - DNA, 173 bp, Homo sapiens; identical to SEQ ID NO: 2491
  misc_feature 1..173: note = chr4:174450751-174450924
  misc_feature 1..173: note = hyper
  source 1..173: mol_type = genomic DNA

SEQ ID NO: 7622 - DNA, 243 bp, Homo sapiens; identical to SEQ ID NO: 408
  misc_feature 1..243: note = chr4:174451855-174452098
  misc_feature 1..243: note = hyper
  source 1..243: mol_type = genomic DNA

SEQ ID NO: 7623 - DNA, 30 bp, Homo sapiens
  misc_feature 1..30: note = chr4:174459927-174459957
  misc_feature 1..30: note = hyper
  source 1..30: mol_type = genomic DNA
cctctgcgctccgggcgggtggaggaagcg

SEQ ID NO: 7624 - DNA, 47 bp, Homo sapiens
  misc_feature 1..47: note = chr4:175133127-175133174
  misc_feature 1..47: note = hyper
  source 1..47: mol_type = genomic DNA
aatccccagctccctcgcgtcagcgaatgtcccgctggtccaggcag

SEQ ID NO: 7625 - DNA, 67 bp, Homo sapiens
  misc_feature 1..67: note = chr4:175134868-175134935
  misc_feature 1..67: note = hyper
  source 1..67: mol_type = genomic DNA
cctctgggtccttaccgaaagggaaggtcccaaaggaccaccagcgcgctctcggaggctccaggac

SEQ ID NO: 7626 - DNA, 435 bp, Homo sapiens; identical to SEQ ID NO: 2493
  misc_feature 1..435: note = chr4:175135253-175135688
  misc_feature 1..435: note = hyper
  source 1..435: mol_type = genomic DNA

SEQ ID NO: 7627 - DNA, 30 bp, Homo sapiens
  misc_feature 1..30: note = chr4:175137723-175137753
  misc_feature 1..30: note = hyper
  source 1..30: mol_type = genomic DNA
gcgtttctctaagtccgagcccccatctct

SEQ ID NO: 7628 - DNA, 256 bp, Homo sapiens
  misc_feature 1..256: note = chr4:175138513-175138769
  misc_feature 1..256: note = hyper
  source 1..256: mol_type = genomic DNA
acgtacagggaactgcgccgcagttaatgcagaggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggct

SEQ ID NO: 7629 - DNA, 109 bp, Homo sapiens
  misc_feature 1..109: note = chr4:175139224-175139333
  misc_feature 1..109: note = hyper
  source 1..109: mol_type = genomic DNA
gacctctaatagggtcggtggaagctaatttgaatcttcccagttccttccctgtttatttctcaacccagcagttcaaaaattcactttataacggtcccctaacaaa

SEQ ID NO: 7630 - DNA, 54 bp, Homo sapiens
  misc_feature 1..54: note = chr4:175139631-175139685
  misc_feature 1..54: note = hyper
  source 1..54: mol_type = genomic DNA
acccagcctggcagtcggaagacagtgagataaagaatgcgatagtaagtcctt

SEQ ID NO: 7631 - DNA, 387 bp, Homo sapiens; identical to SEQ ID NO: 2494
  misc_feature 1..387: note = chr4:175750264-175750651
  misc_feature 1..387: note = hyper
  source 1..387: mol_type = genomic DNA

SEQ ID NO: 7632 - DNA, 57 bp, Homo sapiens
  misc_feature 1..57: note = chr4:176923024-176923081
  misc_feature 1..57: note = hyper
  source 1..57: mol_type = genomic DNA
aagagaacatgaaaacgtgggaactcgggaggacagagatctccctgtaatcgcctc

SEQ ID NO: 7633 - DNA, 20 bp, Homo sapiens
  misc_feature 1..20: note = chr4:176923082-176923102
  misc_feature 1..20: note = hyper
  source 1..20: mol_type = genomic DNA
ctattcggatcctgggtctc

SEQ ID NO: 7634 - DNA, 241 bp, Homo sapiens
  misc_feature 1..241: note = chr4:176923402-176923643
  misc_feature 1..241: note = hyper
  source 1..241: mol_type = genomic DNA
gcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctcc

SEQ ID NO: 7635 - DNA, 124 bp, Homo sapiens; identical to SEQ ID NO: 2495
  misc_feature 1..124: note = chr4:176987050-176987174
  misc_feature 1..124: note = hyper
  source 1..124: mol_type = genomic DNA

SEQ ID NO: 7636 - skipped

SEQ ID NO: 7637 - DNA, 107 bp, Homo sapiens; identical to SEQ ID NO: 2497
  misc_feature 1..107: note = chr4:176987206-176987313
  misc_feature 1..107: note = hyper
  source 1..107: mol_type = genomic DNA

SEQ ID NO: 7638 - DNA, 13 bp, Homo sapiens
  misc_feature 1..13: note = chr4:176987314-176987327
  misc_feature 1..13: note = hyper
  source 1..13: mol_type = genomic DNA
agaggggctctga

SEQ ID NO: 7639 - DNA, 39 bp, Homo sapiens
  misc_feature 1..39: note = chr4:177713271-177713310
  misc_feature 1..39: note = hyper
  source 1..39: mol_type = genomic DNA
cctaacgcaaactctcgggttctccgcaaaccctaacgc

SEQ ID NO: 7640 - DNA, 530 bp, Homo sapiens
  misc_feature 1..530: note = chr4:177713662-177714192
  misc_feature 1..530: note = hyper
  source 1..530: mol_type = genomic DNA
agtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagct

SEQ ID NO: 7641 - DNA, 30 bp, Homo sapiens
  misc_feature 1..30: note = chr4:180979304-180979334
  misc_feature 1..30: note = hyper
  source 1..30: mol_type = genomic DNA
gggtctggagtgtcacgtaggcaccccaac

SEQ ID NO: 7642 - DNA, 91 bp, Homo sapiens
  misc_feature 1..91: note = chr4:183062455-183062546
  misc_feature 1..91: note = hyper
  source 1..91: mol_type = genomic DNA
acgacgtgagctgcccgccatccccgccctctcttgacaacagctcagtgaggtaaaaagcatgatggtcacgtagcgagctgcctctctg

SEQ ID NO: 7643 - DNA, 155 bp, Homo sapiens
  misc_feature 1..155: note = chr4:183063795-183063950
  misc_feature 1..155: note = hyper
  source 1..155: mol_type = genomic DNA
cgacgaggctgagagcgcaccagtctccgccacgcttccaaggacaggttggcgacggccggggcaggcctggtcgcgggctcctagccctccacgggcagactgctggtcccaggagagggcggggagatgctcgggcgcgcaccagggagccg

SEQ ID NO: 7644 - DNA, 38 bp, Homo sapiens
  misc_feature 1..38: note = chr4:183064617-183064655
  misc_feature 1..38: note = hyper
  source 1..38: mol_type = genomic DNA
ttctgcctcggaatccgtcttcccggcagtgtcttgca

SEQ ID NO: 7645 - DNA, 30 bp, Homo sapiens
  misc_feature 1..30: note = chr4:183065138-183065168
  misc_feature 1..30: note = hyper
  source 1..30: mol_type = genomic DNA
gaaaaaggcagtaaacggggaatctctttt

SEQ ID NO: 7646 - DNA, 76 bp, Homo sapiens
  misc_feature 1..76: note = chr4:184718260-184718336
  misc_feature 1..76: note = hyper
  source 1..76: mol_type = genomic DNA
gagcgtggggaggagcgacactcgccgctccggaatccgtgccttccaagtgtcgccgttgcgtcccccgcaaccc

SEQ ID NO: 7647 - DNA, 69 bp, Homo sapiens
  misc_feature 1..69: note = chr4:184826238-184826307
  misc_feature 1..69: note = hyper
  source 1..69: mol_type = genomic DNA
tttgaaaacccaaatcgaggagataaccgtttttgaatgaacggcagtgcaaagcgtggtcggggttag

SEQ ID NO: 7648 - DNA, 33 bp, Homo sapiens
  misc_feature 1..33: note = chr4:184826624-184826657
  misc_feature 1..33: note = hyper
  source 1..33: mol_type = genomic DNA
ggttgtgggggagctcgccgtggcctcccctcc

SEQ ID NO: 7649 - DNA, 35 bp, Homo sapiens
  misc_feature 1..35: note = chr4:184827167-184827202
  misc_feature 1..35: note = hyper
  source 1..35: mol_type = genomic DNA
ctgcagtcgcggggacgacgcgggctcttcctgga

SEQ ID NO: 7650 - DNA, 164 bp, Homo sapiens
  misc_feature 1..164: note = chr4:185937754-185937918
  misc_feature 1..164: note = hyper
  source 1..164: mol_type = genomic DNA
gcagaaaggaaacatcgtgaggagactagaggcaggaccgagagggacaccctaggggtgcgaggtgcagaccgagccctcacatctcccaggccgcagcaggtgggccgatggcttccccgaggcctggcaccccaggcctggctctgcgccctgaggctccc

SEQ ID NO: 7651 - DNA, 391 bp, Homo sapiens
  misc_feature 1..391: note = chr4:185938343-185938734
  misc_feature 1..391: note = hyper
  source 1..391: mol_type = genomic DNA
ccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattgatgcccaaagtgtctgcgctctcccgcccccaaacgttaagaaaagacgccagcgaaagggagacataaaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgt

SEQ ID NO: 7652 - DNA, 212 bp, Homo sapiens
  misc_feature 1..212: note = chr4:185939694-185939906
  misc_feature 1..212: note = hyper
  source 1..212: mol_type = genomic DNA
ccggccccagtttaccgcctccttttcccgcccgagctgttgccatgcaaatgttattcctgggccgatcacgtgtcctttgaagggccacgtggattaacaaagctgatctgcccccagctcgcccccctcggctgctaattttttttttttcttaacttctttaaaactgatcttgaatgcatacatcctccaaacgcagctcccctaat

SEQ ID NO: 7653 - DNA, 88 bp, Homo sapiens
  misc_feature 1..88: note = chr4:185940294-185940382
  misc_feature 1..88: note = hyper
  source 1..88: mol_type = genomic DNA
ctgcctggaggctggcggccacctccccaaaggcctgggtagggtggctggaaggggagcgcgccagcgcgggcgtcagaaggcagag

SEQ ID NO: 7654 - DNA, 67 bp, Homo sapiens
  misc_feature 1..67: note = chr4:185941560-185941627
  misc_feature 1..67: note = hyper
  source 1..67: mol_type = genomic DNA
ttgcagtccaaggcccgcctgggcgcggagcccgcctttccgccgctgggttcgctcccggagccgg

SEQ ID NO: 7655 - DNA, 315 bp, Homo sapiens; identical to SEQ ID NO: 2499
  misc_feature 1..315: note = chr4:185941868-185942183
  misc_feature 1..315: note = hyper
  source 1..315: mol_type = genomic DNA

SEQ ID NO: 7656 - DNA, 443 bp, Homo sapiens
  misc_feature 1..443: note = chr4:185942491-185942934
  misc_feature 1..443: note = hyper
  source 1..443: mol_type = genomic DNA
cgcccgcgggtctggaatgcggcgaaacccgggccagcggggcgcgtggctgagtttacagaattaaaaatcctctaaaaaataccggaaccaagtacagttctgagttgcggattagaaacaacatcgttgatgacaactgctcagcgccagaggcttccgagaagctggcgttgccttttgcgcacagagcaggccagcttcgggggcgctgggcgtctcggcgagaggtcggcacctgccgggttgggagacgccccttccccaccccttaggggattgttccctacacgccatcctttaccattcggacactggtgcaggatggagaccctggggtctccgtttaagttctcaggcttggagagaaaagtcctccttatcctttccccagtgagatttttttttttatctcgccccacccagaacgtggtgaggaaagt

SEQ ID NO: 7657 - DNA, 40 bp, Homo sapiens
  misc_feature 1..40: note = chr4:186048748-186048788
  misc_feature 1..40: note = hyper
  source 1..40: mol_type = genomic DNA
ttgctgagttatgtccgggcgagatcggtgtccttcaggg

SEQ ID NO: 7658 - DNA, 70 bp, Homo sapiens
  misc_feature 1..70: note = chr4:186049492-186049562
  misc_feature 1..70: note = hyper
  source 1..70: mol_type = genomic DNA
tccaggcgtgagccccgcgccctccccttgcggagattcggcctggaaagctccgcggctctggccggca

SEQ ID NO: 7659 - DNA, 57 bp, Homo sapiens
  misc_feature 1..57: note = chr4:186049764-186049821
  misc_feature 1..57: note = hyper
  source 1..57: mol_type = genomic DNA
agagcgcagcagaggcggggaggaggcgcgagcggaggggaccgacttccaccgcac

SEQ ID NO: 7660 - DNA, 61 bp, Homo sapiens
  misc_feature 1..61: note = chr5:53500-53561
  misc_feature 1..61: note = hyper
  source 1..61: mol_type = genomic DNA
cgagtccccttctcaggcaggctgtgggggttggggttgggcttcgcgagcccaagcggac

SEQ ID NO: 7661 - DNA, 50 bp, Homo sapiens
  misc_feature 1..50: note = chr5:53849-53899
  misc_feature 1..50: note = hyper
  source 1..50: mol_type = genomic DNA
ggggacctcggtgcccggagctgctgcccaggtaaccgcgctgcgcccgg

SEQ ID NO: 7662 - DNA, 30 bp, Homo sapiens
  misc_feature 1..30: note = chr5:54402-54432
  misc_feature 1..30: note = hyper
  source 1..30: mol_type = genomic DNA
ccacgctcctgtgtgcgagaggggcctggt

SEQ ID NO: 7663 - DNA, 74 bp, Homo sapiens
  misc_feature 1..74: note = chr5:92039-92113
  misc_feature 1..74: note = hyper
  source 1..74: mol_type = genomic DNA
caggtccccgagctccgggctccgagagaacaaaagcagaagccactgccgcccgcgctcggggaggagccgcc

SEQ ID NO: 7664 - DNA, 494 bp, Homo sapiens
  misc_feature 1..494: note = chr5:320840-321334
  misc_feature 1..494: note = hyper
  source 1..494: mol_type = genomic DNA
agggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagc

SEQ ID NO: 7665 - DNA, 213 bp, Homo sapiens
  misc_feature 1..213: note = chr5:374129-374342
  misc_feature 1..213: note = hyper
  source 1..213: mol_type = genomic DNA
aaaggccggggctgccgggtccgcggggcgcattgcgggtgggacggggtcggctccgctgcgggagcgacccctgcaatggggcttggctgcaccggccgcctgggtggtcggtctgtgtgcgggtgacccaggcgtgtgcccccacccgcgctgccccagcccgcggacctcggcggggagcgcccagggccagcacgggggtctcacggg

SEQ ID NO: 7666 - DNA, 67 bp, Homo sapiens
  misc_feature 1..67: note = chr5:524337-524404
  misc_feature 1..67: note = hyper
  source 1..67: mol_type = genomic DNA
cgccgggctccacctcgacgcccccggcccgcgccagcccgcccagcgccagcgccagcagcagccc

SEQ ID NO: 7667 - DNA, 82 bp, Homo sapiens
  misc_feature 1..82: note = chr5:524772-524854
  misc_feature 1..82: note = hyper
  source 1..82: mol_type = genomic DNA
gcgagcccgggactgcgcggccgccttcctggggcgtggggagcacagcgcggggcagcgggacaggcggttccgcgcagct

SEQ ID NO: 7668 - DNA, 836 bp, Homo sapiens; identical to SEQ ID NO: 409
  misc_feature 1..836: note = chr5:1294607-1295443
  misc_feature 1..836: note = hyper
  source 1..836: mol_type = genomic DNA

SEQ ID NO: 7669 - DNA, 75 bp, Homo sapiens; identical to SEQ ID NO: 410
  misc_feature 1..75: note = chr5:1295604-1295679
  misc_feature 1..75: note = hyper
  source 1..75: mol_type = genomic DNA

SEQ ID NO: 7670 - DNA, 52 bp, Homo sapiens
  misc_feature 1..52: note = chr5:1444711-1444763
  misc_feature 1..52: note = hyper
  source 1..52: mol_type = genomic DNA
ccggcacgacccctccggtgggtaaaacacccgacgaaggggttccgcggcg

SEQ ID NO: 7671 - DNA, 99 bp, Homo sapiens
  misc_feature 1..99: note = chr5:1445157-1445256
  misc_feature 1..99: note = hyper
  source 1..99: mol_type = genomic DNA
agccatagacacccacgcgtcccctaagccggtgactgcaccaggtgcccacccggttctgagcctggagcggggccaggggcagccctgcaccctcct

SEQ ID NO: 7672 - DNA, 114 bp, Homo sapiens
  misc_feature 1..114: note = chr5:1445840-1445954
  misc_feature 1..114: note = hyper
  source 1..114: mol_type = genomic DNA
cgcccgcacccctgggggctgccccgggcacccgctatcttcggacgcccagggctggcggctcccagctggacggggagggagccgagcggctgcgcgcggggaactgctggg

SEQ ID NO: 7673 - DNA, 126 bp, Homo sapiens; identical to SEQ ID NO: 2502
  misc_feature 1..126: note = chr5:1446236-1446362
  misc_feature 1..126: note = hyper
  source 1..126: mol_type = genomic DNA

SEQ ID NO: 7674 - DNA, 214 bp, Homo sapiens
  misc_feature 1..214: note = chr5:1667861-1668075
  misc_feature 1..214: note = hyper
  source 1..214: mol_type = genomic DNA
cctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaac

SEQ ID NO: 7675 - DNA, 133 bp, Homo sapiens
  misc_feature 1..133: note = chr5:1851756-1851889
  misc_feature 1..133: note = hyper
  source 1..133: mol_type = genomic DNA
tggagtggctcaggccgctgatgagggtgctcggggcagggctcttctctgagtgacgttggaggttttcacggtgaacacagaaaggggcactccgtccgagctgagcctcagggaccgtgaggcttgctct

SEQ ID NO: 7676 - DNA, 517 bp, Homo sapiens; identical to SEQ ID NO: 411
  misc_feature 1..517: note = chr5:1875025-1875542
  misc_feature 1..517: note = hyper
  source 1..517: mol_type = genomic DNA

SEQ ID NO: 7677 - DNA, 478 bp, Homo sapiens; identical to SEQ ID NO: 412
  misc_feature 1..478: note = chr5:1875829-1876307
  misc_feature 1..478: note = hyper
  source 1..478: mol_type = genomic DNA

SEQ ID NO: 7678 - DNA, 223 bp, Homo sapiens; identical to SEQ ID NO: 413
  misc_feature 1..223: note = chr5:1876637-1876860
  misc_feature 1..223: note = hyper
  source 1..223: mol_type = genomic DNA

SEQ ID NO: 7679 - DNA, 28 bp, Homo sapiens
  misc_feature 1..28: note = chr5:1877194-1877222
  misc_feature 1..28: note = hyper
  source 1..28: mol_type = genomic DNA
cgatgggctcccacgcccccccccggga

SEQ ID NO: 7680 - DNA, 15 bp, Homo sapiens
  misc_feature 1..15: note = chr5:1878014-1878029
  misc_feature 1..15: note = hyper
  source 1..15: mol_type = genomic DNA
ctcagtgaaaagagt

SEQ ID NO: 7681 - DNA, 354 bp, Homo sapiens; identical to SEQ ID NO: 2508
  misc_feature 1..354: note = chr5:1878223-1878577
  misc_feature 1..354: note = hyper
  source 1..354: mol_type = genomic DNA

SEQ ID NO: 7682 - DNA, 43 bp, Homo sapiens; identical to SEQ ID NO: 2509
  misc_feature 1..43: note = chr5:1878830-1878873
  misc_feature 1..43: note = hyper
  source 1..43: mol_type = genomic DNA

SEQ ID NO: 7683 - DNA, 124 bp, Homo sapiens
  misc_feature 1..124: note = chr5:1879538-1879662
  misc_feature 1..124: note = hyper
  source 1..124: mol_type = genomic DNA
aagacgtcctagaaccgcagagaaggcactgtgcctgcactccagggcctcagcccccagtgacaacctcccaacccacctgcgttcttggagctcttgaggggctcctcccgcgcctcctcct

SEQ ID NO: 7684 - skipped

SEQ ID NO: 7685 - DNA, 503 bp, Homo sapiens; identical to SEQ ID NO: 2510
  misc_feature 1..503: note = chr5:1882419-1882922
  misc_feature 1..503: note = hyper
  source 1..503: mol_type = genomic DNA

SEQ ID NO: 7686 - DNA, 187 bp, Homo sapiens; identical to SEQ ID NO: 414
  misc_feature 1..187: note = chr5:1883430-1883617
  misc_feature 1..187: note = hyper
  source 1..187: mol_type = genomic DNA

SEQ ID NO: 7687 - DNA, 347 bp, Homo sapiens; identical to SEQ ID NO: 415
  misc_feature 1..347: note = chr5:1883879-1884226
  misc_feature 1..347: note = hyper
  source 1..347: mol_type = genomic DNA

SEQ ID NO: 7688 - DNA, 174 bp, Homo sapiens; identical to SEQ ID NO: 416
  misc_feature 1..174: note = chr5:1884557-1884731
  misc_feature 1..174: note = hyper
  source 1..174: mol_type = genomic DNA

SEQ ID NO: 7689 - DNA, 67 bp, Homo sapiens; identical to SEQ ID NO: 417
  misc_feature 1..67: note = chr5:1885314-1885381
  misc_feature 1..67: note = hyper
  source 1..67: mol_type = genomic DNA

SEQ ID NO: 7690 - DNA, 16 bp, Homo sapiens
  misc_feature 1..16: note = chr5:1886061-1886077
  misc_feature 1..16: note = hyper
  source 1..16: mol_type = genomic DNA
gggccagaagtcagcc

SEQ ID NO: 7691 - DNA, 160 bp, Homo sapiens
  misc_feature 1..160: note = chr5:1886379-1886539
  misc_feature 1..160: note = hyper
  source 1..160: mol_type = genomic DNA
ggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtggg

SEQ ID NO: 7692 - DNA, 103 bp, Homo sapiens; identical to SEQ ID NO: 418
  misc_feature 1..103: note = chr5:1886739-1886842
  misc_feature 1..103: note = hyper
  source 1..103: mol_type = genomic DNA

SEQ ID NO: 7693 - DNA, 149 bp, Homo sapiens; identical to SEQ ID NO: 419
  misc_feature 1..149: note = chr5:1886997-1887146
  misc_feature 1..149: note = hyper
  source 1..149: mol_type = genomic DNA

SEQ ID NO: 7694 - DNA, 36 bp, Homo sapiens; identical to SEQ ID NO: 420
  misc_feature 1..36: note = chr5:1887546-1887582
  misc_feature 1..36: note = hyper
  source 1..36: mol_type = genomic DNA

SEQ ID NO: 7695 - DNA, 101 bp, Homo sapiens; identical to SEQ ID NO: 421
  misc_feature 1..101: note = chr5:1887655-1887756
  misc_feature 1..101: note = hyper
  source 1..101: mol_type = genomic DNA

SEQ ID NO: 7696 - DNA, 31 bp, Homo sapiens; identical to SEQ ID NO: 422
  misc_feature 1..31: note = chr5:1930974-1931005
  misc_feature 1..31: note = hyper
  source 1..31: mol_type = genomic DNA

SEQ ID NO: 7697 - DNA, 223 bp, Homo sapiens; identical to SEQ ID NO: 423
  misc_feature 1..223: note = chr5:1931064-1931287
  misc_feature 1..223: note = hyper
  source 1..223: mol_type = genomic DNA

SEQ ID NO: 7698 - DNA, 133 bp, Homo sapiens; identical to SEQ ID NO: 424
  misc_feature 1..133: note = chr5:1931444-1931577
  misc_feature 1..133: note = hyper
  source 1..133: mol_type = genomic DNA

SEQ ID NO: 7699 - DNA, 349 bp, Homo sapiens; identical to SEQ ID NO: 425
  misc_feature 1..349: note = chr5:1931617-1931966
  misc_feature 1..349: note = hyper
  source 1..349: mol_type = genomic DNA

SEQ ID NO: 7700 - DNA, 424 bp, Homo sapiens; identical to SEQ ID NO: 2523
  misc_feature 1..424: note = chr5:2038439-2038863
  misc_feature 1..424: note = hyper
  source 1..424: mol_type = genomic DNA

SEQ ID NO: 7701 - DNA, 160 bp, Homo sapiens; identical to SEQ ID NO: 2524
  misc_feature 1..160: note = chr5:2738820-2738980
  misc_feature 1..160: note = hyper
  source 1..160: mol_type = genomic DNA

SEQ ID NO: 7702 - DNA, 28 bp, Homo sapiens
  misc_feature 1..28: note = chr5:2739210-2739238
  misc_feature 1..28: note = hyper
  source 1..28: mol_type = genomic DNA
cgaggggactcaacgcgctttgtagggc

SEQ ID NO: 7703 - DNA, 51 bp, Homo sapiens
  misc_feature 1..51: note = chr5:2739946-2739997
  misc_feature 1..51: note = hyper
  source 1..51: mol_type = genomic DNA
tgggaggcaagaggtcgggggaggccggggtcagggcgggaggaacccgat

SEQ ID NO: 7704 - DNA, 42 bp, Homo sapiens
  misc_feature 1..42: note = chr5:2740259-2740301
  misc_feature 1..42: note = hyper
  source 1..42: mol_type = genomic DNA
ggccgggtctggggccgccggggcagtcgtggcgtgcggggg

SEQ ID NO: 7705 - DNA, 235 bp, Homo sapiens
  misc_feature 1..235: note = chr5:2740430-2740665
  misc_feature 1..235: note = hyper
  source 1..235: mol_type = genomic DNA
cggtcacaccggggctgaggtcaggagccggctcaccccctctcctgcgactgttccctgacctgcgactgttcggttctcccgactggccttggtcgttgccttttagggtctcggtgtgaccaactaagcagacactcagcggcagcgccgcgcttggggagactgcagggcagaaatgggcctagaggtgaaggagcccttcccaaatcggacagtcccggggctggagagc

SEQ ID NO: 7706 - DNA, 43 bp, Homo sapiens; identical to SEQ ID NO: 2525
  misc_feature 1..43: note = chr5:2743617-2743660
  misc_feature 1..43: note = hyper
  source 1..43: mol_type = genomic DNA

SEQ ID NO: 7707 - DNA, 46 bp, Homo sapiens; identical to SEQ ID NO: 2526
  misc_feature 1..46: note = chr5:2743698-2743744
  misc_feature 1..46: note = hyper
  source 1..46: mol_type = genomic DNA

SEQ ID NO: 7708 - DNA, 42 bp, Homo sapiens
  misc_feature 1..42: note = chr5:2748353-2748395
  misc_feature 1..42: note = hyper
  source 1..42: mol_type = genomic DNA
cctggatcttcttcccggaccctccctcgggtctcccgggcg

SEQ ID NO: 7709 - DNA, 146 bp, Homo sapiens
  misc_feature 1..146: note = chr5:2749261-2749407
  misc_feature 1..146: note = hyper
  source 1..146: mol_type = genomic DNA
cgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtc

SEQ ID NO: 7710 - DNA, 83 bp, Homo sapiens; identical to SEQ ID NO: 2527
  misc_feature 1..83: note = chr5:2751854-2751937
  misc_feature 1..83: note = hyper
  source 1..83: mol_type = genomic DNA

SEQ ID NO: 7711 - DNA, 200 bp, Homo sapiens
  misc_feature 1..200: note = chr5:2752242-2752442
  misc_feature 1..200: note = hyper
  source 1..200: mol_type = genomic DNA
ggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcc

SEQ ID NO: 7712 - DNA, 294 bp, Homo sapiens
  misc_feature 1..294: note = chr5:2752898-2753192
  misc_feature 1..294: note = hyper
  source 1..294: mol_type = genomic DNA
ggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctgggg

SEQ ID NO: 7713 - DNA, 30 bp, Homo sapiens
  misc_feature 1..30: note = chr5:2754590-2754620
  misc_feature 1..30: note = hyper
  source 1..30: mol_type = genomic DNA
gaaatatataaactacgttttgctttaaag

SEQ ID NO: 7714 - DNA, 129 bp, Homo sapiens
  misc_feature 1..129: note = chr5:2755360-2755489
  misc_feature 1..129: note = hyper
  source 1..129: mol_type = genomic DNA
cgggcggcgagggggcgctgtggcccgtgtctgccggcccgagtcccggcaacggtgggcgcgacccacctcctcccccggcggcttaattcggggaagaagaaaaaacggcatcgaggcatttcaata

SEQ ID NO: 7715 - DNA, 326 bp, Homo sapiens; identical to SEQ ID NO: 2528
  misc_feature 1..326: note = chr5:2755916-2756242
  misc_feature 1..326: note = hyper
  source 1..326: mol_type = genomic DNA

SEQ ID NO: 7716 - DNA, 139 bp, Homo sapiens
  misc_feature 1..139: note = chr5:2756464-2756603
  misc_feature 1..139: note = hyper
  source 1..139: mol_type = genomic DNA
aattctccagcatctcgccgactccgtctctaccctcctctccttcctaatctcgcgctggcttcgcccttttctctctcctcctccttcctacgcgccccgccccctccccccaggtcgcacctctccccgcccgggt

SEQ ID NO: 7717 - DNA, 633 bp, Homo sapiens
  misc_feature 1..633: note = chr5:2756673-2757306
  misc_feature 1..633: note = hyper
  source 1..633: mol_type = genomic DNA
cggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagatagga

SEQ ID NO: 7718 - DNA, 30 bp, Homo sapiens
  misc_feature 1..30: note = chr5:3122164-3122194
  misc_feature 1..30: note = hyper
  source 1..30: mol_type = genomic DNA
cacacagtgccccagcgccaggcagcgggg

SEQ ID NO: 7719 - DNA, 41 bp, Homo sapiens
  misc_feature 1..41: note = chr5:3197756-3197797
  misc_feature 1..41: note = hyper
  source 1..41: mol_type = genomic DNA
aatctaaagaacccgcggtcctgtggcgtgatttcctggga

SEQ ID NO: 7720 - DNA, 253 bp, Homo sapiens; identical to SEQ ID NO: 426
  misc_feature 1..253: note = chr5:3590405-3590658
  misc_feature 1..253: note = hyper
  source 1..253: mol_type = genomic DNA

SEQ ID NO: 7721 - DNA, 123 bp, Homo sapiens
  misc_feature 1..123: note = chr5:3591143-3591266
  misc_feature 1..123: note = hyper
  source 1..123: mol_type = genomic DNA
gtaattcacttccttcgacactggggacggcgtcgtagcggcactccaggccaggccactgcggtccattcctctgccctgcgtttgtgggaaatacgggcccagtgccgcagctttagggcc

SEQ ID NO: 7722 - DNA, 99 bp, Homo sapiens
  misc_feature 1..99: note = chr5:3594407-3594506
  misc_feature 1..99: note = hyper
  source 1..99: mol_type = genomic DNA
gtctgtcctcaggcccggaaaaccggagcccctcctgatgctgctgaagtccctgggcctcgaggctccgtgaagagagggaagcgaggcagggggtga

SEQ ID NO: 7723 - DNA, 145 bp, Homo sapiens
  misc_feature 1..145: note = chr5:3596580-3596725
  misc_feature 1..145: note = hyper
  source 1..145: mol_type = genomic DNA
cgggtggacctggtccggaagaggaactagaaaggtccgggggcaggttcccggtggccgaggccgcggcccccggggacgcaagagggctgggaggccgggcgggtgacggctgggccatctcggcctgggaaagcggaaggcc

SEQ ID NO: 7724 - DNA, 50 bp, Homo sapiens
  misc_feature 1..50: note = chr5:3597411-3597461
  misc_feature 1..50: note = hyper
  source 1..50: mol_type = genomic DNA
tcggtgcttaaacttcggacggctggtgaattgtgcggcgggcgcggggc

SEQ ID NO: 7725 - DNA, 21 bp, Homo sapiens
  misc_feature 1..21: note = chr5:3600732-3600753
  misc_feature 1..21: note = hyper
  source 1..21: mol_type = genomic DNA
cgtccccaggccagattcgcc

SEQ ID NO: 7726 - DNA, 459 bp, Homo sapiens
  misc_feature 1..459: note = chr5:3602804-3603263
  misc_feature 1..459: note = hyper
  source 1..459: mol_type = genomic DNA
agcgagggggaaagtcggggcgctggtgtcttttcagaggttccaggaaagagggaggctcgcgttaggactaggaggtgccagtccacggctcctacccgctcccgacgcccgcatccttctacagccctccaccccgttcctggtccctgtagaggggaaggtcctctccctgccccgaggcgggaggaaaagcggcgaagaggaggctcgaagggcgccgcgtagggcaagtgggccgaggacaccgggggcgcgtcggggagcggggagtgggcggggtgggatgaggcagggaggagccgggccggagcggagtggagtggaccgcgggcggacggactcgggccgggccccggggagcagctccgcagtcggaatggacgtgctccaggcgccctctatggtccgaaagcggaatgcggccttgagcagcgcccatctcgctcctggggtgtg

SEQ ID NO: 7727 - DNA, 34 bp, Homo sapiens
  misc_feature 1..34: note = chr5:3606775-3606809
  misc_feature 1..34: note = hyper
  source 1..34: mol_type = genomic DNA
atttatccagagtcccgagcgcaatggctggtgc

SEQ ID NO: 7728 - DNA, 30 bp, Homo sapiens
  misc_feature 1..30: note = chr5:3607118-3607148
  misc_feature 1..30: note = hyper
  source 1..30: mol_type = genomic DNA
cggacgccctgatagcggggtgacagcctg

SEQ ID NO: 7729 - DNA, 247 bp, Homo sapiens
  misc_feature 1..247: note = chr5:5139753-5140000
  misc_feature 1..247: note = hyper
  source 1..247: mol_type = genomic DNA
cggggcaaatggcgcgggggaagagtttcctcctcagcctccccgtctccgatcgctccgcaaactccagagcgaggcacgcgcctttaaaggcaggtccgcggctctcccacgtcctggcgcccggttttccgcacccagtgtccccacagctgtgcccgggcacagaggcgcggccagaccgcactccgcgggctgcaggtgtcccggcctctggcggcgccggtgcggcccggaggtgggagcc

SEQ ID NO: 7730 - DNA, 137 bp, Homo sapiens
  misc_feature 1..137: note = chr5:5140031-5140168
  misc_feature 1..137: note = hyper
  source 1..137: mol_type = genomic DNA
cgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgt

SEQ ID NO: 7731 - DNA, 18 bp, Homo sapiens
  misc_feature 1..18: note = chr5:5140438-5140456
  misc_feature 1..18: note = hyper
  source 1..18: mol_type = genomic DNA
cttcagtaataaccccgg

SEQ ID NO: 7732 - DNA, 231 bp, Homo sapiens
  misc_feature 1..231: note = chr5:5140527-5140758
  misc_feature 1..231: note = hyper
  source 1..231: mol_type = genomic DNA
cgctgccggccggggaccctccggtggcccctagcccctcggagcgctcctggatgaagccccgcgcgcgcggatggcggggcttggcggcgctgtggatgctgttggcgcaggtggccgagcaggtgagtcccgggcgctcccaccagcgcggaaaccgcgggtccggacagctggaggcgagtcccccgcggctcctctcccgcggaccccgccgtctcaccgcgatgt

SEQ ID NO: 7733 - DNA, 24 bp, Homo sapiens
  misc_feature 1..24: note = chr5:5140849-5140873
  misc_feature 1..24: note = hyper
  source 1..24: mol_type = genomic DNA
cggagcggccgggctggatggaaa

SEQ ID NO: 7734 - DNA, 844 bp, Homo sapiens; identical to SEQ ID NO: 427
  misc_feature 1..844: note = chr5:6448738-6449582
  misc_feature 1..844: note = hyper
  source 1..844: mol_type = genomic DNA

SEQ ID NO: 7735 - DNA, 367 bp, Homo sapiens
  misc_feature 1..367: note = chr5:6583189-6583556
  misc_feature 1..367: note = hyper
  source 1..367: mol_type = genomic DNA
cccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggct

SEQ ID NO: 7736 - DNA, 30 bp, Homo sapiens
  misc_feature 1..30: note = chr5:6687127-6687157
  misc_feature 1..30: note = hyper
  source 1..30: mol_type = genomic DNA
cgcttcctaataaaacggcattccaggttc

SEQ ID NO: 7737 - DNA, 30 bp, Homo sapiens
  misc_feature 1..30: note = chr5:6687371-6687401
  misc_feature 1..30: note = hyper
  source 1..30: mol_type = genomic DNA
ggggcagagccagctcggagccagcgctgc

SEQ ID NO: 7738 - DNA, 101 bp, Homo sapiens; identical to SEQ ID NO: 2531
  misc_feature 1..101: note = chr5:7395293-7395394
  misc_feature 1..101: note = hyper
  source 1..101: mol_type = genomic DNA

SEQ ID NO: 7739 - DNA, 113 bp, Homo sapiens; identical to SEQ ID NO: 2532
  misc_feature 1..113: note = chr5:7395433-7395546
  misc_feature 1..113: note = hyper
  source 1..113: mol_type = genomic DNA

SEQ ID NO: 7740 - DNA, 49 bp, Homo sapiens
  misc_feature 1..49: note = chr5:7396986-7397035
  misc_feature 1..49: note = hyper
  source 1..49: mol_type = genomic DNA
cctgggcttcctgggcgagtcgctgtctcctgcccggttccactggcat

SEQ ID NO: 7741 - DNA, 177 bp, Homo sapiens
  misc_feature 1..177: note = chr5:7850962-7851139
  misc_feature 1..177: note = hyper
  source 1..177: mol_type = genomic DNA
tccgcgcccagtccgcggtcctcacccgcgccgggcggtagtagtagctgtgctctttggggtccaggcgccgcggcgggatgtagctgaaggcggactgcgccgagacgggcggcggcctgggcttgccccgcagcgtggacgcggtggtctcctcctcgtcgtcctccatgccgc

SEQ ID NO: 7742 - DNA, 36 bp, Homo sapiens
  misc_feature 1..36: note = chr5:9546612-9546648
  misc_feature 1..36: note = hyper
  source 1..36: mol_type = genomic DNA
gcgctccctctctgccggcctcggcttcaggtacgt

SEQ ID NO: 7743 - DNA, 496 bp, Homo sapiens; identical to SEQ ID NO: 2533
  misc_feature 1..496: note = chr5:10333618-10334114
  misc_feature 1..496: note = hyper
  source 1..496: mol_type = genomic DNA

SEQ ID NO: 7744 - DNA, 31 bp, Homo sapiens; identical to SEQ ID NO: 428
  misc_feature 1..31: note = chr5:10564628-10564659
  misc_feature 1..31: note = hyper
  source 1..31: mol_type = genomic DNA

SEQ ID NO: 7745 - DNA, 428 bp, Homo sapiens; identical to SEQ ID NO: 429
  misc_feature 1..428: note = chr5:10564800-10565228
  misc_feature 1..428: note = hyper
  source 1..428: mol_type = genomic DNA

SEQ ID NO: 7746 - skipped

SEQ ID NO: 7747 - DNA, 358 bp, Homo sapiens; identical to SEQ ID NO: 431
  misc_feature 1..358: note = chr5:10565264-10565622
  misc_feature 1..358: note = hyper
  source 1..358: mol_type = genomic DNA

SEQ ID NO: 7748 - DNA, 321 bp, Homo sapiens
  misc_feature 1..321: note = chr5:11385070-11385391
  misc_feature 1..321: note = hyper
  source 1..321: mol_type = genomic DNA
gcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcaca

SEQ ID NO: 7749 - DNA, 180 bp, Homo sapiens
  misc_feature 1..180: note = chr5:11903545-11903725
  misc_feature 1..180: note = hyper
  source 1..180: mol_type = genomic DNA
caccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccc

SEQ ID NO: 7750 - DNA, 293 bp, Homo sapiens
  misc_feature 1..293: note = chr5:11903821-11904114
  misc_feature 1..293: note = hyper
  source 1..293: mol_type = genomic DNA
cgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggc

SEQ ID NO: 7751 - DNA, 59 bp, Homo sapiens
  misc_feature 1..59: note = chr5:11904115-11904174
  misc_feature 1..59: note = hyper
  source 1..59: mol_type = genomic DNA
gcaggggcgagcgccgcgggcgagaggcggctcccgacgcgagtgcgcagcgcccggcc

SEQ ID NO: 7752 - skipped

SEQ ID NO: 7753 - DNA, 88 bp, Homo sapiens; identical to SEQ ID NO: 2538
  misc_feature 1..88: note = chr5:11904455-11904543
  misc_feature 1..88: note = hyper
  source 1..88: mol_type = genomic DNA

SEQ ID NO: 7754 - DNA, 30 bp, Homo sapiens
  misc_feature 1..30: note = chr5:11904962-11904992
  misc_feature 1..30: note = hyper
  source 1..30: mol_type = genomic DNA
agagctaaggaggcacgaagtccagcagag

SEQ ID NO: 7755 - DNA, 30 bp, Homo sapiens
  misc_feature 1..30: note = chr5:15500979-15501009
  misc_feature 1..30: note = hyper
  source 1..30: mol_type = genomic DNA
agtgagtaggtcaggcgccccgaggatgct

SEQ ID NO: 7756 - DNA, 30 bp, Homo sapiens
  misc_feature 1..30: note = chr5:15501264-15501294
  misc_feature 1..30: note = hyper
  source 1..30: mol_type = genomic DNA
tttccattctttgctcgctgctcctgctct

SEQ ID NO: 7757 - DNA, 30 bp, Homo sapiens
  misc_feature 1..30: note = chr5:16179111-16179141
  misc_feature 1..30: note = hyper
  source 1..30: mol_type = genomic DNA
cgccaccggctgcctcggggtctcgccggg

SEQ ID NO: 7758 - DNA, 28 bp, Homo sapiens
  misc_feature 1..28: note = chr5:16179554-16179582
  misc_feature 1..28: note = hyper
  source 1..28: mol_type = genomic DNA
cggggaccggggccggctctcccggcgg

SEQ ID NO: 7759 - DNA, 139 bp, Homo sapiens; identical to SEQ ID NO: 2540
  misc_feature 1..139: note = chr5:16180182-16180321
  misc_feature 1..139: note = hyper
  source 1..139: mol_type = genomic DNA

SEQ ID NO: 7760 - DNA, 53 bp, Homo sapiens; identical to SEQ ID NO: 2541
  misc_feature 1..53: note = chr5:16180371-16180424
  misc_feature 1..53: note = hyper
  source 1..53: mol_type = genomic DNA

SEQ ID NO: 7761 - DNA, 43 bp, Homo sapiens
  misc_feature 1..43: note = chr5:17216867-17216910
  misc_feature 1..43: note = hyper
  source 1..43: mol_type = genomic DNA
cgaagctgcagccttcggggctgagccccgcgggtgcgggtgc

SEQ ID NO: 7762 - DNA, 16 bp, Homo sapiens
  misc_feature 1..16: note = chr5:17217708-17217724
  misc_feature 1..16: note = hyper
  source 1..16: mol_type = genomic DNA
atgcagaggctgcagc

SEQ ID NO: 7763 - DNA, 81 bp, Homo sapiens
  misc_feature 1..81: note = chr5:17217784-17217865
  misc_feature 1..81: note = hyper
  source 1..81: mol_type = genomic DNA
tcctcgctccgggctccgccgtcgagccgggagagagcctccgccagcggccaggcaccagccagacgacgccagcgaccc

SEQ ID NO: 7764 - DNA, 49 bp, Homo sapiens
  misc_feature 1..49: note = chr5:17217991-17218040
  misc_feature 1..49: note = hyper
  source 1..49: mol_type = genomic DNA
cgccccgcagcccccgggctctcccttcatgcagcgggcagcagggatg

SEQ ID NO: 7765 - DNA, 276 bp, Homo sapiens
  misc_feature 1..276: note = chr5:17218658-17218934
  misc_feature 1..276: note = hyper
  source 1..276: mol_type = genomic DNA
ttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaac

SEQ ID NO: 7766 - DNA, 49 bp, Homo sapiens
  misc_feature 1..49: note = chr5:17218985-17219034
  misc_feature 1..49: note = hyper
  source 1..49: mol_type = genomic DNA
cgtccccagagacatttccgccttgaaacgaactcggtggacagccctt

SEQ ID NO: 7767 - DNA, 121 bp, Homo sapiens; identical to SEQ ID NO: 2542
  misc_feature 1..121: note = chr5:22853104-22853225
  misc_feature 1..121: note = hyper
  source 1..121: mol_type = genomic DNA

SEQ ID NO: 7768 - DNA, 159 bp, Homo sapiens; identical to SEQ ID NO: 2543
  misc_feature 1..159: note = chr5:31639686-31639845
  misc_feature 1..159: note = hyper
  source 1..159: mol_type = genomic DNA

SEQ ID NO: 7769 - DNA, 270 bp, Homo sapiens
  misc_feature 1..270: note = chr5:31855221-31855491
  misc_feature 1..270: note = hyper
  source 1..270: mol_type = genomic DNA
gactcccaggagctccggagaggaaccctccgaaggtgacttcagaactggaggtaggaaatcggcttctcaggcgaaagcctcaggttttctgatctgatccaggtcgggtgcagactggggctgaatccacaaatgtggagatttagccacagcctcggaggcgcggagcggccacctaagcgtctgcccttctcgtctcccggatcactggggtgtgttgtttttaaagtgggggatttgcgtgttgagagacggtttgtgttcctc

SEQ ID NO: 7770 - DNA, 66 bp, Homo sapiens
  misc_feature 1..66: note = chr5:32710234-32710300
  misc_feature 1..66: note = hyper
  source 1..66: mol_type = genomic DNA
atgctcctctggtcacggacttctccagagccgcttccctccggtctccaccgctgctgtggctat

SEQ ID NO: 7771 - DNA, 183 bp, Homo sapiens
  misc_feature 1..183: note = chr5:32710598-32710781
  misc_feature 1..183: note = hyper
  source 1..183: mol_type = genomic DNA
ttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctg

SEQ ID NO: 7772 - DNA, 52 bp, Homo sapiens
  misc_feature 1..52: note = chr5:32711377-32711429
  misc_feature 1..52: note = hyper
  source 1..52: mol_type = genomic DNA
gctcagccgctgccacgctatttaaacgcgggctatggatccaggaaccggc

SEQ ID NO: 7773 - DNA, 49 bp, Homo sapiens
  misc_feature 1..49: note = chr5:32711430-32711479
  misc_feature 1..49: note = hyper
  source 1..49: mol_type = genomic DNA
cgaatcaatgagatcaaatgcgagggagatgcaccgtcaattacaaaca

SEQ ID NO: 7774 - DNA, 99 bp, Homo sapiens; identical to SEQ ID NO: 2544
  misc_feature 1..99: note = chr5:32711765-32711864
  misc_feature 1..99: note = hyper
  source 1..99: mol_type = genomic DNA

SEQ ID NO: 7775 - DNA, 25 bp, Homo sapiens
  misc_feature 1..25: note = chr5:32712077-32712102
  misc_feature 1..25: note = hyper
  source 1..25: mol_type = genomic DNA
ttgttttcactcacccgggtgcggc

SEQ ID NO: 7776 - DNA, 563 bp, Homo sapiens; identical to SEQ ID NO: 2546
  misc_feature 1..563: note = chr5:32712289-32712852
  misc_feature 1..563: note = hyper
  source 1..563: mol_type = genomic DNA

SEQ ID NO: 7777 - DNA, 495 bp, Homo sapiens
  misc_feature 1..495: note = chr5:33892054-33892549
  misc_feature 1..495: note = hyper
  source 1..495: mol_type = genomic DNA
gggtgcatggtcaggcgcgagaaggcagcgactgcaaagctgcccgcgatctccctgtgcttttttaagcagaaaggagctagacacctttttcccctccctcctcctaaaaggggagtgattcagctgacagtgtccgctttcggcggggtgtggaatgggccagagcgggagggcgcagcccaccccggtccccacccctccgcctcccgcatgccccgcggcctcgcagcccgcccgctcggtgcatcttcctcccggactcccacccccgcgctcctccggccccgccccgaacgccaggcccagctggccgagccggccaaataggggagacccgggagagccgccctgggaggcactggaggaagctgcgagtgagaggcccccaggccagccccccggcgtgcttaaatacaagctcaaaatgaggagaacagagttgaggcagaggggggccccactccctccatccttccgcgctcagcgctgccc

SEQ ID NO: 7778 - DNA, 116 bp, Homo sapiens
  misc_feature 1..116: note = chr5:33936246-33936362
  misc_feature 1..116: note = hyper
  source 1..116: mol_type = genomic DNA
gcccgccgccttggccgtgcaagtgccaccgtaactggtgagagccgctggcaacccacccggagttgacaaccgcggagagacgcagacacccactgacctccaggaagctgagc

SEQ ID NO: 7779 - DNA, 136 bp, Homo sapiens
  misc_feature 1..136: note = chr5:33936363-33936499
  misc_feature 1..136: note = hyper
  source 1..136: mol_type = genomic DNA
tggtggatggaactctacgatctctttctctccaaggacggaaacctcatccaagcagtcccagaggaaacggataaaggtatttgaaagggagcgagcggccccaaatcgcacaattgagcggctgggggagtta

SEQ ID NO: 7780 - DNA, 133 bp, Homo sapiens
  misc_feature 1..133: note = chr5:36690192-36690325
  misc_feature 1..133: note = hyper
  source 1..133: mol_type = genomic DNA
gttctgttagctgaacgggcctggaggaagcgtggcgggaaggctggatccccgccgcaggggctgcggggctgtggctgcctgcgggctgggcagggccgggcgcacgccctccttccgggtggccgcgggc

SEQ ID NO: 7781 - DNA, 65 bp, Homo sapiens
  misc_feature 1..65: note = chr5:37834672-37834737
  misc_feature 1..65: note = hyper
  source 1..65: mol_type = genomic DNA
gtgcggggctggctgcgggtgggggtgcgagggggtccgccggcggcccccccgcggggagggaa

SEQ ID NO: 7782 - DNA, 1728 bp, Homo sapiens; identical to SEQ ID NO: 2547
  misc_feature 1..1728: note = chr5:37836649-37838377
  misc_feature 1..1728: note = hyper
  source 1..1728: mol_type = genomic DNA

SEQ ID NO: 7783 - DNA, 285 bp, Homo sapiens; identical to SEQ ID NO: 2548
  misc_feature 1..285: note = chr5:37838600-37838885
  misc_feature 1..285: note = hyper
  source 1..285: mol_type = genomic DNA

SEQ ID NO: 7784 - DNA, 30 bp, Homo sapiens
  misc_feature 1..30: note = chr5:37839237-37839267
  misc_feature 1..30: note = hyper
  source 1..30: mol_type = genomic DNA
cgacggcggtgggttcgaagatgacccaag

SEQ ID NO: 7785 - DNA, 268 bp, Homo sapiens; identical to SEQ ID NO: 2549
  misc_feature 1..268: note = chr5:37839807-37840075
  misc_feature 1..268: note = hyper
  source 1..268: mol_type = genomic DNA

SEQ ID NO: 7786 - DNA, 144 bp, Homo sapiens; identical to SEQ ID NO: 2550
  misc_feature 1..144: note = chr5:37840076-37840220
  misc_feature 1..144: note = hyper
  source 1..144: mol_type = genomic DNA

SEQ ID NO: 7787 - DNA, 96 bp, Homo sapiens; identical to SEQ ID NO: 2551
  misc_feature 1..96: note = chr5:37840267-37840363
  misc_feature 1..96: note = hyper
  source 1..96: mol_type = genomic DNA

SEQ ID NO: 7788 - DNA, 187 bp, Homo sapiens; identical to SEQ ID NO: 2552
  misc_feature 1..187: note = chr5:37840529-37840716
  misc_feature 1..187: note = hyper
  source 1..187: mol_type = genomic DNA

SEQ ID NO: 7789 - DNA, 90 bp, Homo sapiens
  misc_feature 1..90: note = chr5:38257451-38257541
  misc_feature 1..90: note = hyper
  source 1..90: mol_type = genomic DNA
agccaggacgcccaccgagtcctggcagcgttgcaaggtggggagggggcgggcgcggtcctgtcgctagtgactgcagatttcctctgc

SEQ ID NO: 7790 - DNA, 64 bp, Homo sapiens
  misc_feature 1..64: note = chr5:38257542-38257606
  misc_feature 1..64: note = hyper
  source 1..64: mol_type = genomic DNA
gggcacttcctacggcctttgatctttccccaggaactgccgagggccgcgtttgcctctaagt

SEQ ID NO: 7791 - DNA, 67 bp, Homo sapiens; identical to SEQ ID NO: 2553
  misc_feature 1..67: note = chr5:38257842-38257909
  misc_feature 1..67: note = hyper
  source 1..67: mol_type = genomic DNA

SEQ ID NO: 7792 - DNA, 15 bp, Homo sapiens
  misc_feature 1..15: note = chr5:38257944-38257959
  misc_feature 1..15: note = hyper
  source 1..15: mol_type = genomic DNA
cgccaggcttaactt

SEQ ID NO: 7793 - DNA, 496 bp, Homo sapiens
  misc_feature 1..496: note = chr5:38258174-38258670
  misc_feature 1..496: note = hyper
  source 1..496: mol_type = genomic DNA
caaatcacagacccccgtctacccctcgcatcccccaagtgcgctggaccaactacagcaacctttgaggtgttagaaaaagtcgcctagaggggcgcggcaggaggagggcccaggtggggtggagggggggcgccccaagatttcagggtgaggaccgcggagggtcctggacccgcagtcgcctaactcctgccctgcgtctccagtgcttgaagtcggtccctcccaggtccccaatctaggtcaccagcggggaagggctgcgctgggggtcgctagagagggtgaggggcgggctgtctgcttccgaggtgggcgaggagtgaaggtttcagggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcac

SEQ ID NO: 7794 - DNA, 144 bp, Homo sapiens
  misc_feature 1..144: note = chr5:38258671-38258815
  misc_feature 1..144: note = hyper
  source 1..144: mol_type = genomic DNA
ccgacctcccggctgcagtcctacctcttggaactacccgtgtttccgggcccagccctcgcagccccccacctcctcgccccggcccggggatccgttggggccgcgtcccccacgcgcccccggagacgccctttccgtgtg

SEQ ID NO: 7795 - DNA, 123 bp, Homo sapiens
  misc_feature 1..123: note = chr5:38556551-38556674
  misc_feature 1..123: note = hyper
  source 1..123: mol_type = genomic DNA
gggccgggcacaatgcgccgccgcctccgcagccgccgtctcgcctcccctgtgtcggcgcgaggctgcttgaggcggccacgggcgaagggcggcccgctgcgctccgcgaaccccgcgggc

SEQ ID NO: 7796 - DNA, 30 bp, Homo sapiens
  misc_feature 1..30: note = chr5:39425493-39425523
  misc_feature 1..30: note = hyper
  source 1..30: mol_type = genomic DNA
tctgacaagggacaacggttcctgcgcaga

SEQ ID NO: 7797 - DNA, 15 bp, Homo sapiens
  misc_feature 1..15: note = chr5:40681213-40681228
  misc_feature 1..15: note = hyper
  source 1..15: mol_type = genomic DNA
tggtgctgtgcaagt

SEQ ID NO: 7798 - DNA, 106 bp, Homo sapiens
  misc_feature 1..106: note = chr5:40681261-40681367
  misc_feature 1..106: note = hyper
  source 1..106: mol_type = genomic DNA
cgctggtatgtgggctggctgtcaccgacctgttgggcactttgttggtgagcccggtgaccatcgccacgtacatgaagggccaatggcccgggggccagccgct

SEQ ID NO: 7799 - DNA, 164 bp, Homo sapiens
  misc_feature 1..164: note = chr5:40681676-40681840
  misc_feature 1..164: note = hyper
  source 1..164: mol_type = genomic DNA
cctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgc

SEQ ID NO: 7800 - DNA, 487 bp, Homo sapiens
  misc_feature 1..487: note = chr5:42424672-42425159
  misc_feature 1..487: note = hyper
  source 1..487: mol_type = genomic DNA
tgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcgtgtctagggagagggcgctggcggcgcagagggtgcggggcagggcacttgcgagtgcgtggggaagtctatttggggcgagtgctttatatatagcccgaggggatgcctgctgagaccgagctgcgggggctctcggtctggcgcggactgtgtgtcctgaatgagtgtacgtgtgcgctgtgtgtgcgcgcgcgagtgtgcgcctggggaggcgtgtcggcgcctgagccagtagggtgtgcagggtggaagaggccacagaggtgccgcctgtctgtttgtgccgccaggagaccttggaagggacagagaaaggtaacggaaggccaaagtg

SEQ ID NO: 7801 - DNA, 207 bp, Homo sapiens; identical to SEQ ID NO: 432
  misc_feature 1..207: note = chr5:42951105-42951312
  misc_feature 1..207: note = hyper
  source 1..207: mol_type = genomic DNA

SEQ ID NO: 7802 - DNA, 693 bp, Homo sapiens; identical to SEQ ID NO: 433
  misc_feature 1..693: note = chr5:42951419-42952112
  misc_feature 1..693: note = hyper
  source 1..693: mol_type = genomic DNA

SEQ ID NO: 7803 - DNA, 457 bp, Homo sapiens; identical to SEQ ID NO: 434
  misc_feature 1..457: note = chr5:42991785-42992242
  misc_feature 1..457: note = hyper
  source 1..457: mol_type = genomic DNA

SEQ ID NO: 7804 - DNA, 180 bp, Homo sapiens; identical to SEQ ID NO: 435
  misc_feature 1..180: note = chr5:42992375-42992555
  misc_feature 1..180: note = hyper
  source 1..180: mol_type = genomic DNA

SEQ ID NO: 7805 - DNA, 42 bp, Homo sapiens; identical to SEQ ID NO: 436
  misc_feature 1..42: note = chr5:42992556-42992598
  misc_feature 1..42: note = hyper
  source 1..42: mol_type = genomic DNA

SEQ ID NO: 7806 - DNA, 239 bp, Homo sapiens; identical to SEQ ID NO: 437
  misc_feature 1..239: note = chr5:42992782-42993021
  misc_feature 1..239: note = hyper
  source 1..239: mol_type = genomic DNA

SEQ ID NO: 7807 - DNA, 240 bp, Homo sapiens; identical to SEQ ID NO: 438
  misc_feature 1..240: note = chr5:42993321-42993561
  misc_feature 1..240: note = hyper
  source 1..240: mol_type = genomic DNA

SEQ ID NO: 7808 - DNA, 276 bp, Homo sapiens; identical to SEQ ID NO: 439
  misc_feature 1..276: note = chr5:42993861-42994137
  misc_feature 1..276: note = hyper
  source 1..276: mol_type = genomic DNA

SEQ ID NO: 7809 - DNA, 679 bp, Homo sapiens
  misc_feature 1..679: note = chr5:43007818-43008497
  misc_feature 1..679: note = hyper
  source 1..679: mol_type = genomic DNA
taagcatgcctgctgcggattaagagcgcgcatgcgcactgggggaatgggatggagccacccgggattctcgccttatacaaacagggaacccagcctccttagctttcatataaaagcctttgtattcagccgttaaggagcaaccggcaacctgctttcaggacccttgttttttatgagagctttcgtttacgcttaataaattctactccactcactcttcgatatccgcgtgcccacttcctcctgatcgtgagacaaggacccggatatagctgagcttagaagcaaaaatcctgcatcaatagcaaatgcggacactgaacgactagcggagtacccagcggcaaactttagtttttggtgcagttaaggtattgccactaagaaatcgtcgtctctgagaaatatcgaggcttggaaggttgtacagtgcttccaccgagaaagcacctacccaatgaaacgcctgtggcagaaaaaccgagcccaagcccttccagcgaaagtgctgaaagagcgcctcctcggccaatcactgggctgagaccgtgagacagccagcccggggaaagtggcggcgctaggagaggggaagcgttaccacaaagcacttctgagtcttgtgaacaagaaacgttctgggttgttttgtttttgagaaggagcctcgctc

SEQ ID NO: 7810 - DNA, 199 bp, Homo sapiens
  misc_feature 1..199: note = chr5:43008737-43008936
  misc_feature 1..199: note = hyper
  source 1..199: mol_type = genomic DNA
gtgagccacagcgccccgccgaaacgttctgttgtgttcagcgcttccagcggtgcagcagccgagaaaacactgagtctccgctattggcgaaagtgctgatgcgaaactgctggctcgacataggcacagagccgcggaagagaaccctagagaccaggcaccagctctgctccccgactcacgggagaaagctagt

SEQ ID NO: 7811 - DNA, 224 bp, Homo sapiens; identical to SEQ ID NO: 2563
  misc_feature 1..224: note = chr5:43017953-43018177
  misc_feature 1..224: note = hyper
  source 1..224: mol_type = genomic DNA

SEQ ID NO: 7812 - DNA, 325 bp, Homo sapiens; identical to SEQ ID NO: 2564
  misc_feature 1..325: note = chr5:43018326-43018651
  misc_feature 1..325: note = hyper
  source 1..325: mol_type = genomic DNA

SEQ ID NO: 7813 - DNA, 156 bp, Homo sapiens; identical to SEQ ID NO: 2565
  misc_feature 1..156: note = chr5:43019191-43019347
  misc_feature 1..156: note = hyper
  source 1..156: mol_type = genomic DNA

SEQ ID NO: 7814 - DNA, 78 bp, Homo sapiens
  misc_feature 1..78: note = chr5:43019809-43019887
  misc_feature 1..78: note = hyper
  source 1..78: mol_type = genomic DNA
gtgacgtttcccattcgccaggtccttatgttctctgtgctgtcactttcttggttctcgcaccgctagtatctgcta

SEQ ID NO: 7815 - DNA, 147 bp, Homo sapiens
  misc_feature 1..147: note = chr5:43040869-43041016
  misc_feature 1..147: note = hyper
  source 1..147: mol_type = genomic DNA
tactagtgcgaacagcggctcggtgcaatcaccgttctgcacggcaaaacggggttcaggaagttcctaggagatactagcggttgtaggagcgaaaaagtgacagcactgagaacctaaggaccccgcgaacgggaaatgtcacgt

SEQ ID NO: 7816 - DNA, 238 bp, Homo sapiens
  misc_feature 1..238: note = chr5:43191854-43192092
  misc_feature 1..238: note = hyper
  source 1..238: mol_type = genomic DNA
aacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatca

SEQ ID NO: 7817 - DNA, 470 bp, Homo sapiens
  misc_feature 1..470: note = chr5:43192670-43193140
  misc_feature 1..470: note = hyper
  source 1..470: mol_type = genomic DNA
cagaagaaggttaggcgctttctggggcgtacccccacacctgcccaggccgatccgcaagcgagaggagggggcattagagccagggcgagagcgtgctcgcgcgtgtgtgcccgtgtcatgtgtggtgcccgtgtcatgtgcggcgcccatgtctatgtgcgcgcgtgtgtgcacccatgtctctgtatggtgtggacactcgtgtctgcgtgcgcgtccacacgtgagccgaggagcgcagcttagcgcctagcgttgcgcacagcgggtgcgctggaccagagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttctt

SEQ ID NO: 7818 - DNA, 261 bp, Homo sapiens
  misc_feature 1..261: note = chr5:43396969-43397230
  misc_feature 1..261: note = hyper
  source 1..261: mol_type = genomic DNA
tgaagtggaaaacagcgggcggtagccgaagcagagagcaaggaagagcgcgggaagtgcagagcgacagcaacaagaaaggggtggcgcgggacgtcgtttacctgggcgacgtccagccgcccttcccgcctctgcgcgtacgcaacctgcttggcgccactgacctggtgaggaggcttctttaaggccgtggacggttcctacccgcgcgcggagaggaccgacgtgaagaagctgccaaagtataacaagtactac

SEQ ID NO: 7819 - DNA, 72 bp, Homo sapiens
  misc_feature 1..72: note = chr5:43397305-43397377
  misc_feature 1..72: note = hyper
  source 1..72: mol_type = genomic DNA
gcacgcctggacccgggggagccggctggggcgcccaggaccaggcctagcctaccgcgggctgcccttcac

SEQ ID NO: 7820 - DNA, 367 bp, Homo sapiens
  misc_feature 1..367: note = chr5:44388245-44388612
  misc_feature 1..367: note = hyper
  source 1..367: mol_type = genomic DNA
gatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagagg

SEQ ID NO: 7821 - DNA, 30 bp, Homo sapiens
  misc_feature 1..30: note = chr5:44388856-44388886
  misc_feature 1..30: note = hyper
  source 1..30: mol_type = genomic DNA
ggcaaggagagagctcgaggtggtggctgc

SEQ ID NO: 7822 - DNA, 311 bp, Homo sapiens
  misc_feature 1..311: note = chr5:44389793-44390104
  misc_feature 1..311: note = hyper
  source 1..311: mol_type = genomic DNA
tagctctgtctaattcgctgctaaagcgtcctatgcttgcagcgcgggccacggcgctgacggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcag

SEQ ID NO: 7823 - DNA, 15 bp, Homo sapiens
  misc_feature 1..15: note = chr5:45695225-45695240
  misc_feature 1..15: note = hyper
  source 1..15: mol_type = genomic DNA
agcgaggataaccag

SEQ ID NO: 7824 - DNA, 295 bp, Homo sapiens
  misc_feature 1..295: note = chr5:45695313-45695608
  misc_feature 1..295: note = hyper
  source 1..295: mol_type = genomic DNA
cgctgtctccggttacccagtcttcttctgagccccagaagcctccttttccctcctggttgagaccacacttgagggagccgcgcgaggaagggtggcttcccgcttcctcacgctctcgtctctgaagtaaaagtttcccttgtacaacttcgcctcctcccaggagggtgaccgtggcctccatccttccctgatctgtccccgaagttcaggaggccaaggaggagagcccgtccgggattcccgggcaacaggagcacatcctccgagcccctcctgggtggaaactacc

SEQ ID NO: 7825 - DNA, 28 bp, Homo sapiens
  misc_feature 1..28: note = chr5:45695936-45695964
  misc_feature 1..28: note = hyper
  source 1..28: mol_type = genomic DNA
gcccctcggcgtcttcgaagccccccgc

SEQ ID NO: 7826 - DNA, 386 bp, Homo sapiens
  misc_feature 1..386: note = chr5:49736592-49736978
  misc_feature 1..386: note = hyper
  source 1..386: mol_type = genomic DNA
ctgccctgttacctacgcgcccgactcgcggggcgctgttcgttcaagactcgccccaaagagcgcaggaacgcgagccgcagcagtttcagggttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggaggg

SEQ ID NO: 7827 - DNA, 158 bp, Homo sapiens
  misc_feature 1..158: note = chr5:49737098-49737256
  misc_feature 1..158: note = hyper
  source 1..158: mol_type = genomic DNA
cgcgggtaggacgctgaagaaaaggcggaatgggaggggcccggccgccttgccccactcccccgagacgctcttaccgcgcccggccctccatcagttatgcagccctcagccggctgctggcgttcccggatgtgcggtggcggtgctacttcccg

SEQ ID NO: 7828 - DNA, 157 bp, Homo sapiens; identical to SEQ ID NO: 440
  misc_feature 1..157: note = chr5:50263484-50263641
  misc_feature 1..157: note = hyper
  source 1..157: mol_type = genomic DNA

SEQ ID NO: 7829 - DNA, 142 bp, Homo sapiens; identical to SEQ ID NO: 2567
  misc_feature 1..142: note = chr5:50264500-50264642
  misc_feature 1..142: note = hyper
  source 1..142: mol_type = genomic DNA

SEQ ID NO: 7830 - DNA, 347 bp, Homo sapiens
  misc_feature 1..347: note = chr5:50265325-50265672
  misc_feature 1..347: note = hyper
  source 1..347: mol_type = genomic DNA
ctgcagcactgaccacgttgccctggtttctccatttctccttcccaagtctctgcctctgtttccccatgacccggaggacgcgcctacggaagagacgtctggtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccacca

SEQ ID NO: 7831 - DNA, 160 bp, Homo sapiens
  misc_feature 1..160: note = chr5:50265720-50265880
  misc_feature 1..160: note = hyper
  source 1..160: mol_type = genomic DNA
cggacttggcggggccggtccccacctgaagctcacctcaggcagtcgctagaagttccaatccaatcgtgagctttcctctgggagggacaggatccccttcaactcctgaggctgctcctctgggcgaatcccacagtaattgcgcatttctctccct

SEQ ID NO: 7832 - DNA, 40 bp, Homo sapiens
  misc_feature 1..40: note = chr5:50683270-50683310
  misc_feature 1..40: note = hyper
  source 1..40: mol_type = genomic DNA
ctgtacttctctccccgctctgggccgcctccgctccccc

SEQ ID NO: 7833 - DNA, 229 bp, Homo sapiens
  misc_feature 1..229: note = chr5:50685846-50686075
  misc_feature 1..229: note = hyper
  source 1..229: mol_type = genomic DNA
cgcacggttttcaatcctgctcctgggcaggagtttggccggggctgcccctcatccttacccccctacccatgccccgggggacaggctacccggcgccggccgccagctgagggcggggaagctgggaggctccgtgcgccgggggagcagcatccaggtcccaacctcgtgggtgggctcatgcccttccacctcgcctgtacctgtgaaccggagaaacgccgtc

SEQ ID NO: 7834 - skipped

SEQ ID NO: 7835 - DNA, 15 bp, Homo sapiens
  misc_feature 1..15: note = chr5:50695350-50695365
  misc_feature 1..15: note = hyper
  source 1..15: mol_type = genomic DNA
cgccctcaggcccct

SEQ ID NO: 7836 - DNA, 347 bp, Homo sapiens; identical to SEQ ID NO: 441
  misc_feature 1..347: note = chr5:54516334-54516681
  misc_feature 1..347: note = hyper
  source 1..347: mol_type = genomic DNA

SEQ ID NO: 7837 - DNA, 96 bp, Homo sapiens; identical to SEQ ID NO: 442
  misc_feature 1..96: note = chr5:54516831-54516927
  misc_feature 1..96: note = hyper
  source 1..96: mol_type = genomic DNA

SEQ ID NO: 7838 - DNA, 156 bp, Homo sapiens; identical to SEQ ID NO: 443
  misc_feature 1..156: note = chr5:54519133-54519289
  misc_feature 1..156: note = hyper
  source 1..156: mol_type = genomic DNA

SEQ ID NO: 7839 - DNA, 314 bp, Homo sapiens
  misc_feature 1..314: note = chr5:54527322-54527636
  misc_feature 1..314: note = hyper
  source 1..314: mol_type = genomic DNA
cgcctccgggtggtctcccagtcgcaagtccacgggccgcgagacccgcagcatgcggtccgccagcgccaggcagcagatcgccaggagggaaggggagtagctggtgaaggcatagtcggccagactcagctctgccaccccccgcgccagggcttgcgcttccagagcttcggaggcctcagcctgccccgcctccacgcgagcgtgcgtgaaatgctccaggaagaagctaatggtgggcgcacccagggtgaagtgcagcttgtgcagcacgatgcactcgaggttgcagagctgctgccgggagaagg

SEQ ID NO: 7840 - DNA, 449 bp, Homo sapiens
  misc_feature 1..449: note = chr5:57878091-57878540
  misc_feature 1..449: note = hyper
  source 1..449: mol_type = genomic DNA
tttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtgcttagccagaaatctcgctttcacgcacttcggtgtgcgggttgtgtgtgtgactatgtacgcgcgcgcgacttctcagtgcaattatgcggataaaccactttccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaa

SEQ ID NO: 7841 - DNA, 35 bp, Homo sapiens
  misc_feature 1..35: note = chr5:57879028-57879063
  misc_feature 1..35: note = hyper
  source 1..35: mol_type = genomic DNA
gccaacaatgagacacgaagcgcccatgcaggtgg

SEQ ID NO: 7842 - DNA, 149 bp, Homo sapiens
  misc_feature 1..149: note = chr5:58335677-58335826
  misc_feature 1..149: note = hyper
  source 1..149: mol_type = genomic DNA
gagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctc

SEQ ID NO: 7843 - DNA, 62 bp, Homo sapiens
  misc_feature 1..62: note = chr5:59188996-59189058
  misc_feature 1..62: note = hyper
  source 1..62: mol_type = genomic DNA
cctgagtccctggaacgaggagggccaggacatcctggatttcttcaggccgggccggtggc

SEQ ID NO: 7844 - DNA, 310 bp, Homo sapiens
  misc_feature 1..310: note = chr5:59189188-59189498
  misc_feature 1..310: note = hyper
  source 1..310: mol_type = genomic DNA
cggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgct

SEQ ID NO: 7845 - DNA, 166 bp, Homo sapiens; identical to SEQ ID NO: 2571
  misc_feature 1..166: note = chr5:59189863-59190029
  misc_feature 1..166: note = hyper
  source 1..166: mol_type = genomic DNA

SEQ ID NO: 7846 - DNA, 80 bp, Homo sapiens; identical to SEQ ID NO: 444
  misc_feature 1..80: note = chr5:63255163-63255243
  misc_feature 1..80: note = hyper
  source 1..80: mol_type = genomic DNA

SEQ ID NO: 7847 - DNA, 395 bp, Homo sapiens; identical to SEQ ID NO: 2573
  misc_feature 1..395: note = chr5:63801877-63802272
  misc_feature 1..395: note = hyper
  source 1..395: mol_type = genomic DNA

SEQ ID NO: 7848 - DNA, 32 bp, Homo sapiens; identical to SEQ ID NO: 2574
  misc_feature 1..32: note = chr5:63802273-63802305
  misc_feature 1..32: note = hyper
  source 1..32: mol_type = genomic DNA

SEQ ID NO: 7849 - DNA, 166 bp, Homo sapiens; identical to SEQ ID NO: 2575
  misc_feature 1..166: note = chr5:63802339-63802505
  misc_feature 1..166: note = hyper
  source 1..166: mol_type = genomic DNA

SEQ ID NO: 7850 - DNA, 78 bp, Homo sapiens
  misc_feature 1..78: note = chr5:63986450-63986528
  misc_feature 1..78: note = hyper
  source 1..78: mol_type = genomic DNA
atgagcgaggccagccgactgtgctccggctactacagcctcaaccagagcttcgtggagcccttccagtgcccccgg

SEQ ID NO: 7851 - DNA, 112 bp, Homo sapiens
  misc_feature 1..112: note = chr5:63986569-63986681
  misc_feature 1..112: note = hyper
  source 1..112: mol_type = genomic DNA
cgacctcaagtactgctgcagcgagccgggcagctacttcccctacaagcacagctacatgtggagcctcaggtgggctgagagcccgcgcgtgcggcggctggccgagccc

SEQ ID NO: 7852 - DNA, 53 bp, Homo sapiens
  misc_feature 1..53: note = chr5:63986909-63986962
  misc_feature 1..53: note = hyper
  source 1..53: mol_type = genomic DNA
ccgcctggctggccccgctgagttccccgcccgcctcccgggagccgactgct

SEQ ID NO: 7853 - DNA, 132 bp, Homo sapiens
  misc_feature 1..132: note = chr5:67583945-67584077
  misc_feature 1..132: note = hyper
  source 1..132: mol_type = genomic DNA
ctgtgcatagtgcctcgcttcactgtcggctacttgagccccgcgagccagccagcgcgctcagcagccagtgagactattttaggtcccctcacaatggccttctcatttcccaggcgaaaatgagcaagt

SEQ ID NO: 7854 - DNA, 194 bp, Homo sapiens; identical to SEQ ID NO: 2576
  misc_feature 1..194: note = chr5:71014720-71014914
  misc_feature 1..194: note = hyper
  source 1..194: mol_type = genomic DNA

SEQ ID NO: 7855 - DNA, 359 bp, Homo sapiens
  misc_feature 1..359: note = chr5:71015180-71015539
  misc_feature 1..359: note = hyper
  source 1..359: mol_type = genomic DNA
cctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctggg

SEQ ID NO: 7856 - DNA, 30 bp, Homo sapiens
  misc_feature 1..30: note = chr5:71403263-71403293
  misc_feature 1..30: note = hyper
  source 1..30: mol_type = genomic DNA
cggagacagtaccttcggagataatccttt

SEQ ID NO: 7857 - DNA, 60 bp, Homo sapiens
  misc_feature 1..60: note = chr5:71403566-71403626
  misc_feature 1..60: note = hyper
  source 1..60: mol_type = genomic DNA
acgcgcgctgggagacgcgcaaacacgaccccacccagggcgcgacggtcactgcgctcc

SEQ ID NO: 7858 - DNA, 30 bp, Homo sapiens
  misc_feature 1..30: note = chr5:71404019-71404049
  misc_feature 1..30: note = hyper
  source 1..30: mol_type = genomic DNA
tcagcccctgagaaacgccttttctgattt

SEQ ID NO: 7859 - DNA, 30 bp, Homo sapiens
  misc_feature 1..30: note = chr5:71404812-71404842
  misc_feature 1..30: note = hyper
  source 1..30: mol_type = genomic DNA
gcactgcggtctctacggcagcccgaggcg

SEQ ID NO: 7860 - DNA, 63 bp, Homo sapiens
  misc_feature 1..63: note = chr5:72416102-72416165
  misc_feature 1..63: note = hyper
  source 1..63: mol_type = genomic DNA
gggggcatctcaactcgccggccccgccaggtgtgcgggccaggcagccgtggaaggtgccca

SEQ ID NO: 7861 - DNA, 15 bp, Homo sapiens
  misc_feature 1..15: note = chr5:72526051-72526066
  misc_feature 1..15: note = hyper
  source 1..15: mol_type = genomic DNA
tcgccccagactgtc

SEQ ID NO: 7862 - DNA, 20 bp, Homo sapiens
  misc_feature 1..20: note = chr5:72526395-72526415
  misc_feature 1..20: note = hyper
  source 1..20: mol_type = genomic DNA
gtgggcccaatgctccgggc

SEQ ID NO: 7863 - DNA, 156 bp, Homo sapiens
  misc_feature 1..156: note = chr5:72526491-72526647
  misc_feature 1..156: note = hyper
  source 1..156: mol_type = genomic DNA
cgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagtta

SEQ ID NO: 7864 - DNA, 481 bp, Homo sapiens; identical to SEQ ID NO: 445
  misc_feature 1..481: note = chr5:72529345-72529826
  misc_feature 1..481: note = hyper
  source 1..481: mol_type = genomic DNA

SEQ ID NO: 7865 - DNA, 374 bp, Homo sapiens; identical to SEQ ID NO: 446
  misc_feature 1..374: note = chr5:72529889-72530263
  misc_feature 1..374: note = hyper
  source 1..374: mol_type = genomic DNA

SEQ ID NO: 7866 - DNA, 32 bp, Homo sapiens
  misc_feature 1..32: note = chr5:72530577-72530609
  misc_feature 1..32: note = hyper
  source 1..32: mol_type = genomic DNA
ttccacccccacccccgcggaatgacagaaag

SEQ ID NO: 7867 - DNA, 35 bp, Homo sapiens; identical to SEQ ID NO: 447
  misc_feature 1..35: note = chr5:72594802-72594837
  misc_feature 1..35: note = hyper
  source 1..35: mol_type = genomic DNA

SEQ ID NO: 7868 - DNA, 71 bp, Homo sapiens; identical to SEQ ID NO: 448
  misc_feature 1..71: note = chr5:72594867-72594938
  misc_feature 1..71: note = hyper
  source 1..71: mol_type = genomic DNA

SEQ ID NO: 7869 - DNA, 282 bp, Homo sapiens
  misc_feature 1..282: note = chr5:72595440-72595722
  misc_feature 1..282: note = hyper
  source 1..282: mol_type = genomic DNA
ttgtccaccttgccccgaaggcaagtctggatatgaaaagaaaaaggcgggcaacggaggagatttatttttcattttaactttcctctcccaggcttcctcaccccctgcccccttcgattcctaggaggggcggccccagccctcggagccgattctcggcgctgcgctaggacatcagaggcgatacaggttcgatgttaaatgaaccttcaggccgccggacaatggcgcagacctcacacgggggcaccgcgccttcccccagccgtgctcggctcc

SEQ ID NO: 7870 - DNA, 15 bp, Homo sapiens
  misc_feature 1..15: note = chr5:72595773-72595788
  misc_feature 1..15: note = hyper
  source 1..15: mol_type = genomic DNA
cgaaccaatgggcag

SEQ ID NO: 7871 - DNA, 30 bp, Homo sapiens
  misc_feature 1..30: note = chr5:72596861-72596891
  misc_feature 1..30: note = hyper
  source 1..30: mol_type = genomic DNA
cacagagaggttgagcgttgccaaggactg

SEQ ID NO: 7872 - DNA, 72 bp, Homo sapiens
  misc_feature 1..72: note = chr5:72598030-72598102
  misc_feature 1..72: note = hyper
  source 1..72: mol_type = genomic DNA
gcaatggaccatcaacgatcaagaaaaaaatacaaaggagaaatgaaatagctcatccgaaaagtcctactg

SEQ ID NO: 7873 - DNA, 383 bp, Homo sapiens; identical to SEQ ID NO: 449
  misc_feature 1..383: note = chr5:72599059-72599442
  misc_feature 1..383: note = hyper
  source 1..383: mol_type = genomic DNA

SEQ ID NO: 7874 - DNA, 371 bp, Homo sapiens; identical to SEQ ID NO: 450
  misc_feature 1..371: note = chr5:72599462-72599833
  misc_feature 1..371: note = hyper
  source 1..371: mol_type = genomic DNA

SEQ ID NO: 7875 - DNA, 30 bp, Homo sapiens
  misc_feature 1..30: note = chr5:72608427-72608457
  misc_feature 1..30: note = hyper
  source 1..30: mol_type = genomic DNA
gggaagctgtgcctccgcaaacacagccca

SEQ ID NO: 7876 - DNA, 83 bp, Homo sapiens
  misc_feature 1..83: note = chr5:72715590-72715673
  misc_feature 1..83: note = hyper
  source 1..83: mol_type = genomic DNA
cggcccgggggagggcgaggcccggctgcctgcgctcgcgttcccaggccctcggaaccgcgcgccctcgaggccgagcgagc

SEQ ID NO: 7877 - DNA, 40 bp, Homo sapiens
  misc_feature 1..40: note = chr5:72716058-72716098
  misc_feature 1..40: note = hyper
  source 1..40: mol_type = genomic DNA
atgtcccctaaagcacgggaagcttcgtgttttatgtttg

SEQ ID NO: 7878 - DNA, 30 bp, Homo sapiens
  misc_feature 1..30: note = chr5:72733093-72733123
  misc_feature 1..30: note = hyper
  source 1..30: mol_type = genomic DNA
tcagacaggggagtgcggtggagtttatgc

SEQ ID NO: 7879 - DNA, 30 bp, Homo sapiens
  misc_feature 1..30: note = chr5:72733558-72733588
  misc_feature 1..30: note = hyper
  source 1..30: mol_type = genomic DNA
agaggccgagcctcccgctcctgttgccat

SEQ ID NO: 7880 - DNA, 46 bp, Homo sapiens
  misc_feature 1..46: note = chr5:72740138-72740184
  misc_feature 1..46: note = hyper
  source 1..46: mol_type = genomic DNA
cccatccagggtccacggctcactcgtccctcgcctgccccgcggc

SEQ ID NO: 7881 - DNA, 232 bp, Homo sapiens
  misc_feature 1..232: note = chr5:72742850-72743082
  misc_feature 1..232: note = hyper
  source 1..232: mol_type = genomic DNA
gcagagtccccaaggcggcggacgaggagactgaggaggcggcggcggccgcggcggccacgagggatcgggtgagcgcggccgccgggcccacggccgcctgcgccgcgcagcctcctccgctggatccgggagctggcggcgccgccaccggcgagggcgagggcgaggcctgagcggcggcggcggcctgcgcggcggcggcggcagcggcggccgggcccaagctgcc

SEQ ID NO: 7882 - DNA, 51 bp, Homo sapiens
  misc_feature 1..51: note = chr5:72743504-72743555
  misc_feature 1..51: note = hyper
  source 1..51: mol_type = genomic DNA
gggagcagcggctgccgcttgaagcgcttcctccggcgcaggaagctgccg

SEQ ID NO: 7883 - DNA, 171 bp, Homo sapiens
  misc_feature 1..171: note = chr5:72744287-72744458
  misc_feature 1..171: note = hyper
  source 1..171: mol_type = genomic DNA
gcgccacgctgggggcgctgcgactgcggctgccggagctgcgccggggctgccgggtggcggcggagtctcgcgcgccgactttataactcctgcgccgccgcggtagccgcgcggatgctgcgctccctgggctccgctcgcgcccggcccgggcggaggacttgacct

SEQ ID NO: 7884 - DNA, 32 bp, Homo sapiens
  misc_feature 1..32: note = chr5:72744886-72744918
  misc_feature 1..32: note = hyper
  source 1..32: mol_type = genomic DNA
cctcagaagcacacccgcgacactctggtttg

SEQ ID NO: 7885 - DNA, 53 bp, Homo sapiens
  misc_feature 1..53: note = chr5:74162540-74162593
  misc_feature 1..53: note = hyper
  source 1..53: mol_type = genomic DNA
gcaacgctgattttgcgtattcctttaatgccgaccttcgcaggattctgttc

SEQ ID NO: 7886 - DNA, 302 bp, Homo sapiens
  misc_feature 1..302: note = chr5:75377939-75378241
  misc_feature 1..302: note = hyper
  source 1..302: mol_type = genomic DNA
caggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaa

SEQ ID NO: 7887 - DNA, 148 bp, Homo sapiens
  misc_feature 1..148: note = chr5:75379107-75379255
  misc_feature 1..148: note = hyper
  source 1..148: mol_type = genomic DNA
gggggaggaggcaggcggaggagaggaggaggaccgcagcgtgcaagccgggagccactttcccgcccctcctctcgccgctgacacgctcagaggagtcaccactccgcgcgctgcaggcgagagtggcagacggaggcagcccggg

SEQ ID NO: 7888 - DNA, 126 bp, Homo sapiens; identical to SEQ ID NO: 2583
  misc_feature 1..126: note = chr5:75380067-75380193
  misc_feature 1..126: note = hyper
  source 1..126: mol_type = genomic DNA

SEQ ID NO: 7889 - DNA, 452 bp, Homo sapiens; identical to SEQ ID NO: 2584
  misc_feature 1..452: note = chr5:75380422-75380874
  misc_feature 1..452: note = hyper
  source 1..452: mol_type = genomic DNA

SEQ ID NO: 7890 - DNA, 47 bp, Homo sapiens
  misc_feature 1..47: note = chr5:76011307-76011354
  misc_feature 1..47: note = hyper
  source 1..47: mol_type = genomic DNA
tgaaacgcctaacttcgcgaaataaagagagacgtataaaagttcaa

SEQ ID NO: 7891 - DNA, 92 bp, Homo sapiens; identical to SEQ ID NO: 451
  misc_feature 1..92: note = chr5:76249579-76249671
  misc_feature 1..92: note = hyper
  source 1..92: mol_type = genomic DNA

SEQ ID NO: 7892 - DNA, 212 bp, Homo sapiens; identical to SEQ ID NO: 452
  misc_feature 1..212: note = chr5:76249695-76249907
  misc_feature 1..212: note = hyper
  source 1..212: mol_type = genomic DNA

SEQ ID NO: 7893 - DNA, 174 bp, Homo sapiens; identical to SEQ ID NO: 453
  misc_feature 1..174: note = chr5:76249944-76250118
  misc_feature 1..174: note = hyper
  source 1..174: mol_type = genomic DNA

SEQ ID NO: 7894 - DNA, 211 bp, Homo sapiens
  misc_feature 1..211: note = chr5:76506548-76506759
  misc_feature 1..211: note = hyper
  source 1..211: mol_type = genomic DNA
ggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgc

SEQ ID NO: 7895 - DNA, 366 bp, Homo sapiens
  misc_feature 1..366: note = chr5:76506760-76507126
  misc_feature 1..366: note = hyper
  source 1..366: mol_type = genomic DNA
cccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgt

SEQ ID NO: 7896 - DNA, 345 bp, Homo sapiens; identical to SEQ ID NO: 454
  misc_feature 1..345: note = chr5:76923679-76924024
  misc_feature 1..345: note = hyper
  source 1..345: mol_type = genomic DNA

SEQ ID NO: 7897 - DNA, 214 bp, Homo sapiens; identical to SEQ ID NO: 455
  misc_feature 1..214: note = chr5:76924086-76924300
  misc_feature 1..214: note = hyper
  source 1..214: mol_type = genomic DNA

SEQ ID NO: 7898 - DNA, 133 bp, Homo sapiens
  misc_feature 1..133: note = chr5:76924754-76924887
  misc_feature 1..133: note = hyper
  source 1..133: mol_type = genomic DNA
ttcattcttagaaagcgcttctgttctctgggtttggatttgaccagcacatgcagaaagagctgattgtgtttctctgtacaaagttgcagggttgtagatgtccgagtgcccccatcggctgccagcaggt

SEQ ID NO: 7899 - DNA, 425 bp, Homo sapiens
  misc_feature 1..425: note = chr5:76925464-76925889
  misc_feature 1..425: note = hyper
  source 1..425: mol_type = genomic DNA
tgcaccgtgtctgtgcgcgcgcgtgtgtagcgtctgagcgtgagcgagagtgcgagtgtgtgtgtttctgcccacaaaccagtccattggtgtctgatttcagatcctgagtcgactccctggtacgtaaaatggcgggaaggatactttttgccgggcgcgggaggagggtcgcgaagtgtggggaaagaggggaccggaggggaggcggcgggcgaggggggtcgtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaa

SEQ ID NO: 7900 - DNA, 326 bp, Homo sapiens
  misc_feature 1..326: note = chr5:76926106-76926432
  misc_feature 1..326: note = hyper
  source 1..326: mol_type = genomic DNA
gactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcgg

SEQ ID NO: 7901 - DNA, 262 bp, Homo sapiens; identical to SEQ ID NO: 2590
  misc_feature 1..262: note = chr5:76928678-76928940
  misc_feature 1..262: note = hyper
  source 1..262: mol_type = genomic DNA

SEQ ID NO: 7902 - DNA, 984 bp, Homo sapiens; identical to SEQ ID NO: 2591
  misc_feature 1..984: note = chr5:76932282-76933266
  misc_feature 1..984: note = hyper
  source 1..984: mol_type = genomic DNA

SEQ ID NO: 7903 - DNA, 30 bp, Homo sapiens
  misc_feature 1..30: note = chr5:76933489-76933519
  misc_feature 1..30: note = hyper
  source 1..30: mol_type = genomic DNA
cctccggccctcagccgattccctcttact

SEQ ID NO: 7904 - DNA, 47 bp, Homo sapiens
  misc_feature 1..47: note = chr5:76934057-76934104
  misc_feature 1..47: note = hyper
  source 1..47: mol_type = genomic DNA
gggtatatcgcctttcgaaaaaaaaaaaaaggcgggggaggggggaa

SEQ ID NO: 7905 - DNA, 323 bp, Homo sapiens; identical to SEQ ID NO: 456
  misc_feature 1..323: note = chr5:76934331-76934654
  misc_feature 1..323: note = hyper
  source 1..323: mol_type = genomic DNA

SEQ ID NO: 7906 - DNA, 194 bp, Homo sapiens; identical to SEQ ID NO: 457
  misc_feature 1..194: note = chr5:76934676-76934870
  misc_feature 1..194: note = hyper
  source 1..194: mol_type = genomic DNA

SEQ ID NO: 7907 - DNA, 602 bp, Homo sapiens; identical to SEQ ID NO: 458
  misc_feature 1..602: note = chr5:76936119-76936721
  misc_feature 1..602: note = hyper
  source 1..602: mol_type = genomic DNA

SEQ ID NO: 7908 - DNA, 94 bp, Homo sapiens
  misc_feature 1..94: note = chr5:76939648-76939742
  misc_feature 1..94: note = hyper
  source 1..94: mol_type = genomic DNA
cacccagaagcctttcgcaatacacgagctcgacatatacacttttttcttttctgcagtaaacagtttcccacacattcgagtttgcaaactt

SEQ ID NO: 7909 - DNA, 30 bp, Homo sapiens
  misc_feature 1..30: note = chr5:76940379-76940409
  misc_feature 1..30: note = hyper
  source 1..30: mol_type = genomic DNA
cccgcccggctcctacgtcccaatcctttt

SEQ ID NO: 7910 - DNA, 97 bp, Homo sapiens
  misc_feature 1..97: note = chr5:76940857-76940954
  misc_feature 1..97: note = hyper
  source 1..97: mol_type = genomic DNA
ccctcgtcccctccccgcaacccgagtgcggctaattccgggcgtctatattcactcaattagagaaatctacagagaagatcgatcttccatctgc

SEQ ID NO: 7911 - DNA, 306 bp, Homo sapiens
  misc_feature 1..306: note = chr5:76941192-76941498
  misc_feature 1..306: note = hyper
  source 1..306: mol_type = genomic DNA
ccctccatgtgggctcgattaaaccgtgatttagccgaaagaaatataattatggctgcaaataaaataatcagcattgaagagcgatttccttaatgagatggagcggttgcacgtcacggagtaaaggggtctcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccaggggg

SEQ ID NO: 7912 - DNA, 389 bp, Homo sapiens
  misc_feature 1..389: note = chr5:76941512-76941901
  misc_feature 1..389: note = hyper
  source 1..389: mol_type = genomic DNA
cgcggcctcctcccggcgtctcccgcgccgtcgggccgggcgggggacacaagccgccgcagcggctagggggccccgccagcccggcccgctccgcctcggctgggcggccgggttggcacaagcaactgccaggcccccgaacactggagaagccggcccgagggaggggcccttgcctggggcgggtgccgagggtcagtccaggaaacttctggaacaggtggaagtcctcccgggtagatgtgagctccatcgggaaaagggtgtcacaaaaacaggtgctcagaggcaggggtgccaccgcggcaccccagaaccccgggtcagctcgcgcggacaccgcgtctgggagtcctggcgtggaagggcctcgggggttctcattc

SEQ ID NO: 7913 - DNA, 182 bp, Homo sapiens; identical to SEQ ID NO: 459
  misc_feature 1..182: note = chr5:77140529-77140711
  misc_feature 1..182: note = hyper
  source 1..182: mol_type = genomic DNA

SEQ ID NO: 7914 - DNA, 101 bp, Homo sapiens; identical to SEQ ID NO: 460
  misc_feature 1..101: note = chr5:77147549-77147650
  misc_feature 1..101: note = hyper
  source 1..101: mol_type = genomic DNA

SEQ ID NO: 7915 - DNA, 260 bp, Homo sapiens; identical to SEQ ID NO: 461
  misc_feature 1..260: note = chr5:77147872-77148132
  misc_feature 1..260: note = hyper
  source 1..260: mol_type = genomic DNA

SEQ ID NO: 7916 - DNA, 280 bp, Homo sapiens; identical to SEQ ID NO: 462
  misc_feature 1..280: note = chr5:77148393-77148673
  misc_feature 1..280: note = hyper
  source 1..280: mol_type = genomic DNA

SEQ ID NO: 7917 - DNA, 367 bp, Homo sapiens; identical to SEQ ID NO: 463
  misc_feature 1..367: note = chr5:77268367-77268734
  misc_feature 1..367: note = hyper
  source 1..367: mol_type = genomic DNA

SEQ ID NO: 7918 - DNA, 227 bp, Homo sapiens; identical to SEQ ID NO: 464
  misc_feature 1..227: note = chr5:77268735-77268962
  misc_feature 1..227: note = hyper
  source 1..227: mol_type = genomic DNA

SEQ ID NO: 7919 - DNA, 49 bp, Homo sapiens
  misc_feature 1..49: note = chr5:77269263-77269312
  misc_feature 1..49: note = hyper
  source 1..49: mol_type = genomic DNA
cgccagcaccaggggcgggctggagggggaccggcgatcagggaaacct

SEQ ID NO: 7920 - DNA, 43 bp, Homo sapiens
  misc_feature 1..43: note = chr5:78408232-78408275
  misc_feature 1..43: note = hyper
  source 1..43: mol_type = genomic DNA
agcgccctctgcacccggcgcgcccagaacagggaggagtgca

SEQ ID NO: 7921 - DNA, 32 bp, Homo sapiens
  misc_feature 1..32: note = chr5:78408297-78408329
  misc_feature 1..32: note = hyper
  source 1..32: mol_type = genomic DNA
cgcctggatctgcaccgcgggtgtcggggccg

SEQ ID NO: 7922 - DNA, 196 bp, Homo sapiens
  misc_feature 1..196: note = chr5:79330939-79331135
  misc_feature 1..196: note = hyper
  source 1..196: mol_type = genomic DNA
cttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggcc

SEQ ID NO: 7923 - DNA, 108 bp, Homo sapiens
  misc_feature 1..108: note = chr5:79331229-79331337
  misc_feature 1..108: note = hyper
  source 1..108: mol_type = genomic DNA
ggacgccgagcacgggtcacctgcggcgccggcccgggcgccgaccgaggttcaacgcacggcccggggacccccaggcggggccaacgccgccgtcgcccccggcct

SEQ ID NO: 7924 - skipped

SEQ ID NO: 7925 - DNA, 583 bp, Homo sapiens; identical to SEQ ID NO: 2601
  misc_feature 1..583: note = chr5:79864862-79865445
  misc_feature 1..583: note = hyper
  source 1..583: mol_type = genomic DNA

SEQ ID NO: 7926 - DNA, 71 bp, Homo sapiens; identical to SEQ ID NO: 2602
  misc_feature 1..71: note = chr5:79865522-79865593
  misc_feature 1..71: note = hyper
  source 1..71: mol_type = genomic DNA

SEQ ID NO: 7927 - DNA, 315 bp, Homo sapiens; identical to SEQ ID NO: 2603
  misc_feature 1..315: note = chr5:79866099-79866414
  misc_feature 1..315: note = hyper
  source 1..315: mol_type = genomic DNA

SEQ ID NO: 7928 - DNA, 300 bp, Homo sapiens
  misc_feature 1..300: note = chr5:80255775-80256075
  misc_feature 1..300: note = hyper
  source 1..300: mol_type = genomic DNA
ttttgtgcatatgtgcgcgcattgtgtttgtgtgcatttgtgagtgtatttttgtgcgtctgagtgtgtgcattgtggatctgggtgaatgtactggtctgcgtgtgtgtgggtgtgcgtgtgtgtgtgcgcgcgttgtgcgcgagtgtgcgagcgcgtgtgagcgggtgtgtggtgcggccgggcgcctccacctccctgatccgccccatcccggcgggcgcccgagcagaggcagcggcccgggccggggcgggcgagggagggacgcgagccggggcaagcgggctgcgccaccgc

SEQ ID NO: 7929 - DNA, 58 bp, Homo sapiens
  misc_feature 1..58: note = chr5:80256312-80256370
  misc_feature 1..58: note = hyper
  source 1..58: mol_type = genomic DNA
gggggctcggccgggagggtggtggttagggcggagagcgtgcctcggccccagcccg

SEQ ID NO: 7930 - DNA, 91 bp, Homo sapiens
  misc_feature 1..91: note = chr5:80256428-80256519
  misc_feature 1..91: note = hyper
  source 1..91: mol_type = genomic DNA
cgtggggaaagggggcgcccttcgccggccgggacctgagcggtcgcgccctcgagggagccagctgggccatggccgcgaggcaggggtg

SEQ ID NO: 7931 - DNA, 105 bp, Homo sapiens; identical to SEQ ID NO: 2604
  misc_feature 1..105: note = chr5:80689690-80689795
  misc_feature 1..105: note = hyper
  source 1..105: mol_type = genomic DNA

SEQ ID NO: 7932 - DNA, 92 bp, Homo sapiens
  misc_feature 1..92: note = chr5:80690062-80690154
  misc_feature 1..92: note = hyper
  source 1..92: mol_type = genomic DNA
aggtggtgggagctgcgagtgagggggcccgcactgtcatcccaggactatcgcgagtgggggaaaaccagcgctctcgggtctcaggagaa

SEQ ID NO: 7933 - DNA, 30 bp, Homo sapiens
  misc_feature 1..30: note = chr5:81075100-81075130
  misc_feature 1..30: note = hyper
  source 1..30: mol_type = genomic DNA
cctgacctgcagctccgcagaattccaaac

SEQ ID NO: 7934 - DNA, 37 bp, Homo sapiens
  misc_feature 1..37: note = chr5:82767171-82767208
  misc_feature 1..37: note = hyper
  source 1..37: mol_type = genomic DNA
ccagaactagctgcacggggggcggggaaatgggggt

SEQ ID NO: 7935 - DNA, 364 bp, Homo sapiens; identical to SEQ ID NO: 465
  misc_feature 1..364: note = chr5:82767429-82767793
  misc_feature 1..364: note = hyper
  source 1..364: mol_type = genomic DNA

SEQ ID NO: 7936 - DNA, 156 bp, Homo sapiens
  misc_feature 1..156: note = chr5:82768425-82768581
  misc_feature 1..156: note = hyper
  source 1..156: mol_type = genomic DNA
ctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcag

SEQ ID NO: 7937 - DNA, 110 bp, Homo sapiens
  misc_feature 1..110: note = chr5:82769171-82769281
  misc_feature 1..110: note = hyper
  source 1..110: mol_type = genomic DNA
ccctgggagatgctgcgggaagggggagaaatctacacggcgcctggagagttgtcctgccgcgcgcacacccgcggcagagtctctctgggtcgcgttcctcatctttg

SEQ ID NO: 7938 - DNA, 41 bp, Homo sapiens
  misc_feature 1..41: note = chr5:82769910-82769951
  misc_feature 1..41: note = hyper
  source 1..41: mol_type = genomic DNA
accacttgaacccaacgctagggccccgccccaggatattg

SEQ ID NO: 7939 - DNA, 30 bp, Homo sapiens
  misc_feature 1..30: note = chr5:83679177-83679207
  misc_feature 1..30: note = hyper
  source 1..30: mol_type = genomic DNA
ggacaagctgcacctcgcaggggacctgga

SEQ ID NO: 7940 - DNA, 34 bp, Homo sapiens
  misc_feature 1..34: note = chr5:83679766-83679800
  misc_feature 1..34: note = hyper
  source 1..34: mol_type = genomic DNA
gtctgcagtcagcatcgcccgcactgcctaggga

SEQ ID NO: 7941 - DNA, 82 bp, Homo sapiens
  misc_feature 1..82: note = chr5:83680216-83680298
  misc_feature 1..82: note = hyper
  source 1..82: mol_type = genomic DNA
cggctggtcaggggtcgtcgcggagggcagtgtagccgaggtggcagcgcagggcagcagcagactccgcccctactaaaga

SEQ ID NO: 7942 - DNA, 63 bp, Homo sapiens; identical to SEQ ID NO: 466
  misc_feature 1..63: note = chr5:87955602-87955665
  misc_feature 1..63: note = hyper
  source 1..63: mol_type = genomic DNA

SEQ ID NO: 7943 - DNA, 495 bp, Homo sapiens; identical to SEQ ID NO: 467
  misc_feature 1..495: note = chr5:87956168-87956663
  misc_feature 1..495: note = hyper
  source 1..495: mol_type = genomic DNA

SEQ ID NO: 7944 - DNA, 427 bp, Homo sapiens; identical to SEQ ID NO: 468
  misc_feature 1..427: note = chr5:87956679-87957106
  misc_feature 1..427: note = hyper
  source 1..427: mol_type = genomic DNA

SEQ ID NO: 7945 - DNA, 30 bp, Homo sapiens
  misc_feature 1..30: note = chr5:87963456-87963486
  misc_feature 1..30: note = hyper
  source 1..30: mol_type = genomic DNA
aattgtggaccagcccggcaaggtcaaagg

SEQ ID NO: 7946 - DNA, 304 bp, Homo sapiens; identical to SEQ ID NO: 469
  misc_feature 1..304: note = chr5:87967773-87968077
  misc_feature 1..304: note = hyper
  source 1..304: mol_type = genomic DNA

SEQ ID NO: 7947 - DNA, 11 bp, Homo sapiens
  misc_feature 1..11: note = chr5:87968675-87968686
  misc_feature 1..11: note = hyper
  source 1..11: mol_type = genomic DNA
gcaccggctag

SEQ ID NO: 7948 - DNA, 86 bp, Homo sapiens; identical to SEQ ID NO: 471
  misc_feature 1..86: note = chr5:87968772-87968858
  misc_feature 1..86: note = hyper
  source 1..86: mol_type = genomic DNA

SEQ ID NO: 7949 - DNA, 73 bp, Homo sapiens; identical to SEQ ID NO: 472
  misc_feature 1..73: note = chr5:87970041-87970114
  misc_feature 1..73: note = hyper
  source 1..73: mol_type = genomic DNA

SEQ ID NO: 7950 - DNA, 792 bp, Homo sapiens; identical to SEQ ID NO: 473
  misc_feature 1..792: note = chr5:87970115-87970907
  misc_feature 1..792: note = hyper
  source 1..792: mol_type = genomic DNA

SEQ ID NO: 7951 - DNA, 318 bp, Homo sapiens
  misc_feature 1..318: note = chr5:87971517-87971835
  misc_feature 1..318: note = hyper
  source 1..318: mol_type = genomic DNA
agggaagcaaaagaacgtgtgtgtggtggggctggaagctcagggcaagagtctgcgtgtgcggccggaaggctggcgagtctgagagccgcgcggtgcagaaagaaggcggcggcttgtcctcccccggggccggcactggtcccttggcaccccggcctgggctcggctactgccgccgccgcccgcgctctcgggctccgccggctgccgctccgtgttttcccccatcccggcttcacgttcaaggtttagctgcgaggtcacgtccattgacgtcagctccctgtctccctctacgtccggctacatttacat

SEQ ID NO: 7952 - DNA, 374 bp, Homo sapiens
  misc_feature 1..374: note = chr5:87974084-87974458
  misc_feature 1..374: note = hyper
  source 1..374: mol_type = genomic DNA
aatctcccttattggcgcatggtagtaacccaaagcgtgtgaaccgtcaccgtcgctgccgtgtgcgcgctgtggcttaccccgagggccggtggctcggtgactcgctggctaggtgggtgttggggaagagggtgggtagcgtcgctgccgctgccgccgcgggtccgggtgctctgtcccagcccggcagccgagcgcgcagtgtcggagccccctcccaccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaac

SEQ ID NO: 7953 - DNA, 100 bp, Homo sapiens
  misc_feature 1..100: note = chr5:87979725-87979825
  misc_feature 1..100: note = hyper
  source 1..100: mol_type = genomic DNA
acttaaaagcccttgcgactccctctgaattcttagttacttatgacggccttcctcactgcacatagcccctggggtgtgtgtgtgtgtgtgtgtgtgt

SEQ ID NO: 7954 - DNA, 100 bp, Homo sapiens
  misc_feature 1..100: note = chr5:87979885-87979985
  misc_feature 1..100: note = hyper
  source 1..100: mol_type = genomic DNA
gtgtgtttaaaacgcttattggtaggtcatcagcagctgatcagacatggtaatccaataatttttttgaatacacacaatttttcgttgaagttaattt

SEQ ID NO: 7955 - DNA, 30 bp, Homo sapiens
  misc_feature 1..30: note = chr5:87985488-87985518
  misc_feature 1..30: note = hyper
  source 1..30: mol_type = genomic DNA
aggactcatctgccgcggggctgccggaag

SEQ ID NO: 7956 - DNA, 69 bp, Homo sapiens
  misc_feature 1..69: note = chr5:87985975-87986044
  misc_feature 1..69: note = hyper
  source 1..69: mol_type = genomic DNA
taagagctctagaggcgcctcttccactcactagggcaccatgtcaaagggactcgtcatggcgattta

SEQ ID NO: 7957 - DNA, 68 bp, Homo sapiens
  misc_feature 1..68: note = chr5:87988516-87988584
  misc_feature 1..68: note = hyper
  source 1..68: mol_type = genomic DNA
gtctcgcagtaggctcgggtcacaggagggagggggtaggggttcagctccgccgaaagagttagcta

SEQ ID NO: 7958 - DNA, 124 bp, Homo sapiens; identical to SEQ ID NO: 474
  misc_feature 1..124: note = chr5:88185263-88185387
  misc_feature 1..124: note = hyper
  source 1..124: mol_type = genomic DNA

SEQ ID NO: 7959 - DNA, 399 bp, Homo sapiens; identical to SEQ ID NO: 475
  misc_feature 1..399: note = chr5:88185388-88185787
  misc_feature 1..399: note = hyper
  source 1..399: mol_type = genomic DNA

SEQ ID NO: 7960 - DNA, 386 bp, Homo sapiens
  misc_feature 1..386: note = chr5:89854523-89854909
  misc_feature 1..386: note = hyper
  source 1..386: mol_type = genomic DNA
cctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcat

SEQ ID NO: 7961 - DNA, 26 bp, Homo sapiens
  misc_feature 1..26: note = chr5:92915099-92915125
  misc_feature 1..26: note = hyper
  source 1..26: mol_type = genomic DNA
cgctagggtcacgccgggtcccaggg

SEQ ID NO: 7962 - DNA, 12 bp, Homo sapiens
  misc_feature 1..12: note = chr5:92940177-92940189
  misc_feature 1..12: note = hyper
  source 1..12: mol_type = genomic DNA
ggggtgggccgg

SEQ ID NO: 7963 - DNA, 73 bp, Homo sapiens
  misc_feature 1..73: note = chr5:94621061-94621134
  misc_feature 1..73: note = hyper
  source 1..73: mol_type = genomic DNA
actgagcgatgaacccgacggagttctaaagctgaagacgtctgcccccgccccgttgcgctccctgggtcca

SEQ ID NO: 7964 - DNA, 545 bp, Homo sapiens
  misc_feature 1..545: note = chr5:94955615-94956160
  misc_feature 1..545: note = hyper
  source 1..545: mol_type = genomic DNA
ggatgaggttctcagcgcccaggggtccgcggcttccgcgagggtagcgtcgggggccgctgcagagattggaagagtacccgccgggaatgggagggaagacgcggggaaggtggagaataggaatcatgtgtgttcctcgagtgtacaacccacatttgagtgacaaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaaca

SEQ ID NO: 7965 - DNA, 486 bp, Homo sapiens
  misc_feature 1..486: note = chr5:94956606-94957092
  misc_feature 1..486: note = hyper
  source 1..486: mol_type = genomic DNA
gcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggc

SEQ ID NO: 7966 - DNA, 59 bp, Homo sapiens; identical to SEQ ID NO: 2617
  misc_feature 1..59: note = chr5:95769034-95769093
  misc_feature 1..59: note = hyper
  source 1..59: mol_type = genomic DNA

SEQ ID NO: 7967 - DNA, 416 bp, Homo sapiens
  misc_feature 1..416: note = chr5:100236552-100236968
  misc_feature 1..416: note = hyper
  source 1..416: mol_type = genomic DNA
tcattctttccccctcgccgccggcgctctggcagcaggggataaccccggtgcgcgcctctcttcctgtttggtttactcaagcgcctgccccaacgccttctcagtcaagctgggaggaaactgcttcagcttgaaaaggatgcgggcaaaagcccagcccgactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctc

SEQ ID NO: 7968 - DNA, 59 bp, Homo sapiens
  misc_feature 1..59: note = chr5:100237658-100237717
  misc_feature 1..59: note = hyper
  source 1..59: mol_type = genomic DNA
gtttctgatagaggacgcctccaaaccggaacagggaggatttccgaaacaggactttg

SEQ ID NO: 7969 - DNA, 30 bp, Homo sapiens
  misc_feature 1..30: note = chr5:100238368-100238398
  misc_feature 1..30: note = hyper
  source 1..30: mol_type = genomic DNA
cagcttagagaagcacgcacatctcaacaa

SEQ ID NO: 7970 - DNA, 95 bp, Homo sapiens; identical to SEQ ID NO: 2618
  misc_feature 1..95: note = chr5:100238882-100238977
  misc_feature 1..95: note = hyper
  source 1..95: mol_type = genomic DNA

SEQ ID NO: 7971 - DNA, 44 bp, Homo sapiens; identical to SEQ ID NO: 2619
  misc_feature 1..44: note = chr5:100238978-100239022
  misc_feature 1..44: note = hyper
  source 1..44: mol_type = genomic DNA

SEQ ID NO: 7972 - DNA, 97 bp, Homo sapiens; identical to SEQ ID NO: 2620
  misc_feature 1..97: note = chr5:100239023-100239120
  misc_feature 1..97: note = hyper
  source 1..97: mol_type = genomic DNA

SEQ ID NO: 7973 - DNA, 590 bp, Homo sapiens; identical to SEQ ID NO: 2621
  misc_feature 1..590: note = chr5:100239134-100239724
  misc_feature 1..590: note = hyper
  source 1..590: mol_type = genomic DNA

SEQ ID NO: 7974 - DNA, 141 bp, Homo sapiens
  misc_feature 1..141: note = chr5:107005171-107005312
  misc_feature 1..141: note = hyper
  source 1..141: mol_type = genomic DNA
gaagcaataaaggttcggaactgctccagacccggaggaccccgccgggcactctggataacctccccactccacttccagggtccgaaaacacgggacgtctgcgactggccggtgtccagcacgcgcactaggaccgcc

SEQ ID NO: 7975 - DNA, 479 bp, Homo sapiens
  misc_feature 1..479: note = chr5:110408719-110409198
  misc_feature 1..479: note = hyper
  source 1..479: mol_type = genomic DNA
gaggtgcctgggctccgggacgccgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgc

SEQ ID NO: 7976 - DNA, 46 bp, Homo sapiens
  misc_feature 1..46: note = chr5:110560287-110560333
  misc_feature 1..46: note = hyper
  source 1..46: mol_type = genomic DNA
gctccaacagggatgcgctgagcgatttcttcgaggtggagtcgga

SEQ ID NO: 7977 - DNA, 248 bp, Homo sapiens; identical to SEQ ID NO: 476
  misc_feature 1..248: note = chr5:112629488-112629736
  misc_feature 1..248: note = hyper
  source 1..248: mol_type = genomic DNA

SEQ ID NO: 7978 - DNA, 34 bp, Homo sapiens
  misc_feature 1..34: note = chr5:112824097-112824131
  misc_feature 1..34: note = hyper
  source 1..34: mol_type = genomic DNA
gcggccgccatcatgcgcccgctccctacttggg

SEQ ID NO: 7979 - DNA, 19 bp, Homo sapiens
  misc_feature 1..19: note = chr5:113391755-113391774
  misc_feature 1..19: note = hyper
  source 1..19: mol_type = genomic DNA
gggagtccccagtcccggc

SEQ ID NO: 7980 - DNA, 184 bp, Homo sapiens
  misc_feature 1..184: note = chr5:113391775-113391959
  misc_feature 1..184: note = hyper
  source 1..184: mol_type = genomic DNA
gggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagcc

SEQ ID NO: 7981 - DNA, 229 bp, Homo sapiens
  misc_feature 1..229: note = chr5:113696982-113697211
  misc_feature 1..229: note = hyper
  source 1..229: mol_type = genomic DNA
gcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcg

SEQ ID NO: 7982 - DNA, 251 bp, Homo sapiens
  misc_feature 1..251: note = chr5:113697471-113697722
  misc_feature 1..251: note = hyper
  source 1..251: mol_type = genomic DNA
agcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctacc

SEQ ID NO: 7983 - DNA, 87 bp, Homo sapiens
  misc_feature 1..87: note = chr5:113698053-113698140
  misc_feature 1..87: note = hyper
  source 1..87: mol_type = genomic DNA
cctcctccggtgccccggcggcgggggcgggagataacctgtccctgctgctccgcacctcctcgcccggcggcgccttccggaccc

SEQ ID NO: 7984 - skipped

SEQ ID NO: 7985 - DNA, 192 bp, Homo sapiens
  misc_feature 1..192: note = chr5:113698392-113698584
  misc_feature 1..192: note = hyper
  source 1..192: mol_type = genomic DNA
accaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccg

SEQ ID NO: 7986 - DNA, 30 bp, Homo sapiens
  misc_feature 1..30: note = chr5:113698669-113698699
  misc_feature 1..30: note = hyper
  source 1..30: mol_type = genomic DNA
cgtggtgtctaagcccgagcacaacaactc

SEQ ID NO: 7987 - DNA, 156 bp, Homo sapiens
  misc_feature 1..156: note = chr5:113699401-113699557
  misc_feature 1..156: note = hyper
  source 1..156: mol_type = genomic DNA
ttccaggtctactctcgtctcttttggttttgaggccgagtgatctgacagatcacagagccaagacaggtgcacccctctccccttatcttccttctgtgagttcaggtccacctgtgggggactgactgactctggggacgtggaaggcggtta

SEQ ID NO: 7988 - DNA, 571 bp, Homo sapiens; identical to SEQ ID NO: 2623
  misc_feature 1..571: note = chr5:114515009-114515580
  misc_feature 1..571: note = hyper
  source 1..571: mol_type = genomic DNA

SEQ ID NO: 7989 - DNA, 61 bp, Homo sapiens; identical to SEQ ID NO: 2624
  misc_feature 1..61: note = chr5:114515610-114515671
  misc_feature 1..61: note = hyper
  source 1..61: mol_type = genomic DNA

SEQ ID NO: 7990 - DNA, 168 bp, Homo sapiens
  misc_feature 1..168: note = chr5:114515948-114516116
  misc_feature 1..168: note = hyper
  source 1..168: mol_type = genomic DNA
aggatccgggtgcagcggtcggggctgcgcgatctaacggaacaaacgagggcggcggcggcggcagcagaggccgtgaaaccctcaccaggcggagccgggcgcgcggaggccccgcctcctcgggggtcgcggcagcggttcggaccgcagcggagacaaacaaac

SEQ ID NO: 7991 - DNA, 173 bp, Homo sapiens; identical to SEQ ID NO: 477
  misc_feature 1..173: note = chr5:115151185-115151358
  misc_feature 1..173: note = hyper
  source 1..173: mol_type = genomic DNA

SEQ ID NO: 7992 - DNA, 736 bp, Homo sapiens; identical to SEQ ID NO: 478
  misc_feature 1..736: note = chr5:115151649-115152385
  misc_feature 1..736: note = hyper
  source 1..736: mol_type = genomic DNA

SEQ ID NO: 7993 - DNA, 61 bp, Homo sapiens; identical to SEQ ID NO: 479
  misc_feature 1..61: note = chr5:115152616-115152677
  misc_feature 1..61: note = hyper
  source 1..61: mol_type = genomic DNA

SEQ ID NO: 7994 - DNA, 47 bp, Homo sapiens; identical to SEQ ID NO: 2628
  misc_feature 1..47: note = chr5:115297186-115297233
  misc_feature 1..47: note = hyper
  source 1..47: mol_type = genomic DNA

SEQ ID NO: 7995 - DNA, 30 bp, Homo sapiens
  misc_feature 1..30: note = chr5:115297472-115297502
  misc_feature 1..30: note = hyper
  source 1..30: mol_type = genomic DNA
cccttcttgtggtaacgcggtcctaaccct

SEQ ID NO: 7996 - DNA, 45 bp, Homo sapiens
  misc_feature 1..45: note = chr5:115297941-115297986
  misc_feature 1..45: note = hyper
  source 1..45: mol_type = genomic DNA
cacgtttaaggtgtccggattcgtttggcttgaccaccccctccc

SEQ ID NO: 7997 - DNA, 260 bp, Homo sapiens
  misc_feature 1..260: note = chr5:115298781-115299041
  misc_feature 1..260: note = hyper
  source 1..260: mol_type = genomic DNA
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcgg

SEQ ID NO: 7998 - DNA, 30 bp, Homo sapiens
  misc_feature 1..30: note = chr5:115911931-115911961
  misc_feature 1..30: note = hyper
  source 1..30: mol_type = genomic DNA
gctgtcagcaggggccgctatccccacctt

SEQ ID NO: 7999 - DNA, 30 bp, Homo sapiens
  misc_feature 1..30: note = chr5:119800264-119800294
  misc_feature 1..30: note = hyper
  source 1..30: mol_type = genomic DNA
acagatcaagatcatcgtggaggatttgga

SEQ ID NO: 8000 - DNA, 326 bp, Homo sapiens
  misc_feature 1..326: note = chr5:119800576-119800902
  misc_feature 1..326: note = hyper
  source 1..326: mol_type = genomic DNA
ggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagc

SEQ ID NO: 8001 - DNA, 312 bp, Homo sapiens; identical to SEQ ID NO: 2629
  misc_feature 1..312: note = chr5:119801156-119801468
  misc_feature 1..312: note = hyper
  source 1..312: mol_type = genomic DNA

SEQ ID NO: 8002 - DNA, 81 bp, Homo sapiens
  misc_feature 1..81: note = chr5:121412825-121412906
  misc_feature 1..81: note = hyper
  source 1..81: mol_type = genomic DNA
caagagaactggggacgcccgggactgcaaagcaatgtgaaaaggaagcaggaggggccagacgcgcggtttgcactggat

SEQ ID NO: 8003 - DNA, 148 bp, Homo sapiens
  misc_feature 1..148: note = chr5:121413157-121413305
  misc_feature 1..148: note = hyper
  source 1..148: mol_type = genomic DNA
aggggttgtaagggtcgtcgcccaccatgccgtccacgcggctgggcggccgcaggttactgagcgcaggaacttctcccggcgctgtctggttctccgcgcgcgaggcgccagcttcgcgggctctagatgtcgagtagccagcttg

SEQ ID NO: 8004 - DNA, 55 bp, Homo sapiens
  misc_feature 1..55: note = chr5:121647480-121647535
  misc_feature 1..55: note = hyper
  source 1..55: mol_type = genomic DNA
aagaaagagcaggttcgtggacaggagccggcgggcaggccgggggatccctggt

SEQ ID NO: 8005 - DNA, 35 bp, Homo sapiens
  misc_feature 1..35: note = chr5:122422616-122422651
  misc_feature 1..35: note = hyper
  source 1..35: mol_type = genomic DNA
ttcttccctggaccccgcagcgaggggaaccaaat

SEQ ID NO: 8006 - DNA, 48 bp, Homo sapiens; identical to SEQ ID NO: 2630
  misc_feature 1..48: note = chr5:122423328-122423376
  misc_feature 1..48: note = hyper
  source 1..48: mol_type = genomic DNA

SEQ ID NO: 8007 - DNA, 154 bp, Homo sapiens
  misc_feature 1..154: note = chr5:122423874-122424028
  misc_feature 1..154: note = hyper
  source 1..154: mol_type = genomic DNA
ggcaagtgcctccttcgtgggtgcgagactgcatcgaagggctgccctggcacaaagtctggggagaggacatggtggaggtggggctgcactcccaccctgcccctctaacaccaggttttgggtagagaaacctatgcgtgacctcctgcgg

SEQ ID NO: 8008 - DNA, 78 bp, Homo sapiens
  misc_feature 1..78: note = chr5:122424436-122424514
  misc_feature 1..78: note = hyper
  source 1..78: mol_type = genomic DNA
caggaaaaactgagccgggcaaaagcgcaaacccggtcctggcggcgcgggcttgctccagcgcggacaccacagcgt

SEQ ID NO: 8009 - DNA, 166 bp, Homo sapiens
  misc_feature 1..166: note = chr5:122425166-122425332
  misc_feature 1..166: note = hyper
  source 1..166: mol_type = genomic DNA
gctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacg

SEQ ID NO: 8010 - DNA, 79 bp, Homo sapiens
  misc_feature 1..79: note = chr5:122425562-122425641
  misc_feature 1..79: note = hyper
  source 1..79: mol_type = genomic DNA
agggagccgcggaaccgggcggccgccggctgaaccaccggctcgggcactttctccagggtcccagtggccctcttcc

SEQ ID NO: 8011 - DNA, 162 bp, Homo sapiens
  misc_feature 1..162: note = chr5:122425701-122425863
  misc_feature 1..162: note = hyper
  source 1..162: mol_type = genomic DNA
cgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagc

SEQ ID NO: 8012 - DNA, 182 bp, Homo sapiens
  misc_feature 1..182: note = chr5:122426164-122426346
  misc_feature 1..182: note = hyper
  source 1..182: mol_type = genomic DNA
tggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgcc

SEQ ID NO: 8013 - DNA, 44 bp, Homo sapiens
  misc_feature 1..44: note = chr5:122426805-122426849
  misc_feature 1..44: note = hyper
  source 1..44: mol_type = genomic DNA
gggttgtgggggaaccggcgggagctgttcgctggccaggcctc

SEQ ID NO: 8014 - DNA, 80 bp, Homo sapiens
  misc_feature 1..80: note = chr5:122430755-122430835
  misc_feature 1..80: note = hyper
  source 1..80: mol_type = genomic DNA
gccgccccgcagggtcgagactgaaatcaattggctccccttccggcggccaggcaaacctgcctcgcctctggatctgc

SEQ ID NO: 8015 - DNA, 268 bp, Homo sapiens
  misc_feature 1..268: note = chr5:122431118-122431386
  misc_feature 1..268: note = hyper
  source 1..268: mol_type = genomic DNA
ggcgtgaaccccacgcgagaagttcgggcccggatgctctgcctgcccgccctctgcccggctccccagcccccacgcccctccccgcctagggcgcacgcggcactgccagcaggcggcactcccgggtcctagtcgccgggctgggatcgatgggcgccggcccctcgggtctcggcctgcgagactgagggccgcgaccttggcggcggtaggggaggatttacagccggggtggatagtggcgcccaggcggggaagcaggctt

SEQ ID NO: 8016 - DNA, 28 bp, Homo sapiens
  misc_feature 1..28: note = chr5:122434500-122434528
  misc_feature 1..28: note = hyper
  source 1..28: mol_type = genomic DNA
tccagaacagcaccccggtcccccaccc

SEQ ID NO: 8017 - DNA, 15 bp, Homo sapiens
  misc_feature 1..15: note = chr5:122434605-122434620
  misc_feature 1..15: note = hyper
  source 1..15: mol_type = genomic DNA
cgcccttggagtcct

SEQ ID NO: 8018 - DNA, 311 bp, Homo sapiens
  misc_feature 1..311: note = chr5:125930586-125930897
  misc_feature 1..311: note = hyper
  source 1..311: mol_type = genomic DNA
ctcccatgctactaccgcatccagcgccagcggggagtcggtaggtcagtgcccgcccggcctcctcgagcgagccccggcggctgcagagatttcttgagcgcccgcgtacctctccccggcctccccagcttccattatacacgccctcgttttcctcgcggagccccagctctttcagccacgcatactggggctgattgatgaggagagtggacatgaaggcggcaggcctgctccaaggtccagagagcttgctggtctttgcagcgtgcacacacagcgcgcgaggaaggcgccacatactgagc

SEQ ID NO: 8019 - DNA, 96 bp, Homo sapiens
  misc_feature 1..96: note = chr5:126626514-126626610
  misc_feature 1..96: note = hyper
  source 1..96: mol_type = genomic DNA
cagcaagtactttcccggtgcgcaaaactgggcgactgggaacgcgttgagacgttcctctttcccgcttctccacctttacgcctgaaagaagac

SEQ ID NO: 8020 - DNA, 48 bp, Homo sapiens
  misc_feature 1..48: note = chr5:127872942-127872990
  misc_feature 1..48: note = hyper
  source 1..48: mol_type = genomic DNA
ctaaagggtctgggacggagtgggccagaaagccgccaaactgaggat

SEQ ID NO: 8021 - DNA, 102 bp, Homo sapiens; identical to SEQ ID NO: 480
  misc_feature 1..102: note = chr5:127873552-127873654
  misc_feature 1..102: note = hyper
  source 1..102: mol_type = genomic DNA

SEQ ID NO: 8022 - DNA, 295 bp, Homo sapiens; identical to SEQ ID NO: 2632
  misc_feature 1..295: note = chr5:127874183-127874478
  misc_feature 1..295: note = hyper
  source 1..295: mol_type = genomic DNA

SEQ ID NO: 8023 - DNA, 238 bp, Homo sapiens; identical to SEQ ID NO: 2633
  misc_feature 1..238: note = chr5:127874705-127874943
  misc_feature 1..238: note = hyper
  source 1..238: mol_type = genomic DNA

SEQ ID NO: 8024 - DNA, 40 bp, Homo sapiens
  misc_feature 1..40: note = chr5:128300655-128300695
  misc_feature 1..40: note = hyper
  source 1..40: mol_type = genomic DNA
tggatgacctttgtgcgacactgttataccttatcagcct

SEQ ID NO: 8025 - DNA, 82 bp, Homo sapiens
  misc_feature 1..82: note = chr5:128300712-128300794
  misc_feature 1..82: note = hyper
  source 1..82: mol_type = genomic DNA
cgcccaatcccagcaactctggttctcctgtgaccccaagccttccagatccctgggtttccccccacgggactgtcacatt

SEQ ID NO: 8026 - DNA, 193 bp, Homo sapiens
  misc_feature 1..193: note = chr5:128301033-128301226
  misc_feature 1..193: note = hyper
  source 1..193: mol_type = genomic DNA
tcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagccc

SEQ ID NO: 8027 - DNA, 355 bp, Homo sapiens; identical to SEQ ID NO: 2634
  misc_feature 1..355: note = chr5:128795742-128796097
  misc_feature 1..355: note = hyper
  source 1..355: mol_type = genomic DNA

SEQ ID NO: 8028 - DNA, 366 bp, Homo sapiens; identical to SEQ ID NO: 2635
  misc_feature 1..366: note = chr5:128796098-128796464
  misc_feature 1..366: note = hyper
  source 1..366: mol_type = genomic DNA

SEQ ID NO: 8029 - DNA, 654 bp, Homo sapiens
  misc_feature 1..654: note = chr5:128796816-128797470
  misc_feature 1..654: note = hyper
  source 1..654: mol_type = genomic DNA
cgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 8030 - DNA, 37 bp, Homo sapiens
  misc_feature 1..37: note = chr5:129241413-129241450
  misc_feature 1..37: note = hyper
  source 1..37: mol_type = genomic DNA
gcttctctgccagcacgtgcttcgggctcccacaggc

SEQ ID NO: 8031 - DNA, 338 bp, Homo sapiens
  misc_feature 1..338: note = chr5:131346877-131347215
  misc_feature 1..338: note = hyper
  source 1..338: mol_type = genomic DNA
gggcctaatctgatccgcggatggtccttgccatcagggaagggggacgcaagaactcggcgggggtttgtggtggggtcgcagagagcaagccctatatctccctccgcagacccaggtgctccccaaacccggcccggagcccgcgagaactgggggcggagggtgtacttaggcggccctggggaccttgacgggacagctcagcagcaggggatgggggctcggcggccgcggagatgtaacacctccacctcgggcgaagacctcatagcctgcgggagatgggagtccgggacgcggacaggacgggcacttacctacgaatagccagaggg

SEQ ID NO: 8032 - DNA, 30 bp, Homo sapiens
  misc_feature 1..30: note = chr5:131593289-131593319
  misc_feature 1..30: note = hyper
  source 1..30: mol_type = genomic DNA
gggcgggggctgggccgagtggggacaggg

SEQ ID NO: 8033 - DNA, 139 bp, Homo sapiens
  misc_feature 1..139: note = chr5:131992154-131992293
  misc_feature 1..139: note = hyper
  source 1..139: mol_type = genomic DNA
ccacccccctatctccgcgggccatcgccgccgcaaccgccgcgccagcgccttctcccacgcgcgggggcgcccctgcccaccgctcccggcagggcttttggtggccatgggggataaggggcgttgactcacccgg

SEQ ID NO: 8034 - DNA, 65 bp, Homo sapiens
  misc_feature 1..65: note = chr5:132947112-132947177
  misc_feature 1..65: note = hyper
  source 1..65: mol_type = genomic DNA
tccccaaactcgaggcgacaggcgccgaaagcagagtgctgtgcctgcctcgtccaggtccctcc

SEQ ID NO: 8035 - DNA, 967 bp, Homo sapiens
  misc_feature 1..967: note = chr5:132947562-132948529
  misc_feature 1..967: note = hyper
  source 1..967: mol_type = genomic DNA
gcaccgggcccgggccgaggggccgcgctcgcctggctccgccggggccgctcggggtcctgaacccaagaacggcgcctgcaggatttcggagccgggcgcgagctgcgggctcggcccgagcgcttctgcgtggcgccccgcgtgccaaccgggtcactccggtccccaccgtagaccccggccacgagcctcggcgtcccagcctctcctcgagtcctggccttggccggggtagccctgccgagccctggcccagcggtcccttccccgcgggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 8036 - DNA, 107 bp, Homo sapiens
  misc_feature 1..107: note = chr5:133449736-133449843
  misc_feature 1..107: note = hyper
  source 1..107: mol_type = genomic DNA
cctgactgaggggcccgtcacagatgtgtgatgtataagctctgcacgcaacaggagctcaataaatgtgcgaaggggggtatacttatgttcgcactgtatgcagg

SEQ ID NO: 8037 - DNA, 53 bp, Homo sapiens
  misc_feature 1..53: note = chr5:134367150-134367203
  misc_feature 1..53: note = hyper
  source 1..53: mol_type = genomic DNA
ccgcaccactgtcctcgggccccttgggttccccgccgcgctccttctctgca

SEQ ID NO: 8038 - DNA, 667 bp, Homo sapiens; identical to SEQ ID NO: 2636
  misc_feature 1..667: note = chr5:134374791-134375458
  misc_feature 1..667: note = hyper
  source 1..667: mol_type = genomic DNA

SEQ ID NO: 8039 - DNA, 112 bp, Homo sapiens; identical to SEQ ID NO: 481
  misc_feature 1..112: note = chr5:134385952-134386064
  misc_feature 1..112: note = hyper
  source 1..112: mol_type = genomic DNA

SEQ ID NO: 8040 - DNA, 39 bp, Homo sapiens
  misc_feature 1..39: note = chr5:134825463-134825502
  misc_feature 1..39: note = hyper
  source 1..39: mol_type = genomic DNA
agcgctgcacaaaatcgtctagcgcggagcagggcgggg

SEQ ID NO: 8041 - DNA, 94 bp, Homo sapiens
  misc_feature 1..94: note = chr5:134825912-134826006
  misc_feature 1..94: note = hyper
  source 1..94: mol_type = genomic DNA
ggagaggcccccgggacctttcaggcccacaaacgccgcgctaaatagccacgcgcacaatagcatgaaagggctcactcggaccttactgcaa

SEQ ID NO: 8042 - DNA, 392 bp, Homo sapiens
  misc_feature 1..392: note = chr5:134870528-134870920
  misc_feature 1..392: note = hyper
  source 1..392: mol_type = genomic DNA
cggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcc

SEQ ID NO: 8043 - DNA, 96 bp, Homo sapiens
  misc_feature 1..96: note = chr5:134871789-134871885
  misc_feature 1..96: note = hyper
  source 1..96: mol_type = genomic DNA
tgcataatttatgctcgcgggaggccgccatcgcccctcccccaacccggagtgtgcccgtaattaccgccggccaatcggcggcgtcgcgcggcc

SEQ ID NO: 8044 - DNA, 512 bp, Homo sapiens; identical to SEQ ID NO: 482
  misc_feature 1..512: note = chr5:134879478-134879990
  misc_feature 1..512: note = hyper
  source 1..512: mol_type = genomic DNA

SEQ ID NO: 8045 - DNA, 180 bp, Homo sapiens
  misc_feature 1..180: note = chr5:134914251-134914431
  misc_feature 1..180: note = hyper
  source 1..180: mol_type = genomic DNA
ggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgcca

SEQ ID NO: 8046 - DNA, 51 bp, Homo sapiens
  misc_feature 1..51: note = chr5:134914701-134914752
  misc_feature 1..51: note = hyper
  source 1..51: mol_type = genomic DNA
ggcctcttttaaatccgctcctgccctcgcagcgagcgagctcattaatat

SEQ ID NO: 8047 - DNA, 37 bp, Homo sapiens
  misc_feature 1..37: note = chr5:135170325-135170362
  misc_feature 1..37: note = hyper
  source 1..37: mol_type = genomic DNA
gggcgtgatgtcagccgccctccggcacttggagagg

SEQ ID NO: 8048 - DNA, 30 bp, Homo sapiens
  misc_feature 1..30: note = chr5:135171026-135171056
  misc_feature 1..30: note = hyper
  source 1..30: mol_type = genomic DNA
cccaacggggcgtcccgactggagggagca

SEQ ID NO: 8049 - DNA, 123 bp, Homo sapiens; identical to SEQ ID NO: 483
  misc_feature 1..123: note = chr5:135265737-135265860
  misc_feature 1..123: note = hyper
  source 1..123: mol_type = genomic DNA

SEQ ID NO: 8050 - DNA, 12 bp, Homo sapiens
  misc_feature 1..12: note = chr5:135265919-135265931
  misc_feature 1..12: note = hyper
  source 1..12: mol_type = genomic DNA
cgccaggtgggc

SEQ ID NO: 8051 - DNA, 197 bp, Homo sapiens; identical to SEQ ID NO: 485
  misc_feature 1..197: note = chr5:135265932-135266129
  misc_feature 1..197: note = hyper
  source 1..197: mol_type = genomic DNA

SEQ ID NO: 8052 - DNA, 110 bp, Homo sapiens; identical to SEQ ID NO: 486
  misc_feature 1..110: note = chr5:135266577-135266687
  misc_feature 1..110: note = hyper
  source 1..110: mol_type = genomic DNA

SEQ ID NO: 8053 - DNA, 49 bp, Homo sapiens
  misc_feature 1..49: note = chr5:135527945-135527994
  misc_feature 1..49: note = hyper
  source 1..49: mol_type = genomic DNA
gcggtcgtggggcagcgcggcgaaggccgaatggcgcagctggcaaccg

SEQ ID NO: 8054 - DNA, 431 bp, Homo sapiens
  misc_feature 1..431: note = chr5:135528223-135528654
  misc_feature 1..431: note = hyper
  source 1..431: mol_type = genomic DNA
cccgccgaccccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctga

SEQ ID NO: 8055 - DNA, 18 bp, Homo sapiens
  misc_feature 1..18: note = chr5:136834033-136834051
  misc_feature 1..18: note = hyper
  source 1..18: mol_type = genomic DNA
cccagggccgggtggcgc

SEQ ID NO: 8056 - DNA, 108 bp, Homo sapiens; identical to SEQ ID NO: 2644
  misc_feature 1..108: note = chr5:136834289-136834397
  misc_feature 1..108: note = hyper
  source 1..108: mol_type = genomic DNA

SEQ ID NO: 8057 - DNA, 53 bp, Homo sapiens
  misc_feature 1..53: note = chr5:136834828-136834881
  misc_feature 1..53: note = hyper
  source 1..53: mol_type = genomic DNA
tactccaagttggggcgcggggttcctctgggcacgtaccttgggggccggcc

SEQ ID NO: 8058 - skipped

SEQ ID NO: 8059 - DNA, 38 bp, Homo sapiens
  misc_feature 1..38: note = chr5:137225091-137225129
  misc_feature 1..38: note = hyper
  source 1..38: mol_type = genomic DNA
cgtcagagccgggcagcgcgcgccgcaagactagcgcg

SEQ ID NO: 8060 - DNA, 86 bp, Homo sapiens
  misc_feature 1..86: note = chr5:137577679-137577765
  misc_feature 1..86: note = hyper
  source 1..86: mol_type = genomic DNA
gccagccccgtgccccgggcggccgctgatagtcggctaatgcgtatcgaatttttgtggagttcggcccgcgcagagtgcgcgcg

SEQ ID NO: 8061 - DNA, 81 bp, Homo sapiens
  misc_feature 1..81: note = chr5:139048090-139048171
  misc_feature 1..81: note = hyper
  source 1..81: mol_type = genomic DNA
ggcccgaggtgatggcggctgttcctgccgttctggggcctgtgccccagagctggccgcgtttctcggggcgggagccag

SEQ ID NO: 8062 - DNA, 44 bp, Homo sapiens
  misc_feature 1..44: note = chr5:139175833-139175877
  misc_feature 1..44: note = hyper
  source 1..44: mol_type = genomic DNA
gcccagcctgagggacggtgggggctgccgggccgattgtctcc

SEQ ID NO: 8063 - DNA, 21 bp, Homo sapiens
  misc_feature 1..21: note = chr5:139175929-139175950
  misc_feature 1..21: note = hyper
  source 1..21: mol_type = genomic DNA
cgtgtgcgtggggggtgccag

SEQ ID NO: 8064 - DNA, 159 bp, Homo sapiens; identical to SEQ ID NO: 2645
  misc_feature 1..159: note = chr5:139227762-139227921
  misc_feature 1..159: note = hyper
  source 1..159: mol_type = genomic DNA

SEQ ID NO: 8065 - DNA, 335 bp, Homo sapiens
  misc_feature 1..335: note = chr5:139525423-139525758
  misc_feature 1..335: note = hyper
  source 1..335: mol_type = genomic DNA
cagttcccagcctcccgccagattcttgcgtgacctcgggcggcacccagtgctgctgtggacagctcattccgccgcggcggcggctgcggctgcggcggctacaacggctcccggcgtgtccccggcgccgccagggggcgaatggggtgcccgccggctcctcggactccgggcgcgccggcactgcgctccggagaggcccggccagggaagaagcaacttccctccgccgccgcagaccagccgggcagagacttccagccccaccctcaagccctctcggtggctctgtgcgcccaggcctaggggtggggggccgtaggtgctgcgcg

SEQ ID NO: 8066 - DNA, 93 bp, Homo sapiens
  misc_feature 1..93: note = chr5:140012165-140012258
  misc_feature 1..93: note = hyper
  source 1..93: mol_type = genomic DNA
gcggaggcatggtgccggttatctttaggtcctcgagcgtcagttccttgaggcgggagtacgctagcacacgcagggcgcctaccagtagct

SEQ ID NO: 8067 - DNA, 52 bp, Homo sapiens; identical to SEQ ID NO: 2646
  misc_feature 1..52: note = chr5:140187094-140187146
  misc_feature 1..52: note = hyper
  source 1..52: mol_type = genomic DNA

SEQ ID NO: 8068 - DNA, 245 bp, Homo sapiens
  misc_feature 1..245: note = chr5:140305805-140306050
  misc_feature 1..245: note = hyper
  source 1..245: mol_type = genomic DNA
cctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaa

SEQ ID NO: 8069 - DNA, 176 bp, Homo sapiens
  misc_feature 1..176: note = chr5:140306444-140306620
  misc_feature 1..176: note = hyper
  source 1..176: mol_type = genomic DNA
cgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggc

SEQ ID NO: 8070 - DNA, 59 bp, Homo sapiens
  misc_feature 1..59: note = chr5:140306674-140306733
  misc_feature 1..59: note = hyper
  source 1..59: mol_type = genomic DNA
cggggtggatctacccagcggcaatttggtggtcagagagccggcggaccgcgaacagc

SEQ ID NO: 8071 - DNA, 30 bp, Homo sapiens
  misc_feature 1..30: note = chr5:140345497-140345527
  misc_feature 1..30: note = hyper
  source 1..30: mol_type = genomic DNA
ttttaggcttgctcccggaaagagggcagc

SEQ ID NO: 8072 - DNA, 30 bp, Homo sapiens
  misc_feature 1..30: note = chr5:140346719-140346749
  misc_feature 1..30: note = hyper
  source 1..30: mol_type = genomic DNA
gctggcgcacaaccccgtggcggtgagcgc

SEQ ID NO: 8073 - DNA, 30 bp, Homo sapiens
  misc_feature 1..30: note = chr5:140514891-140514921
  misc_feature 1..30: note = hyper
  source 1..30: mol_type = genomic DNA
cttcagggtgggcttcgttcttgtggaaat

SEQ ID NO: 8074 - DNA, 30 bp, Homo sapiens
  misc_feature 1..30: note = chr5:140593316-140593346
  misc_feature 1..30: note = hyper
  source 1..30: mol_type = genomic DNA
ctgctcactaaagtccggcgatattaacgg

SEQ ID NO: 8075 - DNA, 42 bp, Homo sapiens; identical to SEQ ID NO: 2647
  misc_feature 1..42: note = chr5:140604459-140604501
  misc_feature 1..42: note = hyper
  source 1..42: mol_type = genomic DNA

SEQ ID NO: 8076 - DNA, 15 bp, Homo sapiens
  misc_feature 1..15: note = chr5:140614383-140614398
  misc_feature 1..15: note = hyper
  source 1..15: mol_type = genomic DNA
cgagcagctggaccg

SEQ ID NO: 8077 - DNA, 197 bp, Homo sapiens
  misc_feature 1..197: note = chr5:140777472-140777669
  misc_feature 1..197: note = hyper
  source 1..197: mol_type = genomic DNA
cgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggt

SEQ ID NO: 8078 - DNA, 134 bp, Homo sapiens; identical to SEQ ID NO: 2648
  misc_feature 1..134: note = chr5:140797076-140797210
  misc_feature 1..134: note = hyper
  source 1..134: mol_type = genomic DNA

SEQ ID NO: 8079 - DNA, 97 bp, Homo sapiens
  misc_feature 1..97: note = chr5:140797493-140797590
  misc_feature 1..97: note = hyper
  source 1..97: mol_type = genomic DNA
ctttgttctaccccacgctgtgtgagccgatccgctactcgattccggaggagctggccaagggctcggtggtggggaacctcgctaaggatctagg

SEQ ID NO: 8080 - DNA, 73 bp, Homo sapiens
  misc_feature 1..73: note = chr5:140800570-140800643
  misc_feature 1..73: note = hyper
  source 1..73: mol_type = genomic DNA
gggaatgggaagctgcgcgccattgagtccctccctcccccgcctctaccacacaaagcggaatgagatggat

SEQ ID NO: 8081 - DNA, 228 bp, Homo sapiens; identical to SEQ ID NO: 487
  misc_feature 1..228: note = chr5:140801034-140801262
  misc_feature 1..228: note = hyper
  source 1..228: mol_type = genomic DNA

SEQ ID NO: 8082 - DNA, 861 bp, Homo sapiens; identical to SEQ ID NO: 488
  misc_feature 1..861: note = chr5:140855598-140856459
  misc_feature 1..861: note = hyper
  source 1..861: mol_type = genomic DNA

SEQ ID NO: 8083 - DNA, 87 bp, Homo sapiens; identical to SEQ ID NO: 489
  misc_feature 1..87: note = chr5:140856546-140856633
  misc_feature 1..87: note = hyper
  source 1..87: mol_type = genomic DNA

SEQ ID NO: 8084 - DNA, 347 bp, Homo sapiens; identical to SEQ ID NO: 2652
  misc_feature 1..347: note = chr5:141262718-141263065
  misc_feature 1..347: note = hyper
  source 1..347: mol_type = genomic DNA

SEQ ID NO: 8085 - DNA, 36 bp, Homo sapiens
  misc_feature 1..36: note = chr5:141293999-141294035
  misc_feature 1..36: note = hyper
  source 1..36: mol_type = genomic DNA
gggcgattctggggccgtctccgcaggcagttgagc

SEQ ID NO: 8086 - DNA, 25 bp, Homo sapiens
  misc_feature 1..25: note = chr5:141931330-141931355
  misc_feature 1..25: note = hyper
  source 1..25: mol_type = genomic DNA
ctcacttctccttctcgcccttaat

SEQ ID NO: 8087 - DNA, 60 bp, Homo sapiens; identical to SEQ ID NO: 2654
  misc_feature 1..60: note = chr5:141931424-141931484
  misc_feature 1..60: note = hyper
  source 1..60: mol_type = genomic DNA

SEQ ID NO: 8088 - DNA, 101 bp, Homo sapiens
  misc_feature 1..101: note = chr5:142781774-142781875
  misc_feature 1..101: note = hyper
  source 1..101: mol_type = genomic DNA
aatgaatttccatgccgcttttttgacagctgccttcaaacccgaaaccaaaacaatatttcctaaaacgaaaacgctccctcaagcgacattatccccca

SEQ ID NO: 8089 - DNA, 136 bp, Homo sapiens
  misc_feature 1..136: note = chr5:143584941-143585077
  misc_feature 1..136: note = hyper
  source 1..136: mol_type = genomic DNA
tgaaacaacagcatccgaactgcactgggaactgtggaaccacccagctccgccgccagagaagccggagccccgggccccccgccggcatctctgcgctgcgttggcctctggctcgcaccggctcccacctggc

SEQ ID NO: 8090 - DNA, 71 bp, Homo sapiens; identical to SEQ ID NO: 2655
  misc_feature 1..71: note = chr5:145713641-145713712
  misc_feature 1..71: note = hyper
  source 1..71: mol_type = genomic DNA

SEQ ID NO: 8091 - DNA, 203 bp, Homo sapiens; identical to SEQ ID NO: 2656
  misc_feature 1..203: note = chr5:145716994-145717197
  misc_feature 1..203: note = hyper
  source 1..203: mol_type = genomic DNA

SEQ ID NO: 8092 - DNA, 156 bp, Homo sapiens; identical to SEQ ID NO: 2657
  misc_feature 1..156: note = chr5:145717248-145717404
  misc_feature 1..156: note = hyper
  source 1..156: mol_type = genomic DNA

SEQ ID NO: 8093 - DNA, 187 bp, Homo sapiens
  misc_feature 1..187: note = chr5:145717842-145718029
  misc_feature 1..187: note = hyper
  source 1..187: mol_type = genomic DNA
agaaagaaaggcaagcgtggggaggaagccaccccggactgagaaggcagttactgcccctacctctaccccggagcgcggttgagggaggtggggcaggggtcacctgggcctcgttctggcagcccctcaccctctccagggcccgtctgggcgcttggaggcgcctcctcgctgcgccgcggga

SEQ ID NO: 8094 - DNA, 93 bp, Homo sapiens
  misc_feature 1..93: note = chr5:145718853-145718946
  misc_feature 1..93: note = hyper
  source 1..93: mol_type = genomic DNA
atgtttttttcatgtcgcccagaacaatcgccgctgtctgaacccctctccttgtctcccccgcgttctctcccggcgcgctctctctctcat

SEQ ID NO: 8095 - DNA, 232 bp, Homo sapiens
  misc_feature 1..232: note = chr5:145719364-145719596
  misc_feature 1..232: note = hyper
  source 1..232: mol_type = genomic DNA
cacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggg

SEQ ID NO: 8096 - DNA, 42 bp, Homo sapiens; identical to SEQ ID NO: 2658
  misc_feature 1..42: note = chr5:145719895-145719937
  misc_feature 1..42: note = hyper
  source 1..42: mol_type = genomic DNA

SEQ ID NO: 8097 - DNA, 280 bp, Homo sapiens; identical to SEQ ID NO: 2659
  misc_feature 1..280: note = chr5:145720018-145720298
  misc_feature 1..280: note = hyper
  source 1..280: mol_type = genomic DNA

SEQ ID NO: 8098 - DNA, 92 bp, Homo sapiens; identical to SEQ ID NO: 490
  misc_feature 1..92: note = chr5:145722375-145722467
  misc_feature 1..92: note = hyper
  source 1..92: mol_type = genomic DNA

SEQ ID NO: 8099 - DNA, 467 bp, Homo sapiens; identical to SEQ ID NO: 491
  misc_feature 1..467: note = chr5:145722560-145723027
  misc_feature 1..467: note = hyper
  source 1..467: mol_type = genomic DNA

SEQ ID NO: 8100 - DNA, 161 bp, Homo sapiens
  misc_feature 1..161: note = chr5:145723309-145723470
  misc_feature 1..161: note = hyper
  source 1..161: mol_type = genomic DNA
cctgcatcgggcctccggagggtgggactttgagaactacctggctggaacaggggcttcatctagaatgagctaggcatacacattccagcatgactaaagccctggtaggcagaacttggtggcaggagtcctgggctcctgaacggtgttatctctgg

SEQ ID NO: 8101 - DNA, 144 bp, Homo sapiens
  misc_feature 1..144: note = chr5:145724420-145724564
  misc_feature 1..144: note = hyper
  source 1..144: mol_type = genomic DNA
tgagaagcttggccccggtcagcggctccaggagcccggaacctcctccctggcggaatcccgggcaccattcagccttttcgaaggctccagacttcgcgctgctcctcctcccgaggaggggcggggcgccagagggcaaag

SEQ ID NO: 8102 - DNA, 34 bp, Homo sapiens
  misc_feature 1..34: note = chr5:145724804-145724838
  misc_feature 1..34: note = hyper
  source 1..34: mol_type = genomic DNA
atcacgttatcacaccgcccgttttatttctttc

SEQ ID NO: 8103 - DNA, 151 bp, Homo sapiens; identical to SEQ ID NO: 492
  misc_feature 1..151: note = chr5:145725693-145725844
  misc_feature 1..151: note = hyper
  source 1..151: mol_type = genomic DNA

SEQ ID NO: 8104 - DNA, 24 bp, Homo sapiens
  misc_feature 1..24: note = chr5:146257460-146257484
  misc_feature 1..24: note = hyper
  source 1..24: mol_type = genomic DNA
gcccggaggagtctccgccactac

SEQ ID NO: 8105 - DNA, 300 bp, Homo sapiens
  misc_feature 1..300: note = chr5:146257485-146257785
  misc_feature 1..300: note = hyper
  source 1..300: mol_type = genomic DNA
cgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagag

SEQ ID NO: 8106 - DNA, 30 bp, Homo sapiens
  misc_feature 1..30: note = chr5:146258370-146258400
  misc_feature 1..30: note = hyper
  source 1..30: mol_type = genomic DNA
gcgtcagcagccccacgactctttcccagc

SEQ ID NO: 8107 - DNA, 309 bp, Homo sapiens
  misc_feature 1..309: note = chr5:146888874-146889183
  misc_feature 1..309: note = hyper
  source 1..309: mol_type = genomic DNA
tctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcc

SEQ ID NO: 8108 - DNA, 207 bp, Homo sapiens
  misc_feature 1..207: note = chr5:146889331-146889538
  misc_feature 1..207: note = hyper
  source 1..207: mol_type = genomic DNA
cgggacctggtccgtggtgcccggcctggccaggtacacgggcagatcgtcttcgtgggagctgtcccagcccctccggcccgaggccatggttcaagcacgaaagcggcccgcgggtttttcttccccagaggcggaaagggcagccgccggcagcgtgcgccgagccacagtgactgtggcgggaggaggcgcctgagccttcgc

SEQ ID NO: 8109 - DNA, 36 bp, Homo sapiens
  misc_feature 1..36: note = chr5:146889539-146889575
  misc_feature 1..36: note = hyper
  source 1..36: mol_type = genomic DNA
ccagaggcggcagtgctgctccgattcctgcttgtc

SEQ ID NO: 8110 - DNA, 160 bp, Homo sapiens
  misc_feature 1..160: note = chr5:148206272-148206432
  misc_feature 1..160: note = hyper
  source 1..160: mol_type = genomic DNA
cacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggc

SEQ ID NO: 8111 - DNA, 299 bp, Homo sapiens
  misc_feature 1..299: note = chr5:148651823-148652122
  misc_feature 1..299: note = hyper
  source 1..299: mol_type = genomic DNA
tccccctctagtttccggaggacagcgagctcctcccacctcattccactctaaaggggaaaacaaggtgtacaggttcaactcccgaaacacccgctgtgggcagcccctagggagaagctctaggggaccgaagtttgcagctgcctagggcattgcgagaaggaggagcgccgtgagcaggcgcgcgtgtgcatgcatgtgtgcgccagggagggaggaggcgggggtggttctatcccgcaccagctgtgtcctcggcccagcccttctctctggaccagcgacaaagttggact

SEQ ID NO: 8112 - DNA, 71 bp, Homo sapiens
  misc_feature 1..71: note = chr5:149569700-149569771
  misc_feature 1..71: note = hyper
  source 1..71: mol_type = genomic DNA
acaaggcattcgcagcgccctgcccgcgctccacgcccgcagccgccagacggcagcgcctgcgtccgtgc

SEQ ID NO: 8113 - DNA, 30 bp, Homo sapiens
  misc_feature 1..30: note = chr5:149682061-149682091
  misc_feature 1..30: note = hyper
  source 1..30: mol_type = genomic DNA
gtccagtgtctggtccgggactggctgccg

SEQ ID NO: 8114 - DNA, 566 bp, Homo sapiens; identical to SEQ ID NO: 2663
  misc_feature 1..566: note = chr5:150051101-150051667
  misc_feature 1..566: note = hyper
  source 1..566: mol_type = genomic DNA

SEQ ID NO: 8115 - DNA, 424 bp, Homo sapiens
  misc_feature 1..424: note = chr5:150399985-150400409
  misc_feature 1..424: note = hyper
  source 1..424: mol_type = genomic DNA
tgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaat

SEQ ID NO: 8116 - DNA, 30 bp, Homo sapiens
  misc_feature 1..30: note = chr5:151066451-151066481
  misc_feature 1..30: note = hyper
  source 1..30: mol_type = genomic DNA
gcagagcgcgctctccgggcagtctgaagg

SEQ ID NO: 8117 - DNA, 415 bp, Homo sapiens
  misc_feature 1..415: note = chr5:151304224-151304639
  misc_feature 1..415: note = hyper
  source 1..415: mol_type = genomic DNA
ggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttga

SEQ ID NO: 8118 - DNA, 33 bp, Homo sapiens
  misc_feature 1..33: note = chr5:151304708-151304741
  misc_feature 1..33: note = hyper
  source 1..33: mol_type = genomic DNA
cgttctcctgcctctgtgcgggtctgctgtcgc

SEQ ID NO: 8119 - DNA, 97 bp, Homo sapiens; identical to SEQ ID NO: 2664
  misc_feature 1..97: note = chr5:152870193-152870290
  misc_feature 1..97: note = hyper
  source 1..97: mol_type = genomic DNA

SEQ ID NO: 8120 - DNA, 59 bp, Homo sapiens; identical to SEQ ID NO: 2665
  misc_feature 1..59: note = chr5:153852733-153852792
  misc_feature 1..59: note = hyper
  source 1..59: mol_type = genomic DNA

SEQ ID NO: 8121 - DNA, 27 bp, Homo sapiens
  misc_feature 1..27: note = chr5:153853277-153853304
  misc_feature 1..27: note = hyper
  source 1..27: mol_type = genomic DNA
gcccgcgtggcctctcggcccctgcta

SEQ ID NO: 8122 - DNA, 133 bp, Homo sapiens; identical to SEQ ID NO: 2667
  misc_feature 1..133: note = chr5:153853386-153853519
  misc_feature 1..133: note = hyper
  source 1..133: mol_type = genomic DNA

SEQ ID NO: 8123 - DNA, 32 bp, Homo sapiens; identical to SEQ ID NO: 2668
  misc_feature 1..32: note = chr5:153855232-153855264
  misc_feature 1..32: note = hyper
  source 1..32: mol_type = genomic DNA

SEQ ID NO: 8124 - DNA, 176 bp, Homo sapiens
  misc_feature 1..176: note = chr5:153855657-153855833
  misc_feature 1..176: note = hyper
  source 1..176: mol_type = genomic DNA
cgcggagttcctgggacccgggatgggctgggcagcttcgggaggtttggtaaggaaaatgttctgcgtctggtgaaactgacgcgcgttgatttggctttaggacacctaagggagatcccaggatattggaagggaggggtggaaatccacggttctcccgctctcgctgcacc

SEQ ID NO: 8125 - DNA, 62 bp, Homo sapiens
  misc_feature 1..62: note = chr5:153856334-153856396
  misc_feature 1..62: note = hyper
  source 1..62: mol_type = genomic DNA
aagtgtcaccctaaccggagaggatcaagaaggccaagacgagactgcgctctccaaagcta

SEQ ID NO: 8126 - DNA, 36 bp, Homo sapiens
  misc_feature 1..36: note = chr5:153856624-153856660
  misc_feature 1..36: note = hyper
  source 1..36: mol_type = genomic DNA
tttgaaaacaggaaccgagcccgggcacataaattc

SEQ ID NO: 8127 - DNA, 139 bp, Homo sapiens
  misc_feature 1..139: note = chr5:153856966-153857105
  misc_feature 1..139: note = hyper
  source 1..139: mol_type = genomic DNA
cctgaggctgctcaccgctcctgcacccttggctggagcatgcaagccccaggactcaccagctcccttttccgcttgctctcacggccgccatccgccttcttgagttcagccttgaaggcctcgggatcgccagact

SEQ ID NO: 8128 - DNA, 30 bp, Homo sapiens
  misc_feature 1..30: note = chr5:153857851-153857881
  misc_feature 1..30: note = hyper
  source 1..30: mol_type = genomic DNA
ccaatggcaggggggcggggataaggaaaa

SEQ ID NO: 8129 - DNA, 172 bp, Homo sapiens
  misc_feature 1..172: note = chr5:153858353-153858525
  misc_feature 1..172: note = hyper
  source 1..172: mol_type = genomic DNA
caccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtag

SEQ ID NO: 8130 - DNA, 17 bp, Homo sapiens
  misc_feature 1..17: note = chr5:153858878-153858895
  misc_feature 1..17: note = hyper
  source 1..17: mol_type = genomic DNA
agactgcacagcatccg

SEQ ID NO: 8131 - DNA, 18 bp, Homo sapiens
  misc_feature 1..18: note = chr5:153858916-153858934
  misc_feature 1..18: note = hyper
  source 1..18: mol_type = genomic DNA
cgacgtccggcatctctc

SEQ ID NO: 8132 - DNA, 143 bp, Homo sapiens
  misc_feature 1..143: note = chr5:153862037-153862180
  misc_feature 1..143: note = hyper
  source 1..143: mol_type = genomic DNA
taggacagctgtacccgggcaatgcgaaggtccctcaagcctggacgttctgcagtggtggggtctcgctcttgccctagcccctctcctaccctcacccctatccgcgccccccggactggcaggcctctggaagcccaggc

SEQ ID NO: 8133 - DNA, 246 bp, Homo sapiens
  misc_feature 1..246: note = chr5:153862218-153862464
  misc_feature 1..246: note = hyper
  source 1..246: mol_type = genomic DNA
cgtgaccttgacgccacgggcaatccccgcaccggaccccttatctaaatagggcagtaaatcaaggacctgtcagggcccgggtaattacaggaactccataaaaaggacccggccggccgcctgtttatattagcgcggtgtaaaatattctcgctgtcttggggaatcgcgtcgcgcagtaacgcgccataaatcagcccgcggaccatttaccccgcagcttgagcgcgcaaatcccttaaa

SEQ ID NO: 8134 - DNA, 23 bp, Homo sapiens
  misc_feature 1..23: note = chr5:153863394-153863417
  misc_feature 1..23: note = hyper
  source 1..23: mol_type = genomic DNA
gagagatgtctgcttcgggacgc

SEQ ID NO: 8135 - DNA, 13 bp, Homo sapiens
  misc_feature 1..13: note = chr5:153863418-153863431
  misc_feature 1..13: note = hyper
  source 1..13: mol_type = genomic DNA
ttcaacctaaaca

SEQ ID NO: 8136 - DNA, 53 bp, Homo sapiens
  misc_feature 1..53: note = chr5:153990970-153991023
  misc_feature 1..53: note = hyper
  source 1..53: mol_type = genomic DNA
gacgggccacacacccgcgtgtacacacagtccgagaacgcacacacgtacac

SEQ ID NO: 8137 - DNA, 460 bp, Homo sapiens
  misc_feature 1..460: note = chr5:155107388-155107848
  misc_feature 1..460: note = hyper
  source 1..460: mol_type = genomic DNA
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcacaccgggactccggcacgtgggcgcgcgggaggtggcggccgctgctgccgctgc

SEQ ID NO: 8138 - DNA, 20 bp, Homo sapiens
  misc_feature 1..20: note = chr5:155108248-155108268
  misc_feature 1..20: note = hyper
  source 1..20: mol_type = genomic DNA
cccggacgctcgagccggag

SEQ ID NO: 8139 - DNA, 116 bp, Homo sapiens
  misc_feature 1..116: note = chr5:155108733-155108849
  misc_feature 1..116: note = hyper
  source 1..116: mol_type = genomic DNA
gagggagtccccttccgcttcctaaggagaaaaggggctccctagagcagatcgctgacttcctcaccaacgtgccatttggggcttttcagccgcccgcgcgttaagctagctcc

SEQ ID NO: 8140 - DNA, 240 bp, Homo sapiens
  misc_feature 1..240: note = chr5:155109207-155109447
  misc_feature 1..240: note = hyper
  source 1..240: mol_type = genomic DNA
cgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtc

SEQ ID NO: 8141 - DNA, 259 bp, Homo sapiens
  misc_feature 1..259: note = chr5:156887194-156887453
  misc_feature 1..259: note = hyper
  source 1..259: mol_type = genomic DNA
ccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggtgcgtacggcagggctggggaccaggcgggctccgcgcttcgcgccctcccctccttgccaccgctctccctcgcatcctctcctcc

SEQ ID NO: 8142 - DNA, 45 bp, Homo sapiens
  misc_feature 1..45: note = chr5:157001813-157001858
  misc_feature 1..45: note = hyper
  source 1..45: mol_type = genomic DNA
cttagctggaaacatcgagtcagaccccttcgcttcacagaaggg

SEQ ID NO: 8143 - DNA, 315 bp, Homo sapiens
  misc_feature 1..315: note = chr5:157098344-157098659
  misc_feature 1..315: note = hyper
  source 1..315: mol_type = genomic DNA
cacttcttccagacccgtccgtcttcacagcaacgcgccgggtctcaccacggcggatgccgagggacaatattaccgcgtccgtggccgccggactctgcacgcatgtccaacagcccccgtccccttccccgcagccaatatgtgtctcccaggcaacgcgccgcgctcggttcagggctccgcccagggactcactccgcgtcagcgcgcgcccacctaggtgggctggcaaccagccaccagtttccaactctttctccaacagggaagccgcaatgacacagccgactaggccctcggtcacctgtgacc

SEQ ID NO: 8144 - skipped

SEQ ID NO: 8145 - DNA, 276 bp, Homo sapiens
  misc_feature 1..276: note = chr5:158478512-158478788
  misc_feature 1..276: note = hyper
  source 1..276: mol_type = genomic DNA
cgctggcgacaaactggagccggggcctttccgcttaggaggaactcgctacgtgtcgctaacaacaacacaaacaccgccggcccggctcggtgctccgctgcccacagtgcgctcggcaccagggctggatttatagcaaggagccccgactgtaagaagtaattcatgagtccccacaatgccactactgagaggcattcagaagggggggcaagacacggggtgttcctgctccgtggcctccatcccagccgatcccgctttgcagttgtg

SEQ ID NO: 8146 - DNA, 30 bp, Homo sapiens
  misc_feature 1..30: note = chr5:158524686-158524716
  misc_feature 1..30: note = hyper
  source 1..30: mol_type = genomic DNA
atgtggagaagggtccgagggcggggctca

SEQ ID NO: 8147 - DNA, 375 bp, Homo sapiens; identical to SEQ ID NO: 493
  misc_feature 1..375: note = chr5:158527442-158527817
  misc_feature 1..375: note = hyper
  source 1..375: mol_type = genomic DNA

SEQ ID NO: 8148 - DNA, 251 bp, Homo sapiens; identical to SEQ ID NO: 494
  misc_feature 1..251: note = chr5:158527818-158528069
  misc_feature 1..251: note = hyper
  source 1..251: mol_type = genomic DNA

SEQ ID NO: 8149 - DNA, 88 bp, Homo sapiens
  misc_feature 1..88: note = chr5:158533565-158533653
  misc_feature 1..88: note = hyper
  source 1..88: mol_type = genomic DNA
gggcccaagggcaggcgtgcagaccgctacgactttggctttagggagacgccttcggggcgcagggcccgcccgaagacgcgggtta

SEQ ID NO: 8150 - DNA, 28 bp, Homo sapiens
  misc_feature 1..28: note = chr5:159399072-159399100
  misc_feature 1..28: note = hyper
  source 1..28: mol_type = genomic DNA
tcgcctgggcggctgcgcctacacctac

SEQ ID NO: 8151 - DNA, 262 bp, Homo sapiens
  misc_feature 1..262: note = chr5:160973528-160973790
  misc_feature 1..262: note = hyper
  source 1..262: mol_type = genomic DNA
ccttcaaagtgagaacggaaaagagaaacgctgggcacacttacctctgcgcacagacagcggcgattattaaggggaaggaccaaatcccaaagtagccccttttccgcactctccacatccctttagtttttgatggaattgagggtttcactgaagagaggagatccaacttagtctgcccagtgcagtaattctaatgtgaggcgcatgcgcacggcgtaccaaaacatcaaaggggaagcggcggctgccggggacc

SEQ ID NO: 8152 - DNA, 40 bp, Homo sapiens
  misc_feature 1..40: note = chr5:160974819-160974859
  misc_feature 1..40: note = hyper
  source 1..40: mol_type = genomic DNA
gcgccccctccgctgcgcgcacccgcgcgcacacacgtgc

SEQ ID NO: 8153 - DNA, 235 bp, Homo sapiens
  misc_feature 1..235: note = chr5:160975112-160975347
  misc_feature 1..235: note = hyper
  source 1..235: mol_type = genomic DNA
ttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggcc

SEQ ID NO: 8154 - DNA, 100 bp, Homo sapiens
  misc_feature 1..100: note = chr5:160975348-160975448
  misc_feature 1..100: note = hyper
  source 1..100: mol_type = genomic DNA
tccgaaggaaccggagtccacaccagcggctctccgggtactcctgagtttatcttggaactggggaagaggcgggaagagtagacgttcccgctacccc

SEQ ID NO: 8155 - DNA, 210 bp, Homo sapiens; identical to SEQ ID NO: 2672
  misc_feature 1..210: note = chr5:160975724-160975934
  misc_feature 1..210: note = hyper
  source 1..210: mol_type = genomic DNA

SEQ ID NO: 8156 - DNA, 15 bp, Homo sapiens
  misc_feature 1..15: note = chr5:160975955-160975970
  misc_feature 1..15: note = hyper
  source 1..15: mol_type = genomic DNA
cggaagtagctccac

SEQ ID NO: 8157 - DNA, 30 bp, Homo sapiens
  misc_feature 1..30: note = chr5:161274605-161274635
  misc_feature 1..30: note = hyper
  source 1..30: mol_type = genomic DNA
ctctttcctaccatccgtcaccattcgtga

SEQ ID NO: 8158 - DNA, 30 bp, Homo sapiens
  misc_feature 1..30: note = chr5:162931253-162931283
  misc_feature 1..30: note = hyper
  source 1..30: mol_type = genomic DNA
attatgcttgtttagcgctggggcagtcct

SEQ ID NO: 8159 - DNA, 79 bp, Homo sapiens
  misc_feature 1..79: note = chr5:162931522-162931601
  misc_feature 1..79: note = hyper
  source 1..79: mol_type = genomic DNA
aaaaggtttaggagtcggggaaaggccctaggaaaatccagacagtggtcacgtttgtggacgacgtttagagcttgct

SEQ ID NO: 8160 - DNA, 37 bp, Homo sapiens
  misc_feature 1..37: note = chr5:166405784-166405821
  misc_feature 1..37: note = hyper
  source 1..37: mol_type = genomic DNA
gcccctccctggctgcgtaccccgcagccacagcagc

SEQ ID NO: 8161 - DNA, 30 bp, Homo sapiens
  misc_feature 1..30: note = chr5:166406285-166406315
  misc_feature 1..30: note = hyper
  source 1..30: mol_type = genomic DNA
tgcagaagcgagcaccgtttggggagtccg

SEQ ID NO: 8162 - DNA, 177 bp, Homo sapiens; identical to SEQ ID NO: 2674
  misc_feature 1..177: note = chr5:167956090-167956267
  misc_feature 1..177: note = hyper
  source 1..177: mol_type = genomic DNA

SEQ ID NO: 8163 - DNA, 31 bp, Homo sapiens; identical to SEQ ID NO: 2675
  misc_feature 1..31: note = chr5:167956413-167956444
  misc_feature 1..31: note = hyper
  source 1..31: mol_type = genomic DNA

SEQ ID NO: 8164 - DNA, 42 bp, Homo sapiens
  misc_feature 1..42: note = chr5:168727504-168727546
  misc_feature 1..42: note = hyper
  source 1..42: mol_type = genomic DNA
aggggtactcacaggcgctcagcgttgcgggggatgccccga

SEQ ID NO: 8165 - skipped

SEQ ID NO: 8166 - DNA, 82 bp, Homo sapiens
  misc_feature 1..82: note = chr5:168727994-168728076
  misc_feature 1..82: note = hyper
  source 1..82: mol_type = genomic DNA
cgcgggccgggttggggacctggggcgagcgcaatggggcgtggcgcccggggaggtccggcttggggctgggctggggagc

SEQ ID NO: 8167 - DNA, 35 bp, Homo sapiens
  misc_feature 1..35: note = chr5:168728077-168728112
  misc_feature 1..35: note = hyper
  source 1..35: mol_type = genomic DNA
cggcggctgcggctggggcacggggcggccgggtg

SEQ ID NO: 8168 - DNA, 30 bp, Homo sapiens
  misc_feature 1..30: note = chr5:168728323-168728353
  misc_feature 1..30: note = hyper
  source 1..30: mol_type = genomic DNA
ggaaggaaaggggctcggccagcagggccc

SEQ ID NO: 8169 - DNA, 63 bp, Homo sapiens
  misc_feature 1..63: note = chr5:169064022-169064085
  misc_feature 1..63: note = hyper
  source 1..63: mol_type = genomic DNA
gcggtggtggtctggcgagccccaggtggggactggcctctgctccctcgcctggggaggaga

SEQ ID NO: 8170 - DNA, 235 bp, Homo sapiens; identical to SEQ ID NO: 2676
  misc_feature 1..235: note = chr5:169064295-169064530
  misc_feature 1..235: note = hyper
  source 1..235: mol_type = genomic DNA

SEQ ID NO: 8171 - DNA, 274 bp, Homo sapiens; identical to SEQ ID NO: 2677
  misc_feature 1..274: note = chr5:169064531-169064805
  misc_feature 1..274: note = hyper
  source 1..274: mol_type = genomic DNA

SEQ ID NO: 8172 - DNA, 38 bp, Homo sapiens
  misc_feature 1..38: note = chr5:169931409-169931447
  misc_feature 1..38: note = hyper
  source 1..38: mol_type = genomic DNA
gaagcctcctagcctcgcctccacgcttgctgaatacc

SEQ ID NO: 8173 - DNA, 378 bp, Homo sapiens; identical to SEQ ID NO: 2678
  misc_feature 1..378: note = chr5:170108034-170108412
  misc_feature 1..378: note = hyper
  source 1..378: mol_type = genomic DNA

SEQ ID NO: 8174 - DNA, 100 bp, Homo sapiens; identical to SEQ ID NO: 495
  misc_feature 1..100: note = chr5:170735131-170735231
  misc_feature 1..100: note = hyper
  source 1..100: mol_type = genomic DNA

SEQ ID NO: 8175 - skipped

SEQ ID NO: 8176 - DNA, 116 bp, Homo sapiens; identical to SEQ ID NO: 496
  misc_feature 1..116: note = chr5:170736715-170736831
  misc_feature 1..116: note = hyper
  source 1..116: mol_type = genomic DNA

SEQ ID NO: 8177 - DNA, 454 bp, Homo sapiens; identical to SEQ ID NO: 497
  misc_feature 1..454: note = chr5:170737281-170737735
  misc_feature 1..454: note = hyper
  source 1..454: mol_type = genomic DNA

SEQ ID NO: 8178 - DNA, 69 bp, Homo sapiens; identical to SEQ ID NO: 498
  misc_feature 1..69: note = chr5:170737795-170737864
  misc_feature 1..69: note = hyper
  source 1..69: mol_type = genomic DNA

SEQ ID NO: 8179 - DNA, 755 bp, Homo sapiens; identical to SEQ ID NO: 499
  misc_feature 1..755: note = chr5:170737935-170738690
  misc_feature 1..755: note = hyper
  source 1..755: mol_type = genomic DNA

SEQ ID NO: 8180 - DNA, 1116 bp, Homo sapiens; identical to SEQ ID NO: 500
  misc_feature 1..1116: note = chr5:170738823-170739939
  misc_feature 1..1116: note = hyper
  source 1..1116: mol_type = genomic DNA

SEQ ID NO: 8181 - DNA, 23 bp, Homo sapiens
  misc_feature 1..23: note = chr5:170740455-170740478
  misc_feature 1..23: note = hyper
  source 1..23: mol_type = genomic DNA
aaggcaaaacactttcggggccg

SEQ ID NO: 8182 - DNA, 99 bp, Homo sapiens; identical to SEQ ID NO: 2686
  misc_feature 1..99: note = chr5:170740574-170740673
  misc_feature 1..99: note = hyper
  source 1..99: mol_type = genomic DNA

SEQ ID NO: 8183 - DNA, 125 bp, Homo sapiens; identical to SEQ ID NO: 2687
  misc_feature 1..125: note = chr5:170740674-170740799
  misc_feature 1..125: note = hyper
  source 1..125: mol_type = genomic DNA

SEQ ID NO: 8184 - DNA, 741 bp, Homo sapiens; identical to SEQ ID NO: 2688
  misc_feature 1..741: note = chr5:170741487-170742228
  misc_feature 1..741: note = hyper
  source 1..741: mol_type = genomic DNA

SEQ ID NO: 8185 - DNA, 152 bp, Homo sapiens; identical to SEQ ID NO: 501
  misc_feature 1..152: note = chr5:170742448-170742600
  misc_feature 1..152: note = hyper
  source 1..152: mol_type = genomic DNA

SEQ ID NO: 8186 - DNA, 166 bp, Homo sapiens; identical to SEQ ID NO: 502
  misc_feature 1..166: note = chr5:170742672-170742838
  misc_feature 1..166: note = hyper
  source 1..166: mol_type = genomic DNA

SEQ ID NO: 8187 - DNA, 342 bp, Homo sapiens; identical to SEQ ID NO: 503
  misc_feature 1..342: note = chr5:170743138-170743480
  misc_feature 1..342: note = hyper
  source 1..342: mol_type = genomic DNA

SEQ ID NO: 8188 - DNA, 482 bp, Homo sapiens; identical to SEQ ID NO: 504
  misc_feature 1..482: note = chr5:170743646-170744128
  misc_feature 1..482: note = hyper
  source 1..482: mol_type = genomic DNA

SEQ ID NO: 8189 - DNA, 66 bp, Homo sapiens
  misc_feature 1..66: note = chr5:170744496-170744562
  misc_feature 1..66: note = hyper
  source 1..66: mol_type = genomic DNA
agttgaaacgaatgtcgttgctctgtcagacccgctgccaattaatgagttcgttattcaacccct

SEQ ID NO: 8190 - DNA, 30 bp, Homo sapiens
  misc_feature 1..30: note = chr5:170745324-170745354
  misc_feature 1..30: note = hyper
  source 1..30: mol_type = genomic DNA
tgattatccagcatgcgaagctgccttgca

SEQ ID NO: 8191 - DNA, 253 bp, Homo sapiens
  misc_feature 1..253: note = chr5:172655851-172656104
  misc_feature 1..253: note = hyper
  source 1..253: mol_type = genomic DNA
cgctgggcctgagctcggaatgcttcccggaggatgcgaggggcgggcgctgcggggaagacggtgctactcccgcgcgggaccgcgtgatgtttccgagtcagcggtgaaacctgcggcttccgcgcgtcctttaaaaatacaggtatttagatacacaccgtggcgtcgacttaaggtgaaatctaaacaaaatgaaaggacgggagctattctgatttggccgaacctgtgcctgcgggctgggaatgac

SEQ ID NO: 8192 - DNA, 63 bp, Homo sapiens
  misc_feature 1..63: note = chr5:172659592-172659655
  misc_feature 1..63: note = hyper
  source 1..63: mol_type = genomic DNA
cagcgtggacactcccgagttgctctgcggaatcccggggctctgaaccgcattcaagtcccc

SEQ ID NO: 8193 - DNA, 171 bp, Homo sapiens; identical to SEQ ID NO: 505
  misc_feature 1..171: note = chr5:172659855-172660026
  misc_feature 1..171: note = hyper
  source 1..171: mol_type = genomic DNA

SEQ ID NO: 8194 - DNA, 77 bp, Homo sapiens; identical to SEQ ID NO: 506
  misc_feature 1..77: note = chr5:172660141-172660218
  misc_feature 1..77: note = hyper
  source 1..77: mol_type = genomic DNA

SEQ ID NO: 8195 - DNA, 82 bp, Homo sapiens; identical to SEQ ID NO: 2695
  misc_feature 1..82: note = chr5:172660919-172661001
  misc_feature 1..82: note = hyper
  source 1..82: mol_type = genomic DNA

SEQ ID NO: 8196 - DNA, 20 bp, Homo sapiens
  misc_feature 1..20: note = chr5:172661126-172661146
  misc_feature 1..20: note = hyper
  source 1..20: mol_type = genomic DNA
cgcgccggcaagttgtgctg

SEQ ID NO: 8197 - DNA, 359 bp, Homo sapiens; identical to SEQ ID NO: 2697
  misc_feature 1..359: note = chr5:172661471-172661830
  misc_feature 1..359: note = hyper
  source 1..359: mol_type = genomic DNA

SEQ ID NO: 8198 - DNA, 157 bp, Homo sapiens
  misc_feature 1..157: note = chr5:172662041-172662198
  misc_feature 1..157: note = hyper
  source 1..157: mol_type = genomic DNA
tttgactgagaagggcgtgggcgtgagagcagggctggggaacatggtggcagcgccagtctcacagcgccaggtgggcggcagaaagcggcgctgcccacggcccctggcagcttccctgcatggtgccgccgcccgcccgcgcacccgtcggcca

SEQ ID NO: 8199 - DNA, 131 bp, Homo sapiens
  misc_feature 1..131: note = chr5:172664437-172664568
  misc_feature 1..131: note = hyper
  source 1..131: mol_type = genomic DNA
tcgctgaaaagagctcggaacgagggtcctgggagcgctgttaagtgaatctgctggccaggcggctcgcgatgacagtttgaaagattagtgtgagcggacgcctgaaatattaccgtttaatgggggac

SEQ ID NO: 8200 - DNA, 170 bp, Homo sapiens
  misc_feature 1..170: note = chr5:172665691-172665861
  misc_feature 1..170: note = hyper
  source 1..170: mol_type = genomic DNA
cgctgcaataattggcgagaaagcaaacagagggccgagagcgcgactctgctcttcgtccggctgatggatgagcagctccggctgcgcgccggactcccggcctcggcctccgcctccgcctccgcctccgcctccgcgctgggcccctccgccgcccggcttccttc

SEQ ID NO: 8201 - DNA, 149 bp, Homo sapiens; identical to SEQ ID NO: 2698
  misc_feature 1..149: note = chr5:172670933-172671082
  misc_feature 1..149: note = hyper
  source 1..149: mol_type = genomic DNA

SEQ ID NO: 8202 - DNA, 87 bp, Homo sapiens; identical to SEQ ID NO: 507
  misc_feature 1..87: note = chr5:172671395-172671482
  misc_feature 1..87: note = hyper
  source 1..87: mol_type = genomic DNA

SEQ ID NO: 8203 - DNA, 153 bp, Homo sapiens; identical to SEQ ID NO: 508
  misc_feature 1..153: note = chr5:172671639-172671792
  misc_feature 1..153: note = hyper
  source 1..153: mol_type = genomic DNA

SEQ ID NO: 8204 - DNA, 92 bp, Homo sapiens
  misc_feature 1..92: note = chr5:172672801-172672893
  misc_feature 1..92: note = hyper
  source 1..92: mol_type = genomic DNA
agactggggcccttccgctcggggtcaggcgcagcgccctcggcttgggccccgccgcccctttaggggtccgggagggtggagagaagggg

SEQ ID NO: 8205 - DNA, 363 bp, Homo sapiens
  misc_feature 1..363: note = chr5:172754563-172754926
  misc_feature 1..363: note = hyper
  source 1..363: mol_type = genomic DNA
aaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcc

SEQ ID NO: 8206 - DNA, 93 bp, Homo sapiens
  misc_feature 1..93: note = chr5:172755470-172755563
  misc_feature 1..93: note = hyper
  source 1..93: mol_type = genomic DNA
cttgaatgaaggagtcgagcaggtgttgtcccggcggctggaccaatccgagaccccggcccttttgacaacacggccgggaggcggggcctg

SEQ ID NO: 8207 - DNA, 69 bp, Homo sapiens
  misc_feature 1..69: note = chr5:172755594-172755663
  misc_feature 1..69: note = hyper
  source 1..69: mol_type = genomic DNA
cgctgggagcgccggacaaagttgccgacctggcggcggccacgcgtttgcgtgcgtgtgtatgagtgt

SEQ ID NO: 8208 - DNA, 719 bp, Homo sapiens
  misc_feature 1..719: note = chr5:172756377-172757096
  misc_feature 1..719: note = hyper
  source 1..719: mol_type = genomic DNA
caaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccaggatggccacggctggccgcagctatccggcgtgtcgagctctcctgagt

SEQ ID NO: 8209 - DNA, 156 bp, Homo sapiens; identical to SEQ ID NO: 2701
  misc_feature 1..156: note = chr5:174115433-174115589
  misc_feature 1..156: note = hyper
  source 1..156: mol_type = genomic DNA

SEQ ID NO: 8210 - DNA, 55 bp, Homo sapiens
  misc_feature 1..55: note = chr5:174119987-174120042
  misc_feature 1..55: note = hyper
  source 1..55: mol_type = genomic DNA
taattttgaaagggtcgctgtaagacactgactaatgacacgtgacctttggatt

SEQ ID NO: 8211 - DNA, 154 bp, Homo sapiens
  misc_feature 1..154: note = chr5:174147428-174147582
  misc_feature 1..154: note = hyper
  source 1..154: mol_type = genomic DNA
ctctctgcgcctggacgacttcatctgtggaatggggagaaagctcaggctttagggggccttcagtaatctgcatcgtgcttttggcaaaagctccttctctccagccccggctcaaacccgggctcggtcctgactccggaccttagggggc

SEQ ID NO: 8212 - DNA, 279 bp, Homo sapiens; identical to SEQ ID NO: 2702
  misc_feature 1..279: note = chr5:174159299-174159578
  misc_feature 1..279: note = hyper
  source 1..279: mol_type = genomic DNA

SEQ ID NO: 8213 - DNA, 37 bp, Homo sapiens
  misc_feature 1..37: note = chr5:174162509-174162546
  misc_feature 1..37: note = hyper
  source 1..37: mol_type = genomic DNA
cgcaggaagggggcgcgtcacccggtttccccataga

SEQ ID NO: 8214 - DNA, 30 bp, Homo sapiens
  misc_feature 1..30: note = chr5:174162799-174162829
  misc_feature 1..30: note = hyper
  source 1..30: mol_type = genomic DNA
cccggcccgctccaccggcacggaagatcg

SEQ ID NO: 8215 - DNA, 120 bp, Homo sapiens
  misc_feature 1..120: note = chr5:174178667-174178787
  misc_feature 1..120: note = hyper
  source 1..120: mol_type = genomic DNA
agggagaagaggggccgcggccgcgcgccccgccatcagctgcgcgcacagagggagagttcactccggggacaagggcggcgcgaccggcccggggctcttgggcggccgcgtttcccc

SEQ ID NO: 8216 - DNA, 1140 bp, Homo sapiens; identical to SEQ ID NO: 2703
  misc_feature 1..1140: note = chr5:174870738-174871878
  misc_feature 1..1140: note = hyper
  source 1..1140: mol_type = genomic DNA

SEQ ID NO: 8217 - DNA, 241 bp, Homo sapiens; identical to SEQ ID NO: 2704
  misc_feature 1..241: note = chr5:175085074-175085315
  misc_feature 1..241: note = hyper
  source 1..241: mol_type = genomic DNA

SEQ ID NO: 8218 - DNA, 79 bp, Homo sapiens; identical to SEQ ID NO: 2705
  misc_feature 1..79: note = chr5:175085524-175085603
  misc_feature 1..79: note = hyper
  source 1..79: mol_type = genomic DNA

SEQ ID NO: 8219 - DNA, 30 bp, Homo sapiens; identical to SEQ ID NO: 2706
  misc_feature 1..30: note = chr5:175223920-175223950
  misc_feature 1..30: note = hyper
  source 1..30: mol_type = genomic DNA

SEQ ID NO: 8220 - DNA, 92 bp, Homo sapiens
  misc_feature 1..92: note = chr5:175224643-175224735
  misc_feature 1..92: note = hyper
  source 1..92: mol_type = genomic DNA
agggggctgagaagccgcggggaagcctcacgaacgggacagctccaggctccctctctccctcactccccgggttccgcccccacctccag

SEQ ID NO: 8221 - DNA, 35 bp, Homo sapiens
  misc_feature 1..35: note = chr5:175298647-175298682
  misc_feature 1..35: note = hyper
  source 1..35: mol_type = genomic DNA
accacctcgtggagtcgggccggagccctgcagtg

SEQ ID NO: 8222 - DNA, 40 bp, Homo sapiens
  misc_feature 1..40: note = chr5:175298910-175298950
  misc_feature 1..40: note = hyper
  source 1..40: mol_type = genomic DNA
aaggacagctccttgcgaggggccgcgagcaggcagctag

SEQ ID NO: 8223 - DNA, 44 bp, Homo sapiens
  misc_feature 1..44: note = chr5:175299304-175299348
  misc_feature 1..44: note = hyper
  source 1..44: mol_type = genomic DNA
ctttccgggaggagccgccgcttggacagcgcacgcccgccgcc

SEQ ID NO: 8224 - DNA, 161 bp, Homo sapiens
  misc_feature 1..161: note = chr5:175299980-175300141
  misc_feature 1..161: note = hyper
  source 1..161: mol_type = genomic DNA
gaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgc

SEQ ID NO: 8225 - DNA, 29 bp, Homo sapiens
  misc_feature 1..29: note = chr5:175300142-175300171
  misc_feature 1..29: note = hyper
  source 1..29: mol_type = genomic DNA
cagggatagaccaaggcttcccgcagaat

SEQ ID NO: 8226 - DNA, 196 bp, Homo sapiens
  misc_feature 1..196: note = chr5:175300216-175300412
  misc_feature 1..196: note = hyper
  source 1..196: mol_type = genomic DNA
cggcaacctgctggacctcagcactcccgcaggcatatggcaaaacatacacacacacacaccctgcacacacgcacgcactcacacgatgtctaagtccagagttgcacacacggggtcatactttcaacgcacacaccctcatgcactcgttgacacgttaaattcaacccggcacacacgtcctcaggatcta

SEQ ID NO: 8227 - DNA, 42 bp, Homo sapiens
  misc_feature 1..42: note = chr5:175488184-175488226
  misc_feature 1..42: note = hyper
  source 1..42: mol_type = genomic DNA
agccaggagaacccgcgagcccagcggcgcctgcacctgcgg

SEQ ID NO: 8228 - DNA, 180 bp, Homo sapiens
  misc_feature 1..180: note = chr5:175560567-175560747
  misc_feature 1..180: note = hyper
  source 1..180: mol_type = genomic DNA
cgccagcttgcaagtcgtgcatttacctcttttggctgcacagagggcagggaagcctcgcgggtatgcaagatcgggaatggctgggggtgcgaccaaggggacttggagaaccgccccgcctccccaggttcccctggtagagcgcaccaccccccacccccgcgagttttcagaggc

SEQ ID NO: 8229 - DNA, 30 bp, Homo sapiens
  misc_feature 1..30: note = chr5:175621379-175621409
  misc_feature 1..30: note = hyper
  source 1..30: mol_type = genomic DNA
tctccaagctgaggccgggtggcctgcgac

SEQ ID NO: 8230 - DNA, 101 bp, Homo sapiens
  misc_feature 1..101: note = chr5:175792208-175792309
  misc_feature 1..101: note = hyper
  source 1..101: mol_type = genomic DNA
cggttttcccttctgcgtggtatcattgtaaggggtaacggagaaaagccgtgagctaacccctggtggatgctagcaagcaccgccgtctcccgtcctcc

SEQ ID NO: 8231 - DNA, 68 bp, Homo sapiens
  misc_feature 1..68: note = chr5:175792864-175792932
  misc_feature 1..68: note = hyper
  source 1..68: mol_type = genomic DNA
cgagggcttggcagccgcagcgcacaggccccgcgcgggtgggcggtcagagcccgggaaccgaggaa

SEQ ID NO: 8232 - DNA, 34 bp, Homo sapiens
  misc_feature 1..34: note = chr5:175792997-175793031
  misc_feature 1..34: note = hyper
  source 1..34: mol_type = genomic DNA
cgggtgttccagcgggggccggagtttggagggc

SEQ ID NO: 8233 - DNA, 204 bp, Homo sapiens
  misc_feature 1..204: note = chr5:176024005-176024209
  misc_feature 1..204: note = hyper
  source 1..204: mol_type = genomic DNA
gctccagatgcttctggatggccatgcccagcacctccacctccatggcggcgccgtatacctcccacgtcatgcccttctcgtcccagctcacgtctcgcacgggctcagccggctccgggggcgctacagcggccgccagcgctgagccgggccgcacccgcacttcggggaaggcgggcggcgcggcggcttgaggtgtca

SEQ ID NO: 8234 - DNA, 30 bp, Homo sapiens
  misc_feature 1..30: note = chr5:176038550-176038580
  misc_feature 1..30: note = hyper
  source 1..30: mol_type = genomic DNA
gcttcctcacatttccggtcctgaaaattg

SEQ ID NO: 8235 - DNA, 272 bp, Homo sapiens; identical to SEQ ID NO: 2707
  misc_feature 1..272: note = chr5:176046306-176046578
  misc_feature 1..272: note = hyper
  source 1..272: mol_type = genomic DNA

SEQ ID NO: 8236 - DNA, 458 bp, Homo sapiens; identical to SEQ ID NO: 2708
  misc_feature 1..458: note = chr5:176056505-176056963
  misc_feature 1..458: note = hyper
  source 1..458: mol_type = genomic DNA

SEQ ID NO: 8237 - DNA, 103 bp, Homo sapiens
  misc_feature 1..103: note = chr5:176057411-176057514
  misc_feature 1..103: note = hyper
  source 1..103: mol_type = genomic DNA
ggtcctgagcaggagcgcagcagtgcccgggtctcgggtgcgtagccagccaccgctcgttcctcgcgccctgcgagctcgcgcgctccggctccggctccgg

SEQ ID NO: 8238 - DNA, 125 bp, Homo sapiens; identical to SEQ ID NO: 2709
  misc_feature 1..125: note = chr5:176107360-176107485
  misc_feature 1..125: note = hyper
  source 1..125: mol_type = genomic DNA

SEQ ID NO: 8239 - DNA, 69 bp, Homo sapiens; identical to SEQ ID NO: 2710
  misc_feature 1..69: note = chr5:176107517-176107586
  misc_feature 1..69: note = hyper
  source 1..69: mol_type = genomic DNA

SEQ ID NO: 8240 - DNA, 42 bp, Homo sapiens
  misc_feature 1..42: note = chr5:176236773-176236815
  misc_feature 1..42: note = hyper
  source 1..42: mol_type = genomic DNA
tcggggctcaaacaccgcgcgcccagtcgggtgtgctgcgcc

SEQ ID NO: 8241 - DNA, 95 bp, Homo sapiens
  misc_feature 1..95: note = chr5:176264805-176264900
  misc_feature 1..95: note = hyper
  source 1..95: mol_type = genomic DNA
gatagcggtcctggacgtggcacgctttcagcaccgtggacagccccaggcgctccacagaggctgtccctctgcggactcggcttcctaacctc

SEQ ID NO: 8242 - DNA, 95 bp, Homo sapiens; identical to SEQ ID NO: 2711
  misc_feature 1..95: note = chr5:177411327-177411422
  misc_feature 1..95: note = hyper
  source 1..95: mol_type = genomic DNA

SEQ ID NO: 8243 - DNA, 15 bp, Homo sapiens
  misc_feature 1..15: note = chr5:177411507-177411522
  misc_feature 1..15: note = hyper
  source 1..15: mol_type = genomic DNA
cgcggagatgggcca

SEQ ID NO: 8244 - DNA, 452 bp, Homo sapiens
  misc_feature 1..452: note = chr5:177411766-177412218
  misc_feature 1..452: note = hyper
  source 1..452: mol_type = genomic DNA
agattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcggtggctcac

SEQ ID NO: 8245 - DNA, 30 bp, Homo sapiens
  misc_feature 1..30: note = chr5:178004344-178004374
  misc_feature 1..30: note = hyper
  source 1..30: mol_type = genomic DNA
ctgtgccacctcatccgcctctttaaagac

SEQ ID NO: 8246 - DNA, 303 bp, Homo sapiens; identical to SEQ ID NO: 509
  misc_feature 1..303: note = chr5:178016681-178016984
  misc_feature 1..303: note = hyper
  source 1..303: mol_type = genomic DNA

SEQ ID NO: 8247 - DNA, 52 bp, Homo sapiens; identical to SEQ ID NO: 510
  misc_feature 1..52: note = chr5:178017519-178017571
  misc_feature 1..52: note = hyper
  source 1..52: mol_type = genomic DNA

SEQ ID NO: 8248 - DNA, 111 bp, Homo sapiens; identical to SEQ ID NO: 511
  misc_feature 1..111: note = chr5:178017572-178017683
  misc_feature 1..111: note = hyper
  source 1..111: mol_type = genomic DNA

SEQ ID NO: 8249 - DNA, 197 bp, Homo sapiens
  misc_feature 1..197: note = chr5:178450910-178451107
  misc_feature 1..197: note = hyper
  source 1..197: mol_type = genomic DNA
ggctgccggtgagggcgggcccggggcgtgcggctgccgcggcgggaccaggacgagggctggcctctgcgcgtgtctgccgagtccccggctccgggcgtccgagccggggcggcctcggcaggtgaacccggccccggagggggcgtggcctgggaagggcctggcggaggccgggagggcgcttcgacgccgct

SEQ ID NO: 8250 - DNA, 46 bp, Homo sapiens
  misc_feature 1..46: note = chr5:178487258-178487304
  misc_feature 1..46: note = hyper
  source 1..46: mol_type = genomic DNA
gcctttgagagctctcgttggcggaggcggttcctctcccggagtt

SEQ ID NO: 8251 - DNA, 83 bp, Homo sapiens
  misc_feature 1..83: note = chr5:178487341-178487424
  misc_feature 1..83: note = hyper
  source 1..83: mol_type = genomic DNA
cggcgtggggccggaggcatgccgggagtggtagttctcccgcggttggcggggtttcggggacagctcgcggcctttcgggg

SEQ ID NO: 8252 - DNA, 30 bp, Homo sapiens
  misc_feature 1..30: note = chr5:178487700-178487730
  misc_feature 1..30: note = hyper
  source 1..30: mol_type = genomic DNA
atgccagccttttgtcgttgttcattctgc

SEQ ID NO: 8253 - DNA, 81 bp, Homo sapiens
  misc_feature 1..81: note = chr5:178594307-178594388
  misc_feature 1..81: note = hyper
  source 1..81: mol_type = genomic DNA
ggcccgggccggggacgcacccggcgcccagactccgcggccgcacccgggctcccggggccccagcggccccaagacagc

SEQ ID NO: 8254 - DNA, 100 bp, Homo sapiens; identical to SEQ ID NO: 2716
  misc_feature 1..100: note = chr5:178770805-178770905
  misc_feature 1..100: note = hyper
  source 1..100: mol_type = genomic DNA

SEQ ID NO: 8255 - DNA, 433 bp, Homo sapiens; identical to SEQ ID NO: 2717
  misc_feature 1..433: note = chr5:178771198-178771631
  misc_feature 1..433: note = hyper
  source 1..433: mol_type = genomic DNA

SEQ ID NO: 8256 - DNA, 58 bp, Homo sapiens; identical to SEQ ID NO: 2718
  misc_feature 1..58: note = chr5:178771723-178771781
  misc_feature 1..58: note = hyper
  source 1..58: mol_type = genomic DNA

SEQ ID NO: 8257 - DNA, 78 bp, Homo sapiens; identical to SEQ ID NO: 2719
  misc_feature 1..78: note = chr5:178771782-178771860
  misc_feature 1..78: note = hyper
  source 1..78: mol_type = genomic DNA

SEQ ID NO: 8258 - skipped

SEQ ID NO: 8259 - DNA, 546 bp, Homo sapiens; identical to SEQ ID NO: 2721
  misc_feature 1..546: note = chr5:178772184-178772730
  misc_feature 1..546: note = hyper
  source 1..546: mol_type = genomic DNA

SEQ ID NO: 8260 - DNA, 58 bp, Homo sapiens; identical to SEQ ID NO: 2722
  misc_feature 1..58: note = chr5:178772778-178772836
  misc_feature 1..58: note = hyper
  source 1..58: mol_type = genomic DNA

SEQ ID NO: 8261 - DNA, 240 bp, Homo sapiens; identical to SEQ ID NO: 2723
  misc_feature 1..240: note = chr5:178957706-178957946
  misc_feature 1..240: note = hyper
  source 1..240: mol_type = genomic DNA

SEQ ID NO: 8262 - DNA, 22 bp, Homo sapiens
  misc_feature 1..22: note = chr5:179244320-179244342
  misc_feature 1..22: note = hyper
  source 1..22: mol_type = genomic DNA
gggcgttcgtcctccatccctc

SEQ ID NO: 8263 - DNA, 135 bp, Homo sapiens
  misc_feature 1..135: note = chr5:179779648-179779783
  misc_feature 1..135: note = hyper
  source 1..135: mol_type = genomic DNA
acgttcctttggggtcgcgaggaggacgcgcaggccctgcctgaggcactgacgcagcgggggcgaccgggcgggctgcggggacggcggggcggggtcgcctctcctctcctcggtgggcgcggcgggctgagt

SEQ ID NO: 8264 - DNA, 173 bp, Homo sapiens
  misc_feature 1..173: note = chr5:179779840-179780013
  misc_feature 1..173: note = hyper
  source 1..173: mol_type = genomic DNA
cgactgggagacgtggaggagagcgacctcggtcggcatggggtggggacccctctgttacggggtccaggccggaccggaccaggtccctcccctccgtggggaccgggcctcggtccccctcactgtgtccgagaccaggagtcgggttgggcatcccccacccacacctc

SEQ ID NO: 8265 - DNA, 227 bp, Homo sapiens
  misc_feature 1..227: note = chr5:179780035-179780262
  misc_feature 1..227: note = hyper
  source 1..227: mol_type = genomic DNA
cgggtgaggggcagccaggcccggccgacgacagcccctcggtaggggcccggggcagatcggcgcccccagccaggtcctcggcgcctgcttgcgggcggaggcgcggagaggctgcggcgccgggacccgcggacggcgtggaggaggcggctcgggcgggcgcggcactcaccgcacatcgtggctgcttctcgggctccttcgcggctcgagggggtctgccc

SEQ ID NO: 8266 - DNA, 699 bp, Homo sapiens; identical to SEQ ID NO: 2724
  misc_feature 1..699: note = chr5:179780528-179781227
  misc_feature 1..699: note = hyper
  source 1..699: mol_type = genomic DNA

SEQ ID NO: 8267 - DNA, 30 bp, Homo sapiens
  misc_feature 1..30: note = chr5:179867518-179867548
  misc_feature 1..30: note = hyper
  source 1..30: mol_type = genomic DNA
caaggcagcccagatcgggagggagggtcc

SEQ ID NO: 8268 - DNA, 179 bp, Homo sapiens
  misc_feature 1..179: note = chr5:180017145-180017324
  misc_feature 1..179: note = hyper
  source 1..179: mol_type = genomic DNA
atggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagc

SEQ ID NO: 8269 - DNA, 153 bp, Homo sapiens; identical to SEQ ID NO: 2725
  misc_feature 1..153: note = chr5:180017536-180017689
  misc_feature 1..153: note = hyper
  source 1..153: mol_type = genomic DNA

SEQ ID NO: 8270 - DNA, 442 bp, Homo sapiens; identical to SEQ ID NO: 2726
  misc_feature 1..442: note = chr5:180017690-180018132
  misc_feature 1..442: note = hyper
  source 1..442: mol_type = genomic DNA

SEQ ID NO: 8271 - DNA, 126 bp, Homo sapiens; identical to SEQ ID NO: 2727
  misc_feature 1..126: note = chr5:180018484-180018610
  misc_feature 1..126: note = hyper
  source 1..126: mol_type = genomic DNA

SEQ ID NO: 8272 - DNA, 44 bp, Homo sapiens; identical to SEQ ID NO: 512
  misc_feature 1..44: note = chr5:180075814-180075858
  misc_feature 1..44: note = hyper
  source 1..44: mol_type = genomic DNA

SEQ ID NO: 8273 - DNA, 405 bp, Homo sapiens; identical to SEQ ID NO: 513
  misc_feature 1..405: note = chr5:180076053-180076458
  misc_feature 1..405: note = hyper
  source 1..405: mol_type = genomic DNA

SEQ ID NO: 8274 - DNA, 314 bp, Homo sapiens; identical to SEQ ID NO: 514
  misc_feature 1..314: note = chr5:180076532-180076846
  misc_feature 1..314: note = hyper
  source 1..314: mol_type = genomic DNA

SEQ ID NO: 8275 - DNA, 30 bp, Homo sapiens
  misc_feature 1..30: note = chr5:180100685-180100715
  misc_feature 1..30: note = hyper
  source 1..30: mol_type = genomic DNA
cagaggggaccactgcgcctcctgcctgag

SEQ ID NO: 8276 - DNA, 153 bp, Homo sapiens; identical to SEQ ID NO: 2731
  misc_feature 1..153: note = chr5:180101015-180101168
  misc_feature 1..153: note = hyper
  source 1..153: mol_type = genomic DNA

SEQ ID NO: 8277 - DNA, 39 bp, Homo sapiens
  misc_feature 1..39: note = chr5:180527793-180527832
  misc_feature 1..39: note = hyper
  source 1..39: mol_type = genomic DNA
cgactggaaatccgggtgcacctccgccccccggggcgc

SEQ ID NO: 8278 - DNA, 135 bp, Homo sapiens; identical to SEQ ID NO: 2732
  misc_feature 1..135: note = chr5:180531170-180531305
  misc_feature 1..135: note = hyper
  source 1..135: mol_type = genomic DNA

SEQ ID NO: 8279 - DNA, 210 bp, Homo sapiens; identical to SEQ ID NO: 2733
  misc_feature 1..210: note = chr5:180600858-180601068
  misc_feature 1..210: note = hyper
  source 1..210: mol_type = genomic DNA

SEQ ID NO: 8280 - DNA, 90 bp, Homo sapiens; identical to SEQ ID NO: 2734
  misc_feature 1..90: note = chr5:180601128-180601218
  misc_feature 1..90: note = hyper
  source 1..90: mol_type = genomic DNA

SEQ ID NO: 8281 - DNA, 534 bp, Homo sapiens; identical to SEQ ID NO: 515
  misc_feature 1..534: note = chr6:391209-391743
  misc_feature 1..534: note = hyper
  source 1..534: mol_type = genomic DNA

SEQ ID NO: 8282 - DNA, 20 bp, Homo sapiens
  misc_feature 1..20: note = chr6:391744-391764
  misc_feature 1..20: note = hyper
  source 1..20: mol_type = genomic DNA
cactctcagtttcaccgctc

SEQ ID NO: 8283 - DNA, 135 bp, Homo sapiens; identical to SEQ ID NO: 517
  misc_feature 1..135: note = chr6:391765-391900
  misc_feature 1..135: note = hyper
  source 1..135: mol_type = genomic DNA

SEQ ID NO: 8284 - DNA, 25 bp, Homo sapiens
  misc_feature 1..25: note = chr6:392409-392434
  misc_feature 1..25: note = hyper
  source 1..25: mol_type = genomic DNA
gctctcccgggcctgctccggggtc

SEQ ID NO: 8285 - DNA, 372 bp, Homo sapiens; identical to SEQ ID NO: 519
  misc_feature 1..372: note = chr6:392587-392959
  misc_feature 1..372: note = hyper
  source 1..372: mol_type = genomic DNA

SEQ ID NO: 8286 - DNA, 115 bp, Homo sapiens; identical to SEQ ID NO: 520
  misc_feature 1..115: note = chr6:393124-393239
  misc_feature 1..115: note = hyper
  source 1..115: mol_type = genomic DNA

SEQ ID NO: 8287 - DNA, 233 bp, Homo sapiens; identical to SEQ ID NO: 521
  misc_feature 1..233: note = chr6:393240-393473
  misc_feature 1..233: note = hyper
  source 1..233: mol_type = genomic DNA

SEQ ID NO: 8288 - DNA, 45 bp, Homo sapiens
  misc_feature 1..45: note = chr6:1314017-1314062
  misc_feature 1..45: note = hyper
  source 1..45: mol_type = genomic DNA
agccactccgaggcccggcggccggcggcgcgcacctgtactgcc

SEQ ID NO: 8289 - DNA, 277 bp, Homo sapiens; identical to SEQ ID NO: 2742
  misc_feature 1..277: note = chr6:1378199-1378476
  misc_feature 1..277: note = hyper
  source 1..277: mol_type = genomic DNA

SEQ ID NO: 8290 - DNA, 123 bp, Homo sapiens
  misc_feature 1..123: note = chr6:1379267-1379390
  misc_feature 1..123: note = hyper
  source 1..123: mol_type = genomic DNA
cgaaaccaccccggggaaagccgtaggggcgcgccggcccacgcgggaccgagttcagaggactctgcaccgtcagtttcagggccgacgtttatagagcgcttcccacgtgccgcacgcggt

SEQ ID NO: 8291 - DNA, 363 bp, Homo sapiens
  misc_feature 1..363: note = chr6:1383078-1383441
  misc_feature 1..363: note = hyper
  source 1..363: mol_type = genomic DNA
gccttgcagactggccgcgtgggtgccatggggcgatttcttgggaaaggagggcagcagaaaggcccgtgggctctcagcgccttggagtcaggggagcaggaaggggagtggaggtgcggacacgcctccagccaccgtgctcccctaggaggatctcccttcagcccctgtagaaccctgcatctcaaccaccctcgtgcatgtggtttaccttggcatagatttccaagccgctacagaaaacctgtccacctcccccaaggtggaggcgggagttgggaggcaggggtgctggaaagggtcacctggctcaagccgaccccaggtctgacgggcggagagcctcgagggccacgcccc

SEQ ID NO: 8292 - DNA, 21 bp, Homo sapiens
  misc_feature 1..21: note = chr6:1383859-1383880
  misc_feature 1..21: note = hyper
  source 1..21: mol_type = genomic DNA
ggggcccggggcctttggcca

SEQ ID NO: 8293 - DNA, 53 bp, Homo sapiens; identical to SEQ ID NO: 522
  misc_feature 1..53: note = chr6:1384127-1384180
  misc_feature 1..53: note = hyper
  source 1..53: mol_type = genomic DNA

SEQ ID NO: 8294 - DNA, 19 bp, Homo sapiens
  misc_feature 1..19: note = chr6:1384625-1384644
  misc_feature 1..19: note = hyper
  source 1..19: mol_type = genomic DNA
cgagcgttgccacagccgg

SEQ ID NO: 8295 - DNA, 67 bp, Homo sapiens
  misc_feature 1..67: note = chr6:1385157-1385224
  misc_feature 1..67: note = hyper
  source 1..67: mol_type = genomic DNA
gcaatttgggaagtgcggaaatggggtgaggccggtcttcgcttgagggtctcgtagattggacccc

SEQ ID NO: 8296 - DNA, 81 bp, Homo sapiens
  misc_feature 1..81: note = chr6:1389124-1389205
  misc_feature 1..81: note = hyper
  source 1..81: mol_type = genomic DNA
ctctgctcaaagttccgaaaacgtccacgatcgccagcggcccgcaaccctgcggcggcccccagtcgccctaacaattgt

SEQ ID NO: 8297 - DNA, 63 bp, Homo sapiens
  misc_feature 1..63: note = chr6:1389953-1390016
  misc_feature 1..63: note = hyper
  source 1..63: mol_type = genomic DNA
cggggagggatgcgccgggcgttgcctcccgcccgccgccgccgccgccgccagaagccccag

SEQ ID NO: 8298 - DNA, 77 bp, Homo sapiens
  misc_feature 1..77: note = chr6:1390484-1390561
  misc_feature 1..77: note = hyper
  source 1..77: mol_type = genomic DNA
gccctactcgtacatcgcgctcatcgtcatggccatccagagctcgcccagcaagcgcctgacgctcagcgagatct

SEQ ID NO: 8299 - DNA, 451 bp, Homo sapiens
  misc_feature 1..451: note = chr6:1390955-1391406
  misc_feature 1..451: note = hyper
  source 1..451: mol_type = genomic DNA
cgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctcc

SEQ ID NO: 8300 - DNA, 30 bp, Homo sapiens
  misc_feature 1..30: note = chr6:1605320-1605350
  misc_feature 1..30: note = hyper
  source 1..30: mol_type = genomic DNA
cccggcgcctgggtccgctgcggcgccggg

SEQ ID NO: 8301 - DNA, 347 bp, Homo sapiens
  misc_feature 1..347: note = chr6:1611408-1611755
  misc_feature 1..347: note = hyper
  source 1..347: mol_type = genomic DNA
cgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagct

SEQ ID NO: 8302 - DNA, 261 bp, Homo sapiens; identical to SEQ ID NO: 524
  misc_feature 1..261: note = chr6:1625257-1625518
  misc_feature 1..261: note = hyper
  source 1..261: mol_type = genomic DNA

SEQ ID NO: 8303 - DNA, 440 bp, Homo sapiens
  misc_feature 1..440: note = chr6:2903077-2903517
  misc_feature 1..440: note = hyper
  source 1..440: mol_type = genomic DNA
aagaagcaggacagacgtcatcctgcggatcccagagcagagaagagcagtgagaacacagggccggcaggtggggaggaggctgcaggggagggcttcggccagggaagggcagcgaggagacatccgggagggaggcgtccgcggtggctgtgggccgccaaggcggagaccggctgccgctcccaggcaccccccagagaccgttgctgaccccaccgagaaggcaccgcctccccggggctcttggctgagcgacctctcctgtcctccggtcccatcactcggtggcagccggtggacctgaagctcgccactcccgtcccctaccccagccgtgcgcggggacgccctcacctgccacctagtccagcgctgccgccgtctccgtgccgcgctccgagcctggacgccgacccccgaggcgcaggacccggccc

SEQ ID NO: 8304 - DNA, 48 bp, Homo sapiens
  misc_feature 1..48: note = chr6:3229011-3229059
  misc_feature 1..48: note = hyper
  source 1..48: mol_type = genomic DNA
tttcttatcttccatcgcggcgacctggaggtccgaggcttcgtgctg

SEQ ID NO: 8305 - DNA, 39 bp, Homo sapiens
  misc_feature 1..39: note = chr6:3231729-3231768
  misc_feature 1..39: note = hyper
  source 1..39: mol_type = genomic DNA
agctggaaccagcagcgaaaaccccgagcccacgaacgc

SEQ ID NO: 8306 - DNA, 41 bp, Homo sapiens
  misc_feature 1..41: note = chr6:4775411-4775452
  misc_feature 1..41: note = hyper
  source 1..41: mol_type = genomic DNA
acatggaggaactggcgagggcttcccgatgcagggcctgg

SEQ ID NO: 8307 - DNA, 179 bp, Homo sapiens
  misc_feature 1..179: note = chr6:5086150-5086329
  misc_feature 1..179: note = hyper
  source 1..179: mol_type = genomic DNA
cgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcc

SEQ ID NO: 8308 - DNA, 30 bp, Homo sapiens
  misc_feature 1..30: note = chr6:5851769-5851799
  misc_feature 1..30: note = hyper
  source 1..30: mol_type = genomic DNA
ggaggcctggtcacccgcaggccctgccat

SEQ ID NO: 8309 - DNA, 638 bp, Homo sapiens
  misc_feature 1..638: note = chr6:5996066-5996704
  misc_feature 1..638: note = hyper
  source 1..638: mol_type = genomic DNA
tcagtggggcatgctcgccctggttaatgtcatctccctgaactgccaacgaggctagcagctttgctgcttaaaaccggtaacatcaaccaacatatggagatgtcatcatgattaaacggcaaattatagccgaagacggcgcgataataatctaaacaatcaccacaagaagaaacgttctctaacgctccagttgcggaagcctgcgtttccaagactcgcggccctgcgttcccagggatatctccgtgctcacgtgagcgtggtcctcggcttgggacagacaagggagccccagacaggacgataaggtttggagattcccagggcgatctgggactccgtggcgtgggggcttggaagcgcgtggaggggctgagagaggggagagggcgcccttcctctagggcggccccgtctgggaagcagttggaacagcagtaggagccaggggttcctagagaagaaccctgttaggagagcagaccagcccgcgctcccagtccccgccccctcgccccttctgccccgcccttagcctgcctcttcctagatcttccaggacattgatttccgagtaggaagcccgcgctgctaggggaggggcgtcctctgtgggtcgtgggggggtttcc

SEQ ID NO: 8310 - DNA, 87 bp, Homo sapiens
  misc_feature 1..87: note = chr6:5996959-5997046
  misc_feature 1..87: note = hyper
  source 1..87: mol_type = genomic DNA
tatttatacgcagaccgaaaataaccattgaaacgaaaccaacaaaatgcaactattttccaaaaccccgagcgtttgctggtgggt

SEQ ID NO: 8311 - DNA, 36 bp, Homo sapiens
  misc_feature 1..36: note = chr6:5997581-5997617
  misc_feature 1..36: note = hyper
  source 1..36: mol_type = genomic DNA
caggcctgcagtccccggacccgggtcgcctctgcc

SEQ ID NO: 8312 - DNA, 260 bp, Homo sapiens; identical to SEQ ID NO: 525
  misc_feature 1..260: note = chr6:6003269-6003529
  misc_feature 1..260: note = hyper
  source 1..260: mol_type = genomic DNA

SEQ ID NO: 8313 - DNA, 395 bp, Homo sapiens; identical to SEQ ID NO: 526
  misc_feature 1..395: note = chr6:6004349-6004744
  misc_feature 1..395: note = hyper
  source 1..395: mol_type = genomic DNA

SEQ ID NO: 8314 - DNA, 329 bp, Homo sapiens; identical to SEQ ID NO: 527
  misc_feature 1..329: note = chr6:6004836-6005165
  misc_feature 1..329: note = hyper
  source 1..329: mol_type = genomic DNA

SEQ ID NO: 8315 - DNA, 192 bp, Homo sapiens; identical to SEQ ID NO: 528
  misc_feature 1..192: note = chr6:6006691-6006883
  misc_feature 1..192: note = hyper
  source 1..192: mol_type = genomic DNA

SEQ ID NO: 8316 - DNA, 352 bp, Homo sapiens; identical to SEQ ID NO: 2751
  misc_feature 1..352: note = chr6:6007318-6007670
  misc_feature 1..352: note = hyper
  source 1..352: mol_type = genomic DNA

SEQ ID NO: 8317 - DNA, 102 bp, Homo sapiens; identical to SEQ ID NO: 2752
  misc_feature 1..102: note = chr6:6007671-6007773
  misc_feature 1..102: note = hyper
  source 1..102: mol_type = genomic DNA

SEQ ID NO: 8318 - DNA, 274 bp, Homo sapiens; identical to SEQ ID NO: 2753
  misc_feature 1..274: note = chr6:6007833-6008107
  misc_feature 1..274: note = hyper
  source 1..274: mol_type = genomic DNA

SEQ ID NO: 8319 - DNA, 30 bp, Homo sapiens
  misc_feature 1..30: note = chr6:6009468-6009498
  misc_feature 1..30: note = hyper
  source 1..30: mol_type = genomic DNA
agggcctcaatgaagcgggtgaacccacgc

SEQ ID NO: 8320 - DNA, 95 bp, Homo sapiens
  misc_feature 1..95: note = chr6:6546546-6546641
  misc_feature 1..95: note = hyper
  source 1..95: mol_type = genomic DNA
caccgcaaccgcagccgcagccgcggaggggaggccgtgcacccgcccgccgggagagccgcgcgcctgagccgggcgcacgtgggaagtgggcc

SEQ ID NO: 8321 - DNA, 296 bp, Homo sapiens
  misc_feature 1..296: note = chr6:6546926-6547222
  misc_feature 1..296: note = hyper
  source 1..296: mol_type = genomic DNA
ctagtcccttgccaccggctcccgcggccaccgcgcagccagagtgcaccgtccctagggctttggcggtggccagagccagcaagtgcggcggcctggagctggggtggtgagggcggatggcaggttggagaaatgcagccgagccgcaggtttctagaggcctctacagcccctgccatctgggcactgcacagacagacgctgcgtgagacctggagctcgccacctccatgcggcgctgccagccactccgctgcgggtgcaggagcgttccatgtcggggactgagggac

SEQ ID NO: 8322 - DNA, 123 bp, Homo sapiens
  misc_feature 1..123: note = chr6:7726824-7726947
  misc_feature 1..123: note = hyper
  source 1..123: mol_type = genomic DNA
gaggcccagagtgaccgcgccgcgactcgcaggagccagggcgcaggctgcagtgcagcccggactcagacgcacctggcctggaccgcgcgcctctagagacctgcgcgaggctgtgaggct

SEQ ID NO: 8323 - DNA, 447 bp, Homo sapiens
  misc_feature 1..447: note = chr6:7727322-7727769
  misc_feature 1..447: note = hyper
  source 1..447: mol_type = genomic DNA
ggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcag

SEQ ID NO: 8324 - DNA, 752 bp, Homo sapiens
  misc_feature 1..752: note = chr6:7728086-7728838
  misc_feature 1..752: note = hyper
  source 1..752: mol_type = genomic DNA
cggccgggccgcggggctccgggagcgctgtccccagcgggcgtgtatttgcggactccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgctt

SEQ ID NO: 8325 - DNA, 86 bp, Homo sapiens; identical to SEQ ID NO: 529
  misc_feature 1..86: note = chr6:10381507-10381593
  misc_feature 1..86: note = hyper
  source 1..86: mol_type = genomic DNA

SEQ ID NO: 8326 - DNA, 138 bp, Homo sapiens; identical to SEQ ID NO: 530
  misc_feature 1..138: note = chr6:10381831-10381969
  misc_feature 1..138: note = hyper
  source 1..138: mol_type = genomic DNA

SEQ ID NO: 8327 - DNA, 184 bp, Homo sapiens; identical to SEQ ID NO: 2756
  misc_feature 1..184: note = chr6:10382722-10382906
  misc_feature 1..184: note = hyper
  source 1..184: mol_type = genomic DNA

SEQ ID NO: 8328 - DNA, 142 bp, Homo sapiens
  misc_feature 1..142: note = chr6:10383858-10384000
  misc_feature 1..142: note = hyper
  source 1..142: mol_type = genomic DNA
cctctgcagcctaggcggggtgtgtggcgtcgcggtcagccttaccgagggacacgccgccccgggccgggacggggtggggctgtgggggatcctgggccgaggaaagcgatccattttctctaaccgtttgctccagagc

SEQ ID NO: 8329 - DNA, 30 bp, Homo sapiens
  misc_feature 1..30: note = chr6:10384438-10384468
  misc_feature 1..30: note = hyper
  source 1..30: mol_type = genomic DNA
tgcccctgcgggtcccgattacagatgaat

SEQ ID NO: 8330 - DNA, 20 bp, Homo sapiens
  misc_feature 1..20: note = chr6:10384955-10384975
  misc_feature 1..20: note = hyper
  source 1..20: mol_type = genomic DNA
gagggggagccgtggcgggc

SEQ ID NO: 8331 - DNA, 354 bp, Homo sapiens
  misc_feature 1..354: note = chr6:10385499-10385853
  misc_feature 1..354: note = hyper
  source 1..354: mol_type = genomic DNA
gggtgttttcctcttcgggaagtgttatcaaacagtaatagctaccctcgactccgaatcacagcattccccccagaattcctgatcagtaaaacccaaatcgttttcaagacaaaggagcatcaatcagcgacaaagacagatttaacgtattaaatctttattaaagtgaagtcattcttattgaaatgatgtattgggtgtgcagaaagattggatttttttttttttttttttttgacaatgtgtaaaatggagatggtggcggagagcttgcgccgcgtcttgccctgattgttctgggctgggattggattactgggactgcccagggtcccgcgccaggaaacacca

SEQ ID NO: 8332 - DNA, 63 bp, Homo sapiens
  misc_feature 1..63: note = chr6:10386210-10386273
  misc_feature 1..63: note = hyper
  source 1..63: mol_type = genomic DNA
agctggctgtcttcccgcctggggtgggctctcaattcaactggacctcgggtcctgtcaagg

SEQ ID NO: 8333 - DNA, 1050 bp, Homo sapiens; identical to SEQ ID NO: 531
  misc_feature 1..1050: note = chr6:10390023-10391073
  misc_feature 1..1050: note = hyper
  source 1..1050: mol_type = genomic DNA

SEQ ID NO: 8334 - DNA, 59 bp, Homo sapiens
  misc_feature 1..59: note = chr6:10391337-10391396
  misc_feature 1..59: note = hyper
  source 1..59: mol_type = genomic DNA
ggccgctgcccaggccgtccacatttccctccctggctgtccttcgagcccctaccagt

SEQ ID NO: 8335 - DNA, 30 bp, Homo sapiens
  misc_feature 1..30: note = chr6:10411311-10411341
  misc_feature 1..30: note = hyper
  source 1..30: mol_type = genomic DNA
aaagggcagaagaaacgcctgactttaggt

SEQ ID NO: 8336 - DNA, 44 bp, Homo sapiens
  misc_feature 1..44: note = chr6:10411992-10412036
  misc_feature 1..44: note = hyper
  source 1..44: mol_type = genomic DNA
cggctcggatccatccgaacttgaaccaccgattcgcgcggcgc

SEQ ID NO: 8337 - DNA, 102 bp, Homo sapiens
  misc_feature 1..102: note = chr6:10415113-10415215
  misc_feature 1..102: note = hyper
  source 1..102: mol_type = genomic DNA
agggagggtcaagctcggagcctgtgaccgcacggatgatcgagccggcgtcgcgcttacctcgcagtcctcgtacttgatattatccgtcaatttccaaag

SEQ ID NO: 8338 - DNA, 154 bp, Homo sapiens
  misc_feature 1..154: note = chr6:10415559-10415713
  misc_feature 1..154: note = hyper
  source 1..154: mol_type = genomic DNA
aatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgcccca

SEQ ID NO: 8339 - DNA, 30 bp, Homo sapiens
  misc_feature 1..30: note = chr6:10416118-10416148
  misc_feature 1..30: note = hyper
  source 1..30: mol_type = genomic DNA
atcccttaattgcagcgtgtaaaataaaag

SEQ ID NO: 8340 - DNA, 65 bp, Homo sapiens; identical to SEQ ID NO: 2758
  misc_feature 1..65: note = chr6:10417158-10417223
  misc_feature 1..65: note = hyper
  source 1..65: mol_type = genomic DNA

SEQ ID NO: 8341 - DNA, 103 bp, Homo sapiens; identical to SEQ ID NO: 532
  misc_feature 1..103: note = chr6:10417427-10417530
  misc_feature 1..103: note = hyper
  source 1..103: mol_type = genomic DNA

SEQ ID NO: 8342 - DNA, 363 bp, Homo sapiens; identical to SEQ ID NO: 533
  misc_feature 1..363: note = chr6:10419077-10419440
  misc_feature 1..363: note = hyper
  source 1..363: mol_type = genomic DNA

SEQ ID NO: 8343 - DNA, 56 bp, Homo sapiens; identical to SEQ ID NO: 534
  misc_feature 1..56: note = chr6:10419476-10419532
  misc_feature 1..56: note = hyper
  source 1..56: mol_type = genomic DNA

SEQ ID NO: 8344 - DNA, 74 bp, Homo sapiens
  misc_feature 1..74: note = chr6:10419828-10419902
  misc_feature 1..74: note = hyper
  source 1..74: mol_type = genomic DNA
acctgccgacgcatgcgcgctggcccaggaattcactccgccagctgcagtcccagcgccgcacagagctgacc

SEQ ID NO: 8345 - DNA, 38 bp, Homo sapiens
  misc_feature 1..38: note = chr6:10420118-10420156
  misc_feature 1..38: note = hyper
  source 1..38: mol_type = genomic DNA
cgaactgggggagtctccactcccgggtgggggtcggg

SEQ ID NO: 8346 - DNA, 96 bp, Homo sapiens; identical to SEQ ID NO: 535
  misc_feature 1..96: note = chr6:10421356-10421452
  misc_feature 1..96: note = hyper
  source 1..96: mol_type = genomic DNA

SEQ ID NO: 8347 - DNA, 568 bp, Homo sapiens; identical to SEQ ID NO: 536
  misc_feature 1..568: note = chr6:10421548-10422116
  misc_feature 1..568: note = hyper
  source 1..568: mol_type = genomic DNA

SEQ ID NO: 8348 - DNA, 306 bp, Homo sapiens; identical to SEQ ID NO: 2764
  misc_feature 1..306: note = chr6:10422355-10422661
  misc_feature 1..306: note = hyper
  source 1..306: mol_type = genomic DNA

SEQ ID NO: 8349 - DNA, 141 bp, Homo sapiens
  misc_feature 1..141: note = chr6:10423946-10424087
  misc_feature 1..141: note = hyper
  source 1..141: mol_type = genomic DNA
ccggcctggaaagaccgagagtaccatgagctgtgaagctggggtgtgacagggatgcccgtccagggctggcaagagtgcagaatggctctcttggatctttggaataggcacatctgcagaccccgctccaatgtttac

SEQ ID NO: 8350 - DNA, 161 bp, Homo sapiens; identical to SEQ ID NO: 2765
  misc_feature 1..161: note = chr6:10425629-10425790
  misc_feature 1..161: note = hyper
  source 1..161: mol_type = genomic DNA

SEQ ID NO: 8351 - DNA, 54 bp, Homo sapiens; identical to SEQ ID NO: 2766
  misc_feature 1..54: note = chr6:10425838-10425892
  misc_feature 1..54: note = hyper
  source 1..54: mol_type = genomic DNA

SEQ ID NO: 8352 - DNA, 393 bp, Homo sapiens; identical to SEQ ID NO: 2767
  misc_feature 1..393: note = chr6:10426185-10426578
  misc_feature 1..393: note = hyper
  source 1..393: mol_type = genomic DNA

SEQ ID NO: 8353 - DNA, 210 bp, Homo sapiens; identical to SEQ ID NO: 2768
  misc_feature 1..210: note = chr6:10881854-10882064
  misc_feature 1..210: note = hyper
  source 1..210: mol_type = genomic DNA

SEQ ID NO: 8354 - DNA, 35 bp, Homo sapiens
  misc_feature 1..35: note = chr6:10886917-10886952
  misc_feature 1..35: note = hyper
  source 1..35: mol_type = genomic DNA
attacaggcgtgagccaccgcgcctggccgcccct

SEQ ID NO: 8355 - DNA, 16 bp, Homo sapiens
  misc_feature 1..16: note = chr6:10887169-10887185
  misc_feature 1..16: note = hyper
  source 1..16: mol_type = genomic DNA
gtaaacttcagggggc

SEQ ID NO: 8356 - DNA, 486 bp, Homo sapiens; identical to SEQ ID NO: 2770
  misc_feature 1..486: note = chr6:10887186-10887672
  misc_feature 1..486: note = hyper
  source 1..486: mol_type = genomic DNA

SEQ ID NO: 8357 - DNA, 228 bp, Homo sapiens
  misc_feature 1..228: note = chr6:11043878-11044106
  misc_feature 1..228: note = hyper
  source 1..228: mol_type = genomic DNA
cccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggcc

SEQ ID NO: 8358 - DNA, 262 bp, Homo sapiens
  misc_feature 1..262: note = chr6:11044107-11044369
  misc_feature 1..262: note = hyper
  source 1..262: mol_type = genomic DNA
ccgcgaaggaggggcggcttcctcgggcatcccgggcgcccggccccgtgcatgcaacaggggactgggcgcgagcgggcgcctcgaggtgccggggcgggaccggggagaggggaccgagacaaagttcccgagacccgcgggcctcgggccgacccgcgcgcccccggcccaaacgctcagctcccgctccccaggcccgcgcggacccggcccctccgagggtagcgggttccagcggcgaacccgcagcgcccgcgcc

SEQ ID NO: 8359 - DNA, 42 bp, Homo sapiens
  misc_feature 1..42: note = chr6:12749899-12749941
  misc_feature 1..42: note = hyper
  source 1..42: mol_type = genomic DNA
ctcccacattaatggcggcatcctcggaggatgatatagacc

SEQ ID NO: 8360 - DNA, 18 bp, Homo sapiens
  misc_feature 1..18: note = chr6:12750364-12750382
  misc_feature 1..18: note = hyper
  source 1..18: mol_type = genomic DNA
gggcgaggttggctggcg

SEQ ID NO: 8361 - DNA, 101 bp, Homo sapiens
  misc_feature 1..101: note = chr6:13013581-13013682
  misc_feature 1..101: note = hyper
  source 1..101: mol_type = genomic DNA
gctacgggttggacccgccggagagggtaatttgctgtggccctggaggggagcttgcacccgaggtttcccagtgcagcgctttccgtgtgaaacatttt

SEQ ID NO: 8362 - DNA, 36 bp, Homo sapiens
  misc_feature 1..36: note = chr6:13013897-13013933
  misc_feature 1..36: note = hyper
  source 1..36: mol_type = genomic DNA
gcctaccccctcctccggcttcgggatccggattgg

SEQ ID NO: 8363 - DNA, 147 bp, Homo sapiens
  misc_feature 1..147: note = chr6:13925376-13925523
  misc_feature 1..147: note = hyper
  source 1..147: mol_type = genomic DNA
gggggcggcaaacttcgggccgagcggcgccggggcccgcgcgcggagtctccctccgggcaccacgggggccgccgtcctggcaccaacttgaggggctgtgcggcggagggcggctgcggagcgcccgcgcgggctgcacctgct

SEQ ID NO: 8364 - DNA, 30 bp, Homo sapiens
  misc_feature 1..30: note = chr6:18122697-18122727
  misc_feature 1..30: note = hyper
  source 1..30: mol_type = genomic DNA
ccgcaggacaggttgcgcgggcgccgctgc

SEQ ID NO: 8365 - DNA, 347 bp, Homo sapiens
  misc_feature 1..347: note = chr6:18277573-18277920
  misc_feature 1..347: note = hyper
  source 1..347: mol_type = genomic DNA
agagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagcc

SEQ ID NO: 8366 - DNA, 102 bp, Homo sapiens; identical to SEQ ID NO: 2771
  misc_feature 1..102: note = chr6:19691895-19691997
  misc_feature 1..102: note = hyper
  source 1..102: mol_type = genomic DNA

SEQ ID NO: 8367 - DNA, 44 bp, Homo sapiens; identical to SEQ ID NO: 2772
  misc_feature 1..44: note = chr6:19692142-19692186
  misc_feature 1..44: note = hyper
  source 1..44: mol_type = genomic DNA

SEQ ID NO: 8368 - DNA, 32 bp, Homo sapiens
  misc_feature 1..32: note = chr6:21665034-21665066
  misc_feature 1..32: note = hyper
  source 1..32: mol_type = genomic DNA
ctggtgcgagtgaagcgcggggcgggggaggc

SEQ ID NO: 8369 - DNA, 113 bp, Homo sapiens
  misc_feature 1..113: note = chr6:21665754-21665867
  misc_feature 1..113: note = hyper
  source 1..113: mol_type = genomic DNA
ggcggcctgggaccccgagtcagatctttggggtgagcacgaggacgtggtgtagggaagaggacgagtgagcagcgcctggctgtagggtcagagggcgcctggtcatcctg

SEQ ID NO: 8370 - DNA, 32 bp, Homo sapiens
  misc_feature 1..32: note = chr6:24126437-24126469
  misc_feature 1..32: note = hyper
  source 1..32: mol_type = genomic DNA
cagctgtcaatcaggcgcgggctgagctctac

SEQ ID NO: 8371 - DNA, 101 bp, Homo sapiens
  misc_feature 1..101: note = chr6:24494728-24494829
  misc_feature 1..101: note = hyper
  source 1..101: mol_type = genomic DNA
ctacaactgaagaagcgtgatcacggccttggcatttagggcaggcaccagcgcatctatggaccgcgcacaaattccggggatgccgaatttgggggatg

SEQ ID NO: 8372 - DNA, 30 bp, Homo sapiens
  misc_feature 1..30: note = chr6:26020909-26020939
  misc_feature 1..30: note = hyper
  source 1..30: mol_type = genomic DNA
aaactacctttccagcgcctggtgcgcgag

SEQ ID NO: 8373 - DNA, 51 bp, Homo sapiens
  misc_feature 1..51: note = chr6:26087615-26087666
  misc_feature 1..51: note = hyper
  source 1..51: mol_type = genomic DNA
gccccccaaaagaagcggagatttaacggggacgtgcggccagagctgggg

SEQ ID NO: 8374 - DNA, 66 bp, Homo sapiens
  misc_feature 1..66: note = chr6:26088186-26088252
  misc_feature 1..66: note = hyper
  source 1..66: mol_type = genomic DNA
acccacagcaggatccgcacggggtttccacctcagaacgaatgcgttgggcggtgggggcgcgaa

SEQ ID NO: 8375 - DNA, 30 bp, Homo sapiens
  misc_feature 1..30: note = chr6:26172122-26172152
  misc_feature 1..30: note = hyper
  source 1..30: mol_type = genomic DNA
catcccatcaaccctcgccaaaaacgccgg

SEQ ID NO: 8376 - DNA, 80 bp, Homo sapiens; identical to SEQ ID NO: 2773
  misc_feature 1..80: note = chr6:26184021-26184101
  misc_feature 1..80: note = hyper
  source 1..80: mol_type = genomic DNA

SEQ ID NO: 8377 - DNA, 163 bp, Homo sapiens; identical to SEQ ID NO: 2774
  misc_feature 1..163: note = chr6:26188740-26188903
  misc_feature 1..163: note = hyper
  source 1..163: mol_type = genomic DNA

SEQ ID NO: 8378 - DNA, 117 bp, Homo sapiens
  misc_feature 1..117: note = chr6:26189276-26189393
  misc_feature 1..117: note = hyper
  source 1..117: mol_type = genomic DNA
cctttccgcccttaccgcggccagacatcttgaaaccacagctgttaaatctgtaacgcaatacgtctggcagagccacgcagcacttttataatagcatgacggacctgtttgaaa

SEQ ID NO: 8379 - DNA, 38 bp, Homo sapiens
  misc_feature 1..38: note = chr6:26199182-26199220
  misc_feature 1..38: note = hyper
  source 1..38: mol_type = genomic DNA
acttgtttagctcctcgtcgttgcggatggccagctgc

SEQ ID NO: 8380 - DNA, 25 bp, Homo sapiens
  misc_feature 1..25: note = chr6:26200129-26200154
  misc_feature 1..25: note = hyper
  source 1..25: mol_type = genomic DNA
gcaccaaggccgtcaccaagtacac

SEQ ID NO: 8381 - DNA, 71 bp, Homo sapiens
  misc_feature 1..71: note = chr6:26205142-26205213
  misc_feature 1..71: note = hyper
  source 1..71: mol_type = genomic DNA
ctgaagagacagggacgcactctttacggcttcggcggctaatgctaccgcttaaacgactcagcatctcg

SEQ ID NO: 8382 - DNA, 30 bp, Homo sapiens
  misc_feature 1..30: note = chr6:26205682-26205712
  misc_feature 1..30: note = hyper
  source 1..30: mol_type = genomic DNA
acttaacctaacgaccgagtttaggtgtgt

SEQ ID NO: 8383 - DNA, 449 bp, Homo sapiens
  misc_feature 1..449: note = chr6:26234025-26234474
  misc_feature 1..449: note = hyper
  source 1..449: mol_type = genomic DNA
accttgggcatgccacgtactgctcacaaccaggacgggatgtgctcaggaagtcacctcaacgctaaagtaaactaaagcatttacaccacatccctgtgtcagaaataaaattttttcagggccacttttaagcgccgcgctttaacagaaatcggccggccaatcacacaccaccgcgggaatttgaagaaaaagtaggacctggtggctcaagtagccttagctatccggtgactgtggctgagactgagacggaaggatccttgcgcccaggctgctgggagctgttaataactgacccccaaccagcacgactaggatagaccgtggccgcacaacaccgcagcacccgcacccctctccaccccactcccccctccaaaaagcttcagctcttttgactgagacctgtgggtggctctgaaaagagccgtttaaaattttca

SEQ ID NO: 8384 - DNA, 30 bp, Homo sapiens
  misc_feature 1..30: note = chr6:26234702-26234732
  misc_feature 1..30: note = hyper
  source 1..30: mol_type = genomic DNA
tttgatgcttttcttcggggtagcggcgcc

SEQ ID NO: 8385 - DNA, 122 bp, Homo sapiens
  misc_feature 1..122: note = chr6:26234942-26235064
  misc_feature 1..122: note = hyper
  source 1..122: mol_type = genomic DNA
atcgtagccagcagccgcaagcgctttcttaagcgcggccagagaaacgccgctgcgctccttagaagctgccactgccttggtgataagctcagatactgggggtccggatgctttgcgtt

SEQ ID NO: 8386 - DNA, 436 bp, Homo sapiens; identical to SEQ ID NO: 2775
  misc_feature 1..436: note = chr6:26240682-26241118
  misc_feature 1..436: note = hyper
  source 1..436: mol_type = genomic DNA

SEQ ID NO: 8387 - DNA, 41 bp, Homo sapiens; identical to SEQ ID NO: 2776
  misc_feature 1..41: note = chr6:26250098-26250139
  misc_feature 1..41: note = hyper
  source 1..41: mol_type = genomic DNA

SEQ ID NO: 8388 - DNA, 486 bp, Homo sapiens; identical to SEQ ID NO: 2777
  misc_feature 1..486: note = chr6:26250199-26250685
  misc_feature 1..486: note = hyper
  source 1..486: mol_type = genomic DNA

SEQ ID NO: 8389 - DNA, 154 bp, Homo sapiens; identical to SEQ ID NO: 2778
  misc_feature 1..154: note = chr6:26250686-26250840
  misc_feature 1..154: note = hyper
  source 1..154: mol_type = genomic DNA

SEQ ID NO: 8390 - DNA, 128 bp, Homo sapiens; identical to SEQ ID NO: 2779
  misc_feature 1..128: note = chr6:26251054-26251182
  misc_feature 1..128: note = hyper
  source 1..128: mol_type = genomic DNA

SEQ ID NO: 8391 - DNA, 325 bp, Homo sapiens; identical to SEQ ID NO: 2780
  misc_feature 1..325: note = chr6:26251641-26251966
  misc_feature 1..325: note = hyper
  source 1..325: mol_type = genomic DNA

SEQ ID NO: 8392 - DNA, 208 bp, Homo sapiens; identical to SEQ ID NO: 2781
  misc_feature 1..208: note = chr6:26271371-26271579
  misc_feature 1..208: note = hyper
  source 1..208: mol_type = genomic DNA

SEQ ID NO: 8393 - DNA, 197 bp, Homo sapiens
  misc_feature 1..197: note = chr6:26272512-26272709
  misc_feature 1..197: note = hyper
  source 1..197: mol_type = genomic DNA
tctcgtcgtggatggcgagctgcaggcgtcggggggtgacgcgggtcttcttgtctcgggccgcgttgcccgccaactccaggatcttggcggtcaggtactccagcaccgcctccaggtacaccggcgcaccggcccggacccgcttggcgtagttgcccttgcggaggaggcggtgcactcggcccacagaaaac

SEQ ID NO: 8394 - DNA, 159 bp, Homo sapiens
  misc_feature 1..159: note = chr6:26273111-26273270
  misc_feature 1..159: note = hyper
  source 1..159: mol_type = genomic DNA
tcatttgcatatacacgaggtaaataatgagggcgtttgggctcaccagcattttcctgtggtcatttgacggtatcacttcggctgcgaacatgcctgaaccagctaagtcagctcccgccccgaagaagggctccaagaaggcggtgaccaaggcac

SEQ ID NO: 8395 - DNA, 180 bp, Homo sapiens
  misc_feature 1..180: note = chr6:26273570-26273750
  misc_feature 1..180: note = hyper
  source 1..180: mol_type = genomic DNA
ccagctccaagtaaactagttacctgggtaaaagcgctaacgacccaaaggctcttctaagagccacccatgttgtcatttaaagatctgtaattttccagacttggcattggcaaggtaaaatggctaagcaacacatgggatagtaagggtttactgaaacatccaagttcggccggg

SEQ ID NO: 8396 - DNA, 101 bp, Homo sapiens
  misc_feature 1..101: note = chr6:26322530-26322631
  misc_feature 1..101: note = hyper
  source 1..101: mol_type = genomic DNA
cctccttacttaccccgcttctcctttggctggagctcggcgagcgagaggcggcgctgggctggcgttggagagcgacggcaggacggctgcggctacga

SEQ ID NO: 8397 - DNA, 157 bp, Homo sapiens; identical to SEQ ID NO: 537
  misc_feature 1..157: note = chr6:26327825-26327982
  misc_feature 1..157: note = hyper
  source 1..157: mol_type = genomic DNA

SEQ ID NO: 8398 - DNA, 85 bp, Homo sapiens; identical to SEQ ID NO: 2783
  misc_feature 1..85: note = chr6:26328331-26328416
  misc_feature 1..85: note = hyper
  source 1..85: mol_type = genomic DNA

SEQ ID NO: 8399 - DNA, 30 bp, Homo sapiens
  misc_feature 1..30: note = chr6:26331781-26331811
  misc_feature 1..30: note = hyper
  source 1..30: mol_type = genomic DNA
tcatgaaaataatttcggtactggtgaaga

SEQ ID NO: 8400 - DNA, 36 bp, Homo sapiens
  misc_feature 1..36: note = chr6:26332172-26332208
  misc_feature 1..36: note = hyper
  source 1..36: mol_type = genomic DNA
cacaaccagtgtttccgttaacgaattcacgcgggg

SEQ ID NO: 8401 - DNA, 240 bp, Homo sapiens; identical to SEQ ID NO: 538
  misc_feature 1..240: note = chr6:26501949-26502189
  misc_feature 1..240: note = hyper
  source 1..240: mol_type = genomic DNA

SEQ ID NO: 8402 - DNA, 187 bp, Homo sapiens
  misc_feature 1..187: note = chr6:26550872-26551059
  misc_feature 1..187: note = hyper
  source 1..187: mol_type = genomic DNA
taggcttgggagttccgcgcctctcggtgtcgcctggggggcgtgctccggttggcgcactgattcccagttgggtaggggaggcttgactgagctcccacccggaatttcaccttagacctttaaagaccttgctccggcctcccgcgccagcgctaacacctagtcctctttagtggagttccgg

SEQ ID NO: 8403 - DNA, 277 bp, Homo sapiens; identical to SEQ ID NO: 2785
  misc_feature 1..277: note = chr6:26577158-26577435
  misc_feature 1..277: note = hyper
  source 1..277: mol_type = genomic DNA

SEQ ID NO: 8404 - DNA, 166 bp, Homo sapiens
  misc_feature 1..166: note = chr6:26577722-26577888
  misc_feature 1..166: note = hyper
  source 1..166: mol_type = genomic DNA
tggctcttggtttctcgatgccattcttatttccggctactgatcgtcaaatgcagtttttattcccacttcccctctccatccccgacccgagctgacgttcgaccagcaaaccacagccaacgcccgcaacacagttcagttaagaaggcgcgtgggaggtgtg

SEQ ID NO: 8405 - DNA, 102 bp, Homo sapiens; identical to SEQ ID NO: 2786
  misc_feature 1..102: note = chr6:27064667-27064769
  misc_feature 1..102: note = hyper
  source 1..102: mol_type = genomic DNA

SEQ ID NO: 8406 - DNA, 233 bp, Homo sapiens; identical to SEQ ID NO: 2787
  misc_feature 1..233: note = chr6:27064770-27065003
  misc_feature 1..233: note = hyper
  source 1..233: mol_type = genomic DNA

SEQ ID NO: 8407 - DNA, 264 bp, Homo sapiens; identical to SEQ ID NO: 2788
  misc_feature 1..264: note = chr6:27065004-27065268
  misc_feature 1..264: note = hyper
  source 1..264: mol_type = genomic DNA

SEQ ID NO: 8408 - DNA, 275 bp, Homo sapiens
  misc_feature 1..275: note = chr6:27100686-27100961
  misc_feature 1..275: note = hyper
  source 1..275: mol_type = genomic DNA
tgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaa

SEQ ID NO: 8409 - DNA, 97 bp, Homo sapiens
  misc_feature 1..97: note = chr6:27173954-27174051
  misc_feature 1..97: note = hyper
  source 1..97: mol_type = genomic DNA
ttacccacatcccccccgcccccatccccaccccgccgcttaactaagagggctttgcctgaagggcctggactgccttatacgtctgtttagaaaa

SEQ ID NO: 8410 - DNA, 79 bp, Homo sapiens; identical to SEQ ID NO: 2789
  misc_feature 1..79: note = chr6:27205332-27205411
  misc_feature 1..79: note = hyper
  source 1..79: mol_type = genomic DNA

SEQ ID NO: 8411 - DNA, 46 bp, Homo sapiens
  misc_feature 1..46: note = chr6:27205940-27205986
  misc_feature 1..46: note = hyper
  source 1..46: mol_type = genomic DNA
aaggaagaaaatctccggcagctatgcctcgcgggttcataaggac

SEQ ID NO: 8412 - DNA, 15 bp, Homo sapiens
  misc_feature 1..15: note = chr6:27228172-27228187
  misc_feature 1..15: note = hyper
  source 1..15: mol_type = genomic DNA
gaagagcccacctgc

SEQ ID NO: 8413 - DNA, 170 bp, Homo sapiens; identical to SEQ ID NO: 540
  misc_feature 1..170: note = chr6:27228289-27228459
  misc_feature 1..170: note = hyper
  source 1..170: mol_type = genomic DNA

SEQ ID NO: 8414 - DNA, 16 bp, Homo sapiens
  misc_feature 1..16: note = chr6:27243064-27243080
  misc_feature 1..16: note = hyper
  source 1..16: mol_type = genomic DNA
acgctgggtgcagctc

SEQ ID NO: 8415 - DNA, 103 bp, Homo sapiens; identical to SEQ ID NO: 2792
  misc_feature 1..103: note = chr6:27247636-27247739
  misc_feature 1..103: note = hyper
  source 1..103: mol_type = genomic DNA

SEQ ID NO: 8416 - DNA, 153 bp, Homo sapiens; identical to SEQ ID NO: 2793
  misc_feature 1..153: note = chr6:27256079-27256232
  misc_feature 1..153: note = hyper
  source 1..153: mol_type = genomic DNA

SEQ ID NO: 8417 - DNA, 725 bp, Homo sapiens; identical to SEQ ID NO: 541
  misc_feature 1..725: note = chr6:27279795-27280520
  misc_feature 1..725: note = hyper
  source 1..725: mol_type = genomic DNA

SEQ ID NO: 8418 - DNA, 498 bp, Homo sapiens; identical to SEQ ID NO: 2795
  misc_feature 1..498: note = chr6:27463133-27463631
  misc_feature 1..498: note = hyper
  source 1..498: mol_type = genomic DNA

SEQ ID NO: 8419 - DNA, 33 bp, Homo sapiens
  misc_feature 1..33: note = chr6:27471362-27471395
  misc_feature 1..33: note = hyper
  source 1..33: mol_type = genomic DNA
tgtcctgacagaccccgtcgttttggcttaggc

SEQ ID NO: 8420 - DNA, 123 bp, Homo sapiens; identical to SEQ ID NO: 542
  misc_feature 1..123: note = chr6:27512761-27512884
  misc_feature 1..123: note = hyper
  source 1..123: mol_type = genomic DNA

SEQ ID NO: 8421 - DNA, 151 bp, Homo sapiens; identical to SEQ ID NO: 543
  misc_feature 1..151: note = chr6:27512994-27513145
  misc_feature 1..151: note = hyper
  source 1..151: mol_type = genomic DNA

SEQ ID NO: 8422 - DNA, 138 bp, Homo sapiens; identical to SEQ ID NO: 2798
  misc_feature 1..138: note = chr6:27513349-27513487
  misc_feature 1..138: note = hyper
  source 1..138: mol_type = genomic DNA

SEQ ID NO: 8423 - DNA, 385 bp, Homo sapiens; identical to SEQ ID NO: 2799
  misc_feature 1..385: note = chr6:27533992-27534377
  misc_feature 1..385: note = hyper
  source 1..385: mol_type = genomic DNA

SEQ ID NO: 8424 - DNA, 61 bp, Homo sapiens
  misc_feature 1..61: note = chr6:27559892-27559953
  misc_feature 1..61: note = hyper
  source 1..61: mol_type = genomic DNA
agagtgggaccccttcggtagtgaataatcccgcagctcattattgcgaacagcagccctt

SEQ ID NO: 8425 - DNA, 30 bp, Homo sapiens
  misc_feature 1..30: note = chr6:27572883-27572913
  misc_feature 1..30: note = hyper
  source 1..30: mol_type = genomic DNA
gactgatcagttgaacggctaaggaaaaga

SEQ ID NO: 8426 - DNA, 267 bp, Homo sapiens
  misc_feature 1..267: note = chr6:27573326-27573593
  misc_feature 1..267: note = hyper
  source 1..267: mol_type = genomic DNA
tcttggaggtagaaacggctgaactattgtggcattccttggcgaaactttcggtacaaatctggtagggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaa

SEQ ID NO: 8427 - DNA, 188 bp, Homo sapiens
  misc_feature 1..188: note = chr6:27598672-27598860
  misc_feature 1..188: note = hyper
  source 1..188: mol_type = genomic DNA
agagatgctggactgcgaatgcaggcgcgctgcaggcgaggctgggagggccgccaggagcgctgcgggtatcgggagacacgcagagggaggggcaggcggcgggctccgcttcttcgcgtcctggctctgaaagcaaccacaggccagcggggcggtgctaggtgaagctacgaagaagccaaata

SEQ ID NO: 8428 - DNA, 81 bp, Homo sapiens
  misc_feature 1..81: note = chr6:27599260-27599341
  misc_feature 1..81: note = hyper
  source 1..81: mol_type = genomic DNA
ccgaggttgtgagttcgagcctcacctggagcatgttttcttccaattgcgatttcagacatttcacgataatgcattttt

SEQ ID NO: 8429 - DNA, 189 bp, Homo sapiens
  misc_feature 1..189: note = chr6:27635245-27635434
  misc_feature 1..189: note = hyper
  source 1..189: mol_type = genomic DNA
aagaatgaaaaacatcgaagctcctggtggtacttcggtctttaaccgttgaatacattaagagtaacactggaattccaacacttcctcgcgccagcgtcagttttagaatcaacaaaatcgttacttgctgattcatttaactgctaatatattcgttaaaagtttattaggcgtcagtgatcttga

SEQ ID NO: 8430 - DNA, 30 bp, Homo sapiens
  misc_feature 1..30: note = chr6:27636385-27636415
  misc_feature 1..30: note = hyper
  source 1..30: mol_type = genomic DNA
gcgtggtgctaataacgccaaggtcgcggg

SEQ ID NO: 8431 - DNA, 39 bp, Homo sapiens
  misc_feature 1..39: note = chr6:27647697-27647736
  misc_feature 1..39: note = hyper
  source 1..39: mol_type = genomic DNA
acctgtcttaaagttcgcgatttttaccaaaataggcca

SEQ ID NO: 8432 - DNA, 34 bp, Homo sapiens
  misc_feature 1..34: note = chr6:27648814-27648848
  misc_feature 1..34: note = hyper
  source 1..34: mol_type = genomic DNA
aaccgcaaactggttcgtgcgtaagaaggaatag

SEQ ID NO: 8433 - DNA, 239 bp, Homo sapiens
  misc_feature 1..239: note = chr6:27661759-27661998
  misc_feature 1..239: note = hyper
  source 1..239: mol_type = genomic DNA
taaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacct

SEQ ID NO: 8434 - DNA, 225 bp, Homo sapiens
  misc_feature 1..225: note = chr6:27774914-27775139
  misc_feature 1..225: note = hyper
  source 1..225: mol_type = genomic DNA
tggagcctggcctggcggtgtcaaacgcattctggtctcatctttttagaaacccgtggatgctcaaggaatttccggataacgtgatcccggatgcgcttgactgacttacacggaacgagcaaagcgcaaagcagtccctgctaaggacttagtttatgccctcaagcgcaaaggtcggaccctctatggtgttggtagctatatgcacgtacctcatgtaca

SEQ ID NO: 8435 - DNA, 120 bp, Homo sapiens
  misc_feature 1..120: note = chr6:27782468-27782588
  misc_feature 1..120: note = hyper
  source 1..120: mol_type = genomic DNA
gtcttggccttggcgcgagctttgcctccctgcttaccacgcccagacatggcaaaaggtctattacctttacggtcaagaaagactgaaatgaaattggaaaaacgtacattttatagc

SEQ ID NO: 8436 - DNA, 64 bp, Homo sapiens
  misc_feature 1..64: note = chr6:27834196-27834260
  misc_feature 1..64: note = hyper
  source 1..64: mol_type = genomic DNA
cgaacacattagtgacgccgaagtagctggtgcctaaatggcttaaacgcggaaaaaccacata

SEQ ID NO: 8437 - DNA, 51 bp, Homo sapiens
  misc_feature 1..51: note = chr6:27834803-27834854
  misc_feature 1..51: note = hyper
  source 1..51: mol_type = genomic DNA
tttgacgccagccgccgcgggcttcttcgccttcttcggagtcttcttcac

SEQ ID NO: 8438 - DNA, 19 bp, Homo sapiens
  misc_feature 1..19: note = chr6:27835078-27835097
  misc_feature 1..19: note = hyper
  source 1..19: mol_type = genomic DNA
ccacgtcgtagccaccggc

SEQ ID NO: 8439 - DNA, 884 bp, Homo sapiens; identical to SEQ ID NO: 2801
  misc_feature 1..884: note = chr6:27839689-27840573
  misc_feature 1..884: note = hyper
  source 1..884: mol_type = genomic DNA

SEQ ID NO: 8440 - DNA, 49 bp, Homo sapiens
  misc_feature 1..49: note = chr6:27858327-27858376
  misc_feature 1..49: note = hyper
  source 1..49: mol_type = genomic DNA
ggttttgaaatcctgcgcgatttctcgcaccaggcgctgaaatggcagt

SEQ ID NO: 8441 - DNA, 292 bp, Homo sapiens
  misc_feature 1..292: note = chr6:28175300-28175592
  misc_feature 1..292: note = hyper
  source 1..292: mol_type = genomic DNA
gcagggcgagaatggcgttaactatgtcaccaccgcccaaattccctataatttaccacttatcgttcctggctttattctccgtgcgtgcagggacatgtaattctctaggagacggtggtccggacttggttcccgactccctcgtggctgcaaacaggggcagctgatttgggtggatgcagaggttgtggccaggggaagggccgcggggcagcgcgtagaactgattgtaaacccaacttcccgcctcggagcgagccgcggctcggagtagcgtcattcgaaagcc

SEQ ID NO: 8442 - DNA, 446 bp, Homo sapiens; identical to SEQ ID NO: 2802
  misc_feature 1..446: note = chr6:28175836-28176282
  misc_feature 1..446: note = hyper
  source 1..446: mol_type = genomic DNA

SEQ ID NO: 8443 - DNA, 225 bp, Homo sapiens; identical to SEQ ID NO: 544
  misc_feature 1..225: note = chr6:28367054-28367279
  misc_feature 1..225: note = hyper
  source 1..225: mol_type = genomic DNA

SEQ ID NO: 8444 - DNA, 67 bp, Homo sapiens; identical to SEQ ID NO: 545
  misc_feature 1..67: note = chr6:28367280-28367347
  misc_feature 1..67: note = hyper
  source 1..67: mol_type = genomic DNA

SEQ ID NO: 8445 - DNA, 81 bp, Homo sapiens; identical to SEQ ID NO: 546
  misc_feature 1..81: note = chr6:28367490-28367571
  misc_feature 1..81: note = hyper
  source 1..81: mol_type = genomic DNA

SEQ ID NO: 8446 - DNA, 243 bp, Homo sapiens; identical to SEQ ID NO: 547
  misc_feature 1..243: note = chr6:28367572-28367815
  misc_feature 1..243: note = hyper
  source 1..243: mol_type = genomic DNA

SEQ ID NO: 8447 - DNA, 16 bp, Homo sapiens
  misc_feature 1..16: note = chr6:28411014-28411030
  misc_feature 1..16: note = hyper
  source 1..16: mol_type = genomic DNA
agcccttccaggctgc

SEQ ID NO: 8448 - DNA, 57 bp, Homo sapiens; identical to SEQ ID NO: 549
  misc_feature 1..57: note = chr6:28411031-28411088
  misc_feature 1..57: note = hyper
  source 1..57: mol_type = genomic DNA

SEQ ID NO: 8449 - DNA, 241 bp, Homo sapiens; identical to SEQ ID NO: 550
  misc_feature 1..241: note = chr6:28411151-28411392
  misc_feature 1..241: note = hyper
  source 1..241: mol_type = genomic DNA

SEQ ID NO: 8450 - DNA, 15 bp, Homo sapiens
  misc_feature 1..15: note = chr6:28414977-28414992
  misc_feature 1..15: note = hyper
  source 1..15: mol_type = genomic DNA
tcaaaccctttcagg

SEQ ID NO: 8451 - DNA, 28 bp, Homo sapiens
  misc_feature 1..28: note = chr6:28415091-28415119
  misc_feature 1..28: note = hyper
  source 1..28: mol_type = genomic DNA
cgttcccctttatcggctctattgccag

SEQ ID NO: 8452 - DNA, 30 bp, Homo sapiens
  misc_feature 1..30: note = chr6:28457825-28457855
  misc_feature 1..30: note = hyper
  source 1..30: mol_type = genomic DNA
gggacccgcccagaacgctttcgtggggtt

SEQ ID NO: 8453 - DNA, 76 bp, Homo sapiens
  misc_feature 1..76: note = chr6:34433517-34433593
  misc_feature 1..76: note = hyper
  source 1..76: mol_type = genomic DNA
cagggagcaacatcccgggctccgagcgcgccagctgggagggctggggaggagggcgcaccggagggctcccggc

SEQ ID NO: 8454 - DNA, 71 bp, Homo sapiens
  misc_feature 1..71: note = chr6:35181353-35181424
  misc_feature 1..71: note = hyper
  source 1..71: mol_type = genomic DNA
tgtttggtctggagccgagcggagcttgcattgatccattgattgcgcgcggtctgcgcctgacctccctg

SEQ ID NO: 8455 - DNA, 187 bp, Homo sapiens; identical to SEQ ID NO: 551
  misc_feature 1..187: note = chr6:36252984-36253171
  misc_feature 1..187: note = hyper
  source 1..187: mol_type = genomic DNA

SEQ ID NO: 8456 - DNA, 53 bp, Homo sapiens
  misc_feature 1..53: note = chr6:36806954-36807007
  misc_feature 1..53: note = hyper
  source 1..53: mol_type = genomic DNA
actctgggaagggggcgcgcggaggtttaggatcgaagcggcaggggccgcgg

SEQ ID NO: 8457 - DNA, 127 bp, Homo sapiens
  misc_feature 1..127: note = chr6:36808176-36808303
  misc_feature 1..127: note = hyper
  source 1..127: mol_type = genomic DNA
tctctgctgagtgtgcgccctactcgggggcgggtctcagttcagaaacagaccctacatctccttctggggaggtgtgtgggggcgaccccagtgccaggagggactacctcggtttcccagtggc

SEQ ID NO: 8458 - DNA, 294 bp, Homo sapiens
  misc_feature 1..294: note = chr6:37664165-37664459
  misc_feature 1..294: note = hyper
  source 1..294: mol_type = genomic DNA
gccaggacgaggtttcggtgcaagtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttg

SEQ ID NO: 8459 - DNA, 56 bp, Homo sapiens
  misc_feature 1..56: note = chr6:37673293-37673349
  misc_feature 1..56: note = hyper
  source 1..56: mol_type = genomic DNA
aaagggggtggggggcgggaaatctggcgtggacttggaggcgttcagcacacccg

SEQ ID NO: 8460 - DNA, 80 bp, Homo sapiens
  misc_feature 1..80: note = chr6:39016550-39016630
  misc_feature 1..80: note = hyper
  source 1..80: mol_type = genomic DNA
cccgggatcagtctccgcacgcggttccgcaggtggcagcgatggcccagtcctgaactccccgccatggccggcgcccc

SEQ ID NO: 8461 - DNA, 251 bp, Homo sapiens
  misc_feature 1..251: note = chr6:39016678-39016929
  misc_feature 1..251: note = hyper
  source 1..251: mol_type = genomic DNA
cggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttc

SEQ ID NO: 8462 - DNA, 218 bp, Homo sapiens
  misc_feature 1..218: note = chr6:39281088-39281306
  misc_feature 1..218: note = hyper
  source 1..218: mol_type = genomic DNA
gcctttctgggcagccgcgcggcggcggcgcgcccagtccttgtgtccgaagactcggagtaaagcgggttcagccagagagcggccctgcgtccgccctcctctcgaacccgggtctgcgcacgtcgagccccctctctgcgttgagggtggccccgaccagcacgcctcgggcccaatccacccaccctccgggacaaacgcgccttcccccaggc

SEQ ID NO: 8463 - DNA, 358 bp, Homo sapiens
  misc_feature 1..358: note = chr6:39281616-39281974
  misc_feature 1..358: note = hyper
  source 1..358: mol_type = genomic DNA
ctcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatcccgccgcgcccaggccgacgccgctcgcccctgacccggatcagcgagtccagcgccgggcggtccagacacgtgaagttctgcaacagctcccacttgtcgcgctggaagctgcggctggagtcctgcgccgcgcggccctccagcgtc

SEQ ID NO: 8464 - DNA, 30 bp, Homo sapiens
  misc_feature 1..30: note = chr6:39902189-39902219
  misc_feature 1..30: note = hyper
  source 1..30: mol_type = genomic DNA
cgggagcacactggccgggcactcgccccc

SEQ ID NO: 8465 - DNA, 148 bp, Homo sapiens
  misc_feature 1..148: note = chr6:40554589-40554737
  misc_feature 1..148: note = hyper
  source 1..148: mol_type = genomic DNA
agttcccggttccctcgggtgcgttcagccccgcgccgagctcccgcggacacccgggatcgcaaagacgcagcgccggcgaccactcacctgggcgaggcagcatctacccccggctgggtggcaccgaggccggctccgcggggcg

SEQ ID NO: 8466 - DNA, 164 bp, Homo sapiens
  misc_feature 1..164: note = chr6:41337045-41337209
  misc_feature 1..164: note = hyper
  source 1..164: mol_type = genomic DNA
gccagggagtggaaacgccggaggtcctcaggctggggatcccggagtcctcgctcagattccgattccggagaaggccaattccgggaccctatccatgtcccattccgggcaccttcctcaaaagtaggggtgggaggggcataagccggtcaagtatttcc

SEQ ID NO: 8467 - DNA, 296 bp, Homo sapiens
  misc_feature 1..296: note = chr6:41339263-41339559
  misc_feature 1..296: note = hyper
  source 1..296: mol_type = genomic DNA
ccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagt

SEQ ID NO: 8468 - DNA, 363 bp, Homo sapiens
  misc_feature 1..363: note = chr6:41339601-41339964
  misc_feature 1..363: note = hyper
  source 1..363: mol_type = genomic DNA
cgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacc

SEQ ID NO: 8469 - DNA, 125 bp, Homo sapiens
  misc_feature 1..125: note = chr6:41340913-41341038
  misc_feature 1..125: note = hyper
  source 1..125: mol_type = genomic DNA
acagcggggtacggccggagtccgccccagcccccgcgccggagctgcgggtggcagggtcgggccgcggtaacccgagccgccgcgccggctccccgcgcgctgccctccgcctgccccttcgc

SEQ ID NO: 8470 - DNA, 48 bp, Homo sapiens
  misc_feature 1..48: note = chr6:41341501-41341549
  misc_feature 1..48: note = hyper
  source 1..48: mol_type = genomic DNA
cctggacagaccaggcgagcctcgctcctggtgcgggagctagttttc

SEQ ID NO: 8471 - DNA, 245 bp, Homo sapiens
  misc_feature 1..245: note = chr6:41342779-41343024
  misc_feature 1..245: note = hyper
  source 1..245: mol_type = genomic DNA
gggtccttcaaaaagcgccactttggagacggtgataaatctgcgctgcctgagtcgttcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttc

SEQ ID NO: 8472 - DNA, 32 bp, Homo sapiens
  misc_feature 1..32: note = chr6:41343650-41343682
  misc_feature 1..32: note = hyper
  source 1..32: mol_type = genomic DNA
tctttgaaaatggaacgcgactttcagacaag

SEQ ID NO: 8473 - DNA, 15 bp, Homo sapiens
  misc_feature 1..15: note = chr6:41605937-41605952
  misc_feature 1..15: note = hyper
  source 1..15: mol_type = genomic DNA
cagagagcagggagt

SEQ ID NO: 8474 - DNA, 320 bp, Homo sapiens; identical to SEQ ID NO: 2812
  misc_feature 1..320: note = chr6:41606037-41606357
  misc_feature 1..320: note = hyper
  source 1..320: mol_type = genomic DNA

SEQ ID NO: 8475 - DNA, 42 bp, Homo sapiens; identical to SEQ ID NO: 2813
  misc_feature 1..42: note = chr6:41606527-41606569
  misc_feature 1..42: note = hyper
  source 1..42: mol_type = genomic DNA

SEQ ID NO: 8476 - DNA, 46 bp, Homo sapiens
  misc_feature 1..46: note = chr6:42879523-42879569
  misc_feature 1..46: note = hyper
  source 1..46: mol_type = genomic DNA
tagggacacctgccccgctccctccccctcccgggggggaacccac

SEQ ID NO: 8477 - DNA, 53 bp, Homo sapiens
  misc_feature 1..53: note = chr6:42879621-42879674
  misc_feature 1..53: note = hyper
  source 1..53: mol_type = genomic DNA
cggcctccaggcagccctgggaaagcaagggccgggagcgcagccctggaggc

SEQ ID NO: 8478 - DNA, 15 bp, Homo sapiens
  misc_feature 1..15: note = chr6:43612884-43612899
  misc_feature 1..15: note = hyper
  source 1..15: mol_type = genomic DNA
ggcagggcctcagcc

SEQ ID NO: 8479 - DNA, 78 bp, Homo sapiens
  misc_feature 1..78: note = chr6:43613052-43613130
  misc_feature 1..78: note = hyper
  source 1..78: mol_type = genomic DNA
cgctctataggtgaggaggcccccgggacgggctccccagagggtggctacctggaggcagggcggggtgggcgggtc

SEQ ID NO: 8480 - DNA, 57 bp, Homo sapiens
  misc_feature 1..57: note = chr6:45387985-45388042
  misc_feature 1..57: note = hyper
  source 1..57: mol_type = genomic DNA
aagggctccagagtccgcgactggcaccaggcccccatcttccgtgcccctcatgct

SEQ ID NO: 8481 - DNA, 30 bp, Homo sapiens
  misc_feature 1..30: note = chr6:45388359-45388389
  misc_feature 1..30: note = hyper
  source 1..30: mol_type = genomic DNA
actgatgatttttttcgcaaacacgttttc

SEQ ID NO: 8482 - DNA, 369 bp, Homo sapiens
  misc_feature 1..369: note = chr6:45391172-45391541
  misc_feature 1..369: note = hyper
  source 1..369: mol_type = genomic DNA
ctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcaggg

SEQ ID NO: 8483 - DNA, 931 bp, Homo sapiens
  misc_feature 1..931: note = chr6:46702594-46703525
  misc_feature 1..931: note = hyper
  source 1..931: mol_type = genomic DNA
gagagaaaaaaaagaaaagaaaactccatgtgttccctgcctgtcctgattctccccccagctctgagctcttagggttgcttcctttcgggaaaaggtttggaagaactggtgtctaataccgtcatcctctccctctccccgcaaggatcctagcgctgtttccgagggctgcagggactgtgagcccaggaccggccagcagagcgggtgcgactcagcgagcccaccccggccggtcgccgctccggggtcccgacctccagcgcggcgaccgtgcccttcctcccactcccgcctcgcccccggggcccctcctcactcaggcgcggcgcggagctgctcgcgggaactggggtccctgggcgcgttccaccgcgcaccaacgcgacccaagcgctccaaacccgactgcttctcgccgacagcactgcgagcctccgaccagccgctgtccccctggctgcgggccgagcagctctggcaggcggcgggcgggtgggctgcgcgcgggctgtgtcctgggtccgcctagcgcggccttgtggccccgaccctctcctcccctggtgatgctggaggaggtaccggggaggagcgtgtgtggccccggcctctcactagcagcggcggctcccgacgctagcctgctcgagcgcacccagcaccctccccaagaccatggcccgcacctggacccgcggttaacttagcccgccgcggagagagccaggcaatgcctgggtggtgtcgtgctcaccagctcctttccgcagacctgatgccgatcagatttactccctgctgaattcaccccccagtcaggccggttttccttgtttcaccgtgttctctgaatacactgaattactccgagcatctatagttggcaatgccctgcgcattttccgcactccgatacactttacac

SEQ ID NO: 8484 - DNA, 348 bp, Homo sapiens
  misc_feature 1..348: note = chr6:50674363-50674711
  misc_feature 1..348: note = hyper
  source 1..348: mol_type = genomic DNA
gttaccagggggtcccggggccagcgcggaattcgcggaattcaccaagccgcagctgcctgccgctgaatgcgaagagggcgcaggagactggcaggtacagctggtggtcccttcggcctgatttccctgctgagtgccacagcgtccgagatccacgactggccaggtggagccaccgactctgaagagaaccagaggcggaccagccaggggagagggcaaccctgggagcactgcacccttgtcggtcccctggaaagctagcggtaagatccgggaggctgaatttgaggccgcggtagtccaggcgacttcccctggaaggtgtgacgatgacttgtactg

SEQ ID NO: 8485 - DNA, 460 bp, Homo sapiens; identical to SEQ ID NO: 2814
  misc_feature 1..460: note = chr6:50681604-50682064
  misc_feature 1..460: note = hyper
  source 1..460: mol_type = genomic DNA

SEQ ID NO: 8486 - DNA, 20 bp, Homo sapiens
  misc_feature 1..20: note = chr6:50682319-50682339
  misc_feature 1..20: note = hyper
  source 1..20: mol_type = genomic DNA
tgattttgagcagcccgggc

SEQ ID NO: 8487 - DNA, 236 bp, Homo sapiens; identical to SEQ ID NO: 2816
  misc_feature 1..236: note = chr6:50682448-50682684
  misc_feature 1..236: note = hyper
  source 1..236: mol_type = genomic DNA

SEQ ID NO: 8488 - DNA, 230 bp, Homo sapiens; identical to SEQ ID NO: 2817
  misc_feature 1..230: note = chr6:50682711-50682941
  misc_feature 1..230: note = hyper
  source 1..230: mol_type = genomic DNA

SEQ ID NO: 8489 - DNA, 64 bp, Homo sapiens; identical to SEQ ID NO: 2818
  misc_feature 1..64: note = chr6:50682991-50683055
  misc_feature 1..64: note = hyper
  source 1..64: mol_type = genomic DNA

SEQ ID NO: 8490 - DNA, 30 bp, Homo sapiens
  misc_feature 1..30: note = chr6:50689980-50690010
  misc_feature 1..30: note = hyper
  source 1..30: mol_type = genomic DNA
actttaccctgtgctcgcgtatcgatagct

SEQ ID NO: 8491 - DNA, 49 bp, Homo sapiens
  misc_feature 1..49: note = chr6:50690631-50690680
  misc_feature 1..49: note = hyper
  source 1..49: mol_type = genomic DNA
gaagcttaaacactgcggtagcctctgggccacgcgaagagggagcgga

SEQ ID NO: 8492 - DNA, 304 bp, Homo sapiens; identical to SEQ ID NO: 552
  misc_feature 1..304: note = chr6:50691909-50692213
  misc_feature 1..304: note = hyper
  source 1..304: mol_type = genomic DNA

SEQ ID NO: 8493 - DNA, 213 bp, Homo sapiens; identical to SEQ ID NO: 553
  misc_feature 1..213: note = chr6:50692299-50692512
  misc_feature 1..213: note = hyper
  source 1..213: mol_type = genomic DNA

SEQ ID NO: 8494 - DNA, 561 bp, Homo sapiens
  misc_feature 1..561: note = chr6:50787316-50787877
  misc_feature 1..561: note = hyper
  source 1..561: mol_type = genomic DNA
tgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtgg

SEQ ID NO: 8495 - DNA, 61 bp, Homo sapiens
  misc_feature 1..61: note = chr6:50788317-50788378
  misc_feature 1..61: note = hyper
  source 1..61: mol_type = genomic DNA
tggtggggattgtttcggttcggcctccttttctttccttaacaggcgggataatggtaaa

SEQ ID NO: 8496 - DNA, 318 bp, Homo sapiens; identical to SEQ ID NO: 554
  misc_feature 1..318: note = chr6:50791177-50791495
  misc_feature 1..318: note = hyper
  source 1..318: mol_type = genomic DNA

SEQ ID NO: 8497 - DNA, 36 bp, Homo sapiens; identical to SEQ ID NO: 555
  misc_feature 1..36: note = chr6:50791550-50791586
  misc_feature 1..36: note = hyper
  source 1..36: mol_type = genomic DNA

SEQ ID NO: 8498 - DNA, 30 bp, Homo sapiens
  misc_feature 1..30: note = chr6:50793374-50793404
  misc_feature 1..30: note = hyper
  source 1..30: mol_type = genomic DNA
gtgaacggagcacctcggggccaagttgtt

SEQ ID NO: 8499 - DNA, 77 bp, Homo sapiens
  misc_feature 1..77: note = chr6:50794608-50794685
  misc_feature 1..77: note = hyper
  source 1..77: mol_type = genomic DNA
tgagttgtttttctgcgcttccgcatgcagtcctaattaaatctttacgatcctccctgtgacgattaagcgccagc

SEQ ID NO: 8500 - DNA, 58 bp, Homo sapiens
  misc_feature 1..58: note = chr6:50803834-50803892
  misc_feature 1..58: note = hyper
  source 1..58: mol_type = genomic DNA
catgtctgtcaacaccggcgaggtgttttgctccgtcccaggccgtttgtctctgctc

SEQ ID NO: 8501 - DNA, 216 bp, Homo sapiens; identical to SEQ ID NO: 556
  misc_feature 1..216: note = chr6:50804152-50804368
  misc_feature 1..216: note = hyper
  source 1..216: mol_type = genomic DNA

SEQ ID NO: 8502 - DNA, 59 bp, Homo sapiens
  misc_feature 1..59: note = chr6:50808681-50808740
  misc_feature 1..59: note = hyper
  source 1..59: mol_type = genomic DNA
cgcggcccaaacagccgcgctcatttatttagtgttggaggacgcggtttgtcccgttg

SEQ ID NO: 8503 - DNA, 87 bp, Homo sapiens; identical to SEQ ID NO: 557
  misc_feature 1..87: note = chr6:50810627-50810714
  misc_feature 1..87: note = hyper
  source 1..87: mol_type = genomic DNA

SEQ ID NO: 8504 - DNA, 30 bp, Homo sapiens
  misc_feature 1..30: note = chr6:50811838-50811868
  misc_feature 1..30: note = hyper
  source 1..30: mol_type = genomic DNA
cagagcaggttctggcggctgaggaaaatc

SEQ ID NO: 8505 - DNA, 490 bp, Homo sapiens; identical to SEQ ID NO: 558
  misc_feature 1..490: note = chr6:50813325-50813815
  misc_feature 1..490: note = hyper
  source 1..490: mol_type = genomic DNA

SEQ ID NO: 8506 - DNA, 332 bp, Homo sapiens
  misc_feature 1..332: note = chr6:50818676-50819008
  misc_feature 1..332: note = hyper
  source 1..332: mol_type = genomic DNA
gactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 8507 - DNA, 134 bp, Homo sapiens
  misc_feature 1..134: note = chr6:55443894-55444028
  misc_feature 1..134: note = hyper
  source 1..134: mol_type = genomic DNA
gaggaggatgaggggcgggcaccgcgctgggaaactgcgccagctcgggagcgcgcccctccggtgcactggctgtgaggaccagagctgttctgcgcactgcggcggcgccgagagggcggggagtggggcgt

SEQ ID NO: 8508 - DNA, 213 bp, Homo sapiens
  misc_feature 1..213: note = chr6:56112173-56112386
  misc_feature 1..213: note = hyper
  source 1..213: mol_type = genomic DNA
tgtctccttacctggcgcagtgtccaggctcggggttgccgtcgcagccagctgagtgttgcgccagggggacaggtatgttccaggcagtggcaagcccaacccgagcaagacctgcgctgaaacggattggctgccctccgcccggagtccgttctccctgcagcggccagtgcagagctcagaggctcagaaactcgctctcagccccct

SEQ ID NO: 8509 - DNA, 55 bp, Homo sapiens
  misc_feature 1..55: note = chr6:56716640-56716695
  misc_feature 1..55: note = hyper
  source 1..55: mol_type = genomic DNA
acatgaagatttgcacggaagaagtgtgtggcctgtggtccggccaccagctcac

SEQ ID NO: 8510 - DNA, 527 bp, Homo sapiens; identical to SEQ ID NO: 559
  misc_feature 1..527: note = chr6:56818720-56819247
  misc_feature 1..527: note = hyper
  source 1..527: mol_type = genomic DNA

SEQ ID NO: 8511 - DNA, 59 bp, Homo sapiens
  misc_feature 1..59: note = chr6:56820782-56820841
  misc_feature 1..59: note = hyper
  source 1..59: mol_type = genomic DNA
cagtgtgcctttctgcggacggccacggccacctggccaggaagcggctgctgcagcag

SEQ ID NO: 8512 - DNA, 83 bp, Homo sapiens; identical to SEQ ID NO: 2827
  misc_feature 1..83: note = chr6:58147428-58147511
  misc_feature 1..83: note = hyper
  source 1..83: mol_type = genomic DNA

SEQ ID NO: 8513 - DNA, 214 bp, Homo sapiens; identical to SEQ ID NO: 2828
  misc_feature 1..214: note = chr6:58147762-58147976
  misc_feature 1..214: note = hyper
  source 1..214: mol_type = genomic DNA

SEQ ID NO: 8514 - DNA, 420 bp, Homo sapiens; identical to SEQ ID NO: 560
  misc_feature 1..420: note = chr6:62995455-62995875
  misc_feature 1..420: note = hyper
  source 1..420: mol_type = genomic DNA

SEQ ID NO: 8515 - DNA, 53 bp, Homo sapiens; identical to SEQ ID NO: 561
  misc_feature 1..53: note = chr6:62996077-62996130
  misc_feature 1..53: note = hyper
  source 1..53: mol_type = genomic DNA

SEQ ID NO: 8516 - DNA, 83 bp, Homo sapiens; identical to SEQ ID NO: 562
  misc_feature 1..83: note = chr6:62996131-62996214
  misc_feature 1..83: note = hyper
  source 1..83: mol_type = genomic DNA

SEQ ID NO: 8517 - DNA, 181 bp, Homo sapiens; identical to SEQ ID NO: 563
  misc_feature 1..181: note = chr6:62996215-62996396
  misc_feature 1..181: note = hyper
  source 1..181: mol_type = genomic DNA

SEQ ID NO: 8518 - DNA, 30 bp, Homo sapiens
  misc_feature 1..30: note = chr6:69345066-69345096
  misc_feature 1..30: note = hyper
  source 1..30: mol_type = genomic DNA
gcgcggcacccgggacgcgcgcgcacacga

SEQ ID NO: 8519 - DNA, 30 bp, Homo sapiens
  misc_feature 1..30: note = chr6:69345341-69345371
  misc_feature 1..30: note = hyper
  source 1..30: mol_type = genomic DNA
gaggagggaggaaagcggaaagaggaaaaa

SEQ ID NO: 8520 - DNA, 174 bp, Homo sapiens
  misc_feature 1..174: note = chr6:69942843-69943017
  misc_feature 1..174: note = hyper
  source 1..174: mol_type = genomic DNA
ggaagtggctgccaacgctctggcggctgctcgtgctgccgccgctgccgctgctgttcctcgcatagggctggacagagctagtcccggtttcagcacctccggcgctggacagctctctgcacgccgcaccgccgcctgcttgctttttcccactctcgctttgcattactg

SEQ ID NO: 8521 - DNA, 26 bp, Homo sapiens
  misc_feature 1..26: note = chr6:70992136-70992162
  misc_feature 1..26: note = hyper
  source 1..26: mol_type = genomic DNA
cgtcccggagccgccagcaccgctag

SEQ ID NO: 8522 - DNA, 58 bp, Homo sapiens; identical to SEQ ID NO: 2833
  misc_feature 1..58: note = chr6:70992440-70992498
  misc_feature 1..58: note = hyper
  source 1..58: mol_type = genomic DNA

SEQ ID NO: 8523 - DNA, 207 bp, Homo sapiens
  misc_feature 1..207: note = chr6:70992853-70993060
  misc_feature 1..207: note = hyper
  source 1..207: mol_type = genomic DNA
cagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctcc

SEQ ID NO: 8524 - DNA, 190 bp, Homo sapiens
  misc_feature 1..190: note = chr6:71666491-71666681
  misc_feature 1..190: note = hyper
  source 1..190: mol_type = genomic DNA
ccgagaagcggcacccggtgcgcctcgccgctccagtccggcggtgctgcgggcacaagggctccagccgcgggcccccaggacgctctctgggacgccttcgagggcgggcggcggcgctgggggctttccttcctcacattcccgccggggtggcgaggagcgggtggagacgctgggggttgtgtcc

SEQ ID NO: 8525 - DNA, 280 bp, Homo sapiens
  misc_feature 1..280: note = chr6:71666698-71666978
  misc_feature 1..280: note = hyper
  source 1..280: mol_type = genomic DNA
cgcagcggaagcctgctctcagtcccttgctcttgtcttctcagaacctctccggatccagcagcaagatcccaaagcaaggaaagaaagaaaaagcgagggggcgggggcgctgcagaatccagcgtcctcccaagtcctcctgtgggaagacagcagcgctgctactggtggagaggggctgcgagagggaggcgcggagggaccccttggctctccgccgggtctggcgctaacggccccgcgagcaagctcgggaggcggccgctgcaccgcgggt

SEQ ID NO: 8526 - DNA, 30 bp, Homo sapiens
  misc_feature 1..30: note = chr6:72129768-72129798
  misc_feature 1..30: note = hyper
  source 1..30: mol_type = genomic DNA
ccgcagcccgaggtgcgggagccctcggac

SEQ ID NO: 8527 - DNA, 22 bp, Homo sapiens
  misc_feature 1..22: note = chr6:72130023-72130045
  misc_feature 1..22: note = hyper
  source 1..22: mol_type = genomic DNA
gggggctgggcgagccgggaga

SEQ ID NO: 8528 - DNA, 31 bp, Homo sapiens
  misc_feature 1..31: note = chr6:72130190-72130221
  misc_feature 1..31: note = hyper
  source 1..31: mol_type = genomic DNA
cgccgccgccgcccaccgcgttctttgtgtg

SEQ ID NO: 8529 - DNA, 75 bp, Homo sapiens
  misc_feature 1..75: note = chr6:72596060-72596135
  misc_feature 1..75: note = hyper
  source 1..75: mol_type = genomic DNA
tgtaggggtagcggccggggcacgcgtggctcggacccggggagtgggcgggtgggtgcccgtgggcggagcggc

SEQ ID NO: 8530 - DNA, 87 bp, Homo sapiens
  misc_feature 1..87: note = chr6:72596136-72596223
  misc_feature 1..87: note = hyper
  source 1..87: mol_type = genomic DNA
ccgggactgagtggctggcagctatgtctgcgagagcagcggcatcaccctggatggaagcctctgagactccgcctaactgacacc

SEQ ID NO: 8531 - DNA, 32 bp, Homo sapiens
  misc_feature 1..32: note = chr6:72596950-72596982
  misc_feature 1..32: note = hyper
  source 1..32: mol_type = genomic DNA
cactcccctagtcctcgcggctgagtgtgggg

SEQ ID NO: 8532 - DNA, 150 bp, Homo sapiens; identical to SEQ ID NO: 564
  misc_feature 1..150: note = chr6:73329801-73329951
  misc_feature 1..150: note = hyper
  source 1..150: mol_type = genomic DNA

SEQ ID NO: 8533 - DNA, 30 bp, Homo sapiens
  misc_feature 1..30: note = chr6:73330633-73330663
  misc_feature 1..30: note = hyper
  source 1..30: mol_type = genomic DNA
tgcggccagtggcaccgtggcctctctctc

SEQ ID NO: 8534 - DNA, 164 bp, Homo sapiens; identical to SEQ ID NO: 565
  misc_feature 1..164: note = chr6:73330950-73331114
  misc_feature 1..164: note = hyper
  source 1..164: mol_type = genomic DNA

SEQ ID NO: 8535 - DNA, 123 bp, Homo sapiens; identical to SEQ ID NO: 566
  misc_feature 1..123: note = chr6:73331115-73331238
  misc_feature 1..123: note = hyper
  source 1..123: mol_type = genomic DNA

SEQ ID NO: 8536 - DNA, 390 bp, Homo sapiens; identical to SEQ ID NO: 567
  misc_feature 1..390: note = chr6:73331239-73331629
  misc_feature 1..390: note = hyper
  source 1..390: mol_type = genomic DNA

SEQ ID NO: 8537 - DNA, 37 bp, Homo sapiens
  misc_feature 1..37: note = chr6:73331883-73331920
  misc_feature 1..37: note = hyper
  source 1..37: mol_type = genomic DNA
ctggcggccccctcgcggtgcccgtggtgatgccatg

SEQ ID NO: 8538 - DNA, 329 bp, Homo sapiens; identical to SEQ ID NO: 2838
  misc_feature 1..329: note = chr6:73332136-73332465
  misc_feature 1..329: note = hyper
  source 1..329: mol_type = genomic DNA

SEQ ID NO: 8539 - DNA, 302 bp, Homo sapiens
  misc_feature 1..302: note = chr6:73332675-73332977
  misc_feature 1..302: note = hyper
  source 1..302: mol_type = genomic DNA
caaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctccc

SEQ ID NO: 8540 - DNA, 681 bp, Homo sapiens
  misc_feature 1..681: note = chr6:74019413-74020094
  misc_feature 1..681: note = hyper
  source 1..681: mol_type = genomic DNA
cagcctctggaaggccgacagcatttcgcgtttctggcctgggaaagtaagggtgcgctaaggcacgagtagtacagctcctcccgccaccgcagagcccgccggcgggaagagaccagacaccgacggagaagcgaagttcaggacgcgaaggaaagggccacttcgggtcggggtcaacccagactggaccaatgcacagtctaggtggattaacgcgccaccgcgagaagtgggcacgggaccacatgcggctggcaagacgtcccagggctcaagctccaggctcggtcaccaaacaacggtgataacatccacaacgccacgtaaaccatctttgggccttgatcgttttccaataaccgactgaactgagggcgtgaccaaacgacaagaaccggaggagaggacccggagaacggagcagcatcccgccgcccgcctccaggaaagcccgaggcactgtagcaggagggtctgggctccgcgccttaattacaccgccctggacccgcctcttccgccgctcgctcctctgaccggcacccgaaggtgctgtcccgcccacggactcgctcacactccgtttcttcgatcctttagacgactttttaccgttcagggatgctctccgttaccgcctctgccatttggttgccctccctgcggtccaagggcctg

SEQ ID NO: 8541 - DNA, 63 bp, Homo sapiens
  misc_feature 1..63: note = chr6:74405916-74405979
  misc_feature 1..63: note = hyper
  source 1..63: mol_type = genomic DNA
agcccaggcagacgccgtcgagatgcagggcccaccgctcctgaccgccgcccacctcctctg

SEQ ID NO: 8542 - DNA, 30 bp, Homo sapiens
  misc_feature 1..30: note = chr6:75914569-75914599
  misc_feature 1..30: note = hyper
  source 1..30: mol_type = genomic DNA
caaaggagagcttagcgtttatttcctttc

SEQ ID NO: 8543 - DNA, 72 bp, Homo sapiens
  misc_feature 1..72: note = chr6:75915049-75915121
  misc_feature 1..72: note = hyper
  source 1..72: mol_type = genomic DNA
ccctccaaagaattccgcaccgtgcgtcaccaaaataccttcccagcgcccccgccgcacgcctgccctccc

SEQ ID NO: 8544 - DNA, 36 bp, Homo sapiens
  misc_feature 1..36: note = chr6:75915170-75915206
  misc_feature 1..36: note = hyper
  source 1..36: mol_type = genomic DNA
cggcgcgccctccattgaaatcgacagcatctacag

SEQ ID NO: 8545 - DNA, 90 bp, Homo sapiens
  misc_feature 1..90: note = chr6:75915711-75915801
  misc_feature 1..90: note = hyper
  source 1..90: mol_type = genomic DNA
tgagcctgcagctgccggcgcgcggacgcgtctggggcggttcgccttagccaagtggaaagagactccgcgccgcgggctacttaatag

SEQ ID NO: 8546 - DNA, 153 bp, Homo sapiens
  misc_feature 1..153: note = chr6:75916306-75916459
  misc_feature 1..153: note = hyper
  source 1..153: mol_type = genomic DNA
ctaactgtctgtacacgcggcgcgccttctgtctttttcaatctccaagcgcgattggaaacccggacagccgcccgcgcggggctcagtgatgggatggctttcccagtcctttctcactcccctggtgcttcaggacggaactgggaggct

SEQ ID NO: 8547 - DNA, 174 bp, Homo sapiens
  misc_feature 1..174: note = chr6:78172322-78172496
  misc_feature 1..174: note = hyper
  source 1..174: mol_type = genomic DNA
cgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgt

SEQ ID NO: 8548 - DNA, 95 bp, Homo sapiens
  misc_feature 1..95: note = chr6:78173771-78173866
  misc_feature 1..95: note = hyper
  source 1..95: mol_type = genomic DNA
cggacgagctgccccgcggagacggagccataaaaggggggacacgggggctggagttgcggctgctcgggccgcgccgccgccaccgccaccct

SEQ ID NO: 8549 - DNA, 30 bp, Homo sapiens
  misc_feature 1..30: note = chr6:78176103-78176133
  misc_feature 1..30: note = hyper
  source 1..30: mol_type = genomic DNA
aatttgttccccacacggtttttggcttta

SEQ ID NO: 8550 - DNA, 33 bp, Homo sapiens
  misc_feature 1..33: note = chr6:78176496-78176529
  misc_feature 1..33: note = hyper
  source 1..33: mol_type = genomic DNA
ctctgcagtccccagcggcgctagaaggaacct

SEQ ID NO: 8551 - DNA, 30 bp, Homo sapiens
  misc_feature 1..30: note = chr6:78176804-78176834
  misc_feature 1..30: note = hyper
  source 1..30: mol_type = genomic DNA
gcggtgagctggctgcggaggaaccaaaga

SEQ ID NO: 8552 - DNA, 42 bp, Homo sapiens
  misc_feature 1..42: note = chr6:79620753-79620795
  misc_feature 1..42: note = hyper
  source 1..42: mol_type = genomic DNA
tttattgccaagggtcgggatggccttcgtgtcctctgcagc

SEQ ID NO: 8553 - DNA, 560 bp, Homo sapiens; identical to SEQ ID NO: 2839
  misc_feature 1..560: note = chr6:80656673-80657233
  misc_feature 1..560: note = hyper
  source 1..560: mol_type = genomic DNA

SEQ ID NO: 8554 - DNA, 70 bp, Homo sapiens
  misc_feature 1..70: note = chr6:80657499-80657569
  misc_feature 1..70: note = hyper
  source 1..70: mol_type = genomic DNA
ctcattagccttccccgcccctgtcccgggcatcggcccctgcggaggagttcaccgcctccccacgggt

SEQ ID NO: 8555 - DNA, 272 bp, Homo sapiens; identical to SEQ ID NO: 568
  misc_feature 1..272: note = chr6:84417429-84417701
  misc_feature 1..272: note = hyper
  source 1..272: mol_type = genomic DNA

SEQ ID NO: 8556 - DNA, 52 bp, Homo sapiens
  misc_feature 1..52: note = chr6:84418260-84418312
  misc_feature 1..52: note = hyper
  source 1..52: mol_type = genomic DNA
cgccgccggctccaaagcctcgccgaggcccatcgcccgggccccttccccc

SEQ ID NO: 8557 - DNA, 116 bp, Homo sapiens
  misc_feature 1..116: note = chr6:84418570-84418686
  misc_feature 1..116: note = hyper
  source 1..116: mol_type = genomic DNA
ctgagcggcgccgcccgccgcaggatgagcggagcccgggccgccgagggaagccgcgccggtggatgtgtgcgaccgcgcgtagccccggtgcccccgggcgcaaagtctccagc

SEQ ID NO: 8558 - DNA, 100 bp, Homo sapiens; identical to SEQ ID NO: 2841
  misc_feature 1..100: note = chr6:84419102-84419202
  misc_feature 1..100: note = hyper
  source 1..100: mol_type = genomic DNA

SEQ ID NO: 8559 - DNA, 126 bp, Homo sapiens; identical to SEQ ID NO: 2842
  misc_feature 1..126: note = chr6:84419203-84419329
  misc_feature 1..126: note = hyper
  source 1..126: mol_type = genomic DNA

SEQ ID NO: 8560 - DNA, 61 bp, Homo sapiens; identical to SEQ ID NO: 2843
  misc_feature 1..61: note = chr6:84419330-84419391
  misc_feature 1..61: note = hyper
  source 1..61: mol_type = genomic DNA

SEQ ID NO: 8561 - DNA, 110 bp, Homo sapiens; identical to SEQ ID NO: 2844
  misc_feature 1..110: note = chr6:84562820-84562930
  misc_feature 1..110: note = hyper
  source 1..110: mol_type = genomic DNA

SEQ ID NO: 8562 - DNA, 354 bp, Homo sapiens; identical to SEQ ID NO: 2845
  misc_feature 1..354: note = chr6:84562931-84563285
  misc_feature 1..354: note = hyper
  source 1..354: mol_type = genomic DNA

SEQ ID NO: 8563 - DNA, 437 bp, Homo sapiens; identical to SEQ ID NO: 2846
  misc_feature 1..437: note = chr6:84563416-84563853
  misc_feature 1..437: note = hyper
  source 1..437: mol_type = genomic DNA

SEQ ID NO: 8564 - DNA, 30 bp, Homo sapiens
  misc_feature 1..30: note = chr6:85471966-85471996
  misc_feature 1..30: note = hyper
  source 1..30: mol_type = genomic DNA
tataaccgccctgaacgcagaacatcaacc

SEQ ID NO: 8565 - DNA, 866 bp, Homo sapiens; identical to SEQ ID NO: 569
  misc_feature 1..866: note = chr6:85472401-85473267
  misc_feature 1..866: note = hyper
  source 1..866: mol_type = genomic DNA

SEQ ID NO: 8566 - DNA, 694 bp, Homo sapiens; identical to SEQ ID NO: 570
  misc_feature 1..694: note = chr6:85473508-85474202
  misc_feature 1..694: note = hyper
  source 1..694: mol_type = genomic DNA

SEQ ID NO: 8567 - DNA, 139 bp, Homo sapiens
  misc_feature 1..139: note = chr6:85474485-85474624
  misc_feature 1..139: note = hyper
  source 1..139: mol_type = genomic DNA
gatgtgccagccacacggacgctgaactctgtctctctgacgtccgtagctgagtccagccccgtagtctccagctttcctcaccaggacctggaaaggcggaagttcccggctttaaactagacgttcaacaagttag

SEQ ID NO: 8568 - DNA, 30 bp, Homo sapiens
  misc_feature 1..30: note = chr6:85476233-85476263
  misc_feature 1..30: note = hyper
  source 1..30: mol_type = genomic DNA
ctagagagtttgggccgggagtgggagtgg

SEQ ID NO: 8569 - DNA, 140 bp, Homo sapiens
  misc_feature 1..140: note = chr6:85476998-85477138
  misc_feature 1..140: note = hyper
  source 1..140: mol_type = genomic DNA
agcccactccaacctcggctcctggagaaggggcgtcgaatctctcttgggcatgggagggaaagacattccgagttggctgggcggagtggcagccttgagagtgacgagtgacagcaaagcctcgtcctagcaaggcc

SEQ ID NO: 8570 - DNA, 119 bp, Homo sapiens; identical to SEQ ID NO: 571
  misc_feature 1..119: note = chr6:85482703-85482822
  misc_feature 1..119: note = hyper
  source 1..119: mol_type = genomic DNA

SEQ ID NO: 8571 - DNA, 30 bp, Homo sapiens
  misc_feature 1..30: note = chr6:85483316-85483346
  misc_feature 1..30: note = hyper
  source 1..30: mol_type = genomic DNA
tcagggagcgcggaacgcgggtttctgttg

SEQ ID NO: 8572 - DNA, 173 bp, Homo sapiens
  misc_feature 1..173: note = chr6:85483759-85483932
  misc_feature 1..173: note = hyper
  source 1..173: mol_type = genomic DNA
cgcttcaggcggtaggtgtggagtacctgggcagctccggcgggaatggtgttggggagaaggagctgtcattcatagtcttctacatatctgaataaagaattgctttttaaaaataggttcagagcctagtgagtgaaaacttaaaagtccccgcgaggagctctagttcc

SEQ ID NO: 8573 - DNA, 69 bp, Homo sapiens; identical to SEQ ID NO: 2850
  misc_feature 1..69: note = chr6:85484557-85484626
  misc_feature 1..69: note = hyper
  source 1..69: mol_type = genomic DNA

SEQ ID NO: 8574 - DNA, 217 bp, Homo sapiens; identical to SEQ ID NO: 2851
  misc_feature 1..217: note = chr6:85484716-85484933
  misc_feature 1..217: note = hyper
  source 1..217: mol_type = genomic DNA

SEQ ID NO: 8575 - DNA, 83 bp, Homo sapiens
  misc_feature 1..83: note = chr6:86159807-86159890
  misc_feature 1..83: note = hyper
  source 1..83: mol_type = genomic DNA
ggcactcgcccggctcgcccgctttcgcacccagttcacgcgccacagctatgtgtccccgagccgcgcgggcgcccgcgacg

SEQ ID NO: 8576 - DNA, 171 bp, Homo sapiens
  misc_feature 1..171: note = chr6:87861962-87862133
  misc_feature 1..171: note = hyper
  source 1..171: mol_type = genomic DNA
gcgccccgatagtggcgcacgctctccgccatccccgggcctcgcgctttcacctcgcgtgctggggcgagggcggggctgcggggtgtactgggtcgggggtaggaaggacctgccaggccttagccctgagctatccgtcatccgctaacgccgcgctccctgcatccc

SEQ ID NO: 8577 - DNA, 30 bp, Homo sapiens
  misc_feature 1..30: note = chr6:88875485-88875515
  misc_feature 1..30: note = hyper
  source 1..30: mol_type = genomic DNA
aaaagtatttccaaacgcaactctgccagg

SEQ ID NO: 8578 - DNA, 103 bp, Homo sapiens
  misc_feature 1..103: note = chr6:88875796-88875899
  misc_feature 1..103: note = hyper
  source 1..103: mol_type = genomic DNA
agtggggtgtgcctccggcgggcggtcagcaagtcagtccgtccgagcgccggcgtcccggtctccagcgcccgcccgcgacagcgaccgggactggcgcccc

SEQ ID NO: 8579 - DNA, 175 bp, Homo sapiens; identical to SEQ ID NO: 2852
  misc_feature 1..175: note = chr6:88876302-88876477
  misc_feature 1..175: note = hyper
  source 1..175: mol_type = genomic DNA

SEQ ID NO: 8580 - DNA, 111 bp, Homo sapiens; identical to SEQ ID NO: 2853
  misc_feature 1..111: note = chr6:88876630-88876741
  misc_feature 1..111: note = hyper
  source 1..111: mol_type = genomic DNA

SEQ ID NO: 8581 - DNA, 322 bp, Homo sapiens; identical to SEQ ID NO: 2854
  misc_feature 1..322: note = chr6:88876742-88877064
  misc_feature 1..322: note = hyper
  source 1..322: mol_type = genomic DNA

SEQ ID NO: 8582 - DNA, 208 bp, Homo sapiens; identical to SEQ ID NO: 2855
  misc_feature 1..208: note = chr6:88877065-88877273
  misc_feature 1..208: note = hyper
  source 1..208: mol_type = genomic DNA

SEQ ID NO: 8583 - DNA, 155 bp, Homo sapiens
  misc_feature 1..155: note = chr6:90143450-90143605
  misc_feature 1..155: note = hyper
  source 1..155: mol_type = genomic DNA
ccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaag

SEQ ID NO: 8584 - DNA, 350 bp, Homo sapiens
  misc_feature 1..350: note = chr6:91004829-91005179
  misc_feature 1..350: note = hyper
  source 1..350: mol_type = genomic DNA
actgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccct

SEQ ID NO: 8585 - DNA, 106 bp, Homo sapiens
  misc_feature 1..106: note = chr6:91005208-91005314
  misc_feature 1..106: note = hyper
  source 1..106: mol_type = genomic DNA
cgcccgccgccgtctccagcggcgccgggctcccgaacacccgccgggtgagcgaagcacagcggggccacggagcgcctcgacgcggggacggggagggcagtgt

SEQ ID NO: 8586 - DNA, 932 bp, Homo sapiens
  misc_feature 1..932: note = chr6:91320320-91321252
  misc_feature 1..932: note = hyper
  source 1..932: mol_type = genomic DNA
ttatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcagtttgggcaggggagcgagggccgggaggcgtctaggctgtggcgaggggagaagcatcccccatccctccgctccccgtctcgctcaagctcttcctgcgccacgggcaggtctcccagcctcgccatcgcggggcgtccccgtcccggcccacacctctttcctctccagccacaccggcgcgccccgagggttgcaggcgggggctgcaccgggttgaagcccagtcaaccacacgtcccagggcttaggcgccgggcggggacaacgtgtctgcctgggctcagacgctgctagggggca

SEQ ID NO: 8587 - DNA, 43 bp, Homo sapiens
  misc_feature 1..43: note = chr6:94126380-94126423
  misc_feature 1..43: note = hyper
  source 1..43: mol_type = genomic DNA
ctcggagcagagtgccgacctccctttgcgcccgcggaggcgc

SEQ ID NO: 8588 - DNA, 110 bp, Homo sapiens
  misc_feature 1..110: note = chr6:94126643-94126753
  misc_feature 1..110: note = hyper
  source 1..110: mol_type = genomic DNA
gccaagcatccattacgcctctgccagacctgggcactccagggagccggtggcgccctcgctcgagaaggagtcgggaagaggagagtggctttcgggaagaggagagt

SEQ ID NO: 8589 - DNA, 36 bp, Homo sapiens
  misc_feature 1..36: note = chr6:94127088-94127124
  misc_feature 1..36: note = hyper
  source 1..36: mol_type = genomic DNA
cgcctagaagccgggcgcactcgccgcccgccagcc

SEQ ID NO: 8590 - DNA, 184 bp, Homo sapiens; identical to SEQ ID NO: 2856
  misc_feature 1..184: note = chr6:94127476-94127660
  misc_feature 1..184: note = hyper
  source 1..184: mol_type = genomic DNA

SEQ ID NO: 8591 - DNA, 39 bp, Homo sapiens
  misc_feature 1..39: note = chr6:94128439-94128478
  misc_feature 1..39: note = hyper
  source 1..39: mol_type = genomic DNA
gtaacccgagctttccgagctcatcgaagtctcggtccc

SEQ ID NO: 8592 - DNA, 36 bp, Homo sapiens
  misc_feature 1..36: note = chr6:94128713-94128749
  misc_feature 1..36: note = hyper
  source 1..36: mol_type = genomic DNA
ccgcgccagaaatcccgcacccgtcggatggacggc

SEQ ID NO: 8593 - DNA, 224 bp, Homo sapiens
  misc_feature 1..224: note = chr6:94129182-94129406
  misc_feature 1..224: note = hyper
  source 1..224: mol_type = genomic DNA
cgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggcca

SEQ ID NO: 8594 - DNA, 32 bp, Homo sapiens
  misc_feature 1..32: note = chr6:94129782-94129814
  misc_feature 1..32: note = hyper
  source 1..32: mol_type = genomic DNA
tgttgttagaacctccgcgggctgggtaactt

SEQ ID NO: 8595 - DNA, 93 bp, Homo sapiens
  misc_feature 1..93: note = chr6:96463220-96463313
  misc_feature 1..93: note = hyper
  source 1..93: mol_type = genomic DNA
gctccaaggggcaggcgatggttgccggcattgagctccctgctggcgccttctggcgggacagccagtgccaaagagcgcccagggaaacaa

SEQ ID NO: 8596 - DNA, 34 bp, Homo sapiens
  misc_feature 1..34: note = chr6:96464100-96464134
  misc_feature 1..34: note = hyper
  source 1..34: mol_type = genomic DNA
gagagtgcagggggtcgggcgtcaaagcttggcg

SEQ ID NO: 8597 - DNA, 736 bp, Homo sapiens; identical to SEQ ID NO: 572
  misc_feature 1..736: note = chr6:99271926-99272662
  misc_feature 1..736: note = hyper
  source 1..736: mol_type = genomic DNA

SEQ ID NO: 8598 - DNA, 30 bp, Homo sapiens
  misc_feature 1..30: note = chr6:99273871-99273901
  misc_feature 1..30: note = hyper
  source 1..30: mol_type = genomic DNA
tttcctggactgagacgttgactggtgacc

SEQ ID NO: 8599 - DNA, 150 bp, Homo sapiens; identical to SEQ ID NO: 573
  misc_feature 1..150: note = chr6:99277180-99277330
  misc_feature 1..150: note = hyper
  source 1..150: mol_type = genomic DNA

SEQ ID NO: 8600 - DNA, 184 bp, Homo sapiens
  misc_feature 1..184: note = chr6:99279556-99279740
  misc_feature 1..184: note = hyper
  source 1..184: mol_type = genomic DNA
caaccgggcccctggcgcctggaggggaggcggcggtagctcgtggggaggtgttgctcagagccgcggtgcgagcccagcctggcccgcccggtgattggccgcgcttgggggtgggggtggggtgcagagactgaggccccgggtaggctatttctttgtgtactcccggggatttattggg

SEQ ID NO: 8601 - DNA, 194 bp, Homo sapiens
  misc_feature 1..194: note = chr6:99280516-99280710
  misc_feature 1..194: note = hyper
  source 1..194: mol_type = genomic DNA
cggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcag

SEQ ID NO: 8602 - skipped

SEQ ID NO: 8603 - DNA, 79 bp, Homo sapiens
  misc_feature 1..79: note = chr6:99281067-99281146
  misc_feature 1..79: note = hyper
  source 1..79: mol_type = genomic DNA
cgcgcccaagttctagctaccgggcttgcaggctcggaaactcgcaggcggcacctgctctgggcggctaaagaactga

SEQ ID NO: 8604 - DNA, 123 bp, Homo sapiens
  misc_feature 1..123: note = chr6:99281355-99281478
  misc_feature 1..123: note = hyper
  source 1..123: mol_type = genomic DNA
ttcccaaggggctaacggaaaagttgcacctaccagcggtaggagcacggggaatcgcgcacgcaggccctccgcgcggcttcccggagcggcctttggcgactgcgccgcccctacaaggcc

SEQ ID NO: 8605 - DNA, 95 bp, Homo sapiens
  misc_feature 1..95: note = chr6:99282778-99282873
  misc_feature 1..95: note = hyper
  source 1..95: mol_type = genomic DNA
cctgctcacctccagcgcctccatcgtgcacgccgagccgcccggcggcatgcagcagggcgcggggggctaccgcgaagcgcagagcctggtgc

SEQ ID NO: 8606 - DNA, 98 bp, Homo sapiens
  misc_feature 1..98: note = chr6:99283408-99283506
  misc_feature 1..98: note = hyper
  source 1..98: mol_type = genomic DNA
cgagccacaccatgccgaccaccacccgcacccgcactcgcacccacaccagcagccgccgcccccgccgcccccgcagggtccgcctggccacccag

SEQ ID NO: 8607 - DNA, 113 bp, Homo sapiens
  misc_feature 1..113: note = chr6:99290360-99290473
  misc_feature 1..113: note = hyper
  source 1..113: mol_type = genomic DNA
ctcggggaccctggccgctgtcgcgaaggcccagacagcctagctcggccgcgcggggaggagagagacagggaaaggagcggggcactccctgcactcccagccccggcctt

SEQ ID NO: 8608 - DNA, 30 bp, Homo sapiens
  misc_feature 1..30: note = chr6:99291312-99291342
  misc_feature 1..30: note = hyper
  source 1..30: mol_type = genomic DNA
ccagagctgagggcccggaaagtgaggggc

SEQ ID NO: 8609 - DNA, 269 bp, Homo sapiens
  misc_feature 1..269: note = chr6:99292252-99292521
  misc_feature 1..269: note = hyper
  source 1..269: mol_type = genomic DNA
agcctggtctcccagcgccgtgcccgccgcccccgccccatcctgcgccccagatgcgcgccccgcttggaccagtccgagcagaggggggttccgaaatctgctcggacgcagcatcgctggccgcctgccccgctagttccccgagtgcgattactttttaaaggctcctttaagcatatttccgtgaatctgtttcttgtgctttaatgttactattaattgataagatcagctcatcaaacatactatttcgatagggaattgta

SEQ ID NO: 8610 - DNA, 105 bp, Homo sapiens; identical to SEQ ID NO: 574
  misc_feature 1..105: note = chr6:99295759-99295864
  misc_feature 1..105: note = hyper
  source 1..105: mol_type = genomic DNA

SEQ ID NO: 8611 - DNA, 304 bp, Homo sapiens; identical to SEQ ID NO: 575
  misc_feature 1..304: note = chr6:99296061-99296365
  misc_feature 1..304: note = hyper
  source 1..304: mol_type = genomic DNA

SEQ ID NO: 8612 - DNA, 49 bp, Homo sapiens; identical to SEQ ID NO: 576
  misc_feature 1..49: note = chr6:99296407-99296456
  misc_feature 1..49: note = hyper
  source 1..49: mol_type = genomic DNA

SEQ ID NO: 8613 - DNA, 46 bp, Homo sapiens; identical to SEQ ID NO: 577
  misc_feature 1..46: note = chr6:100038661-100038707
  misc_feature 1..46: note = hyper
  source 1..46: mol_type = genomic DNA

SEQ ID NO: 8614 - DNA, 369 bp, Homo sapiens; identical to SEQ ID NO: 578
  misc_feature 1..369: note = chr6:100038785-100039154
  misc_feature 1..369: note = hyper
  source 1..369: mol_type = genomic DNA

SEQ ID NO: 8615 - DNA, 251 bp, Homo sapiens; identical to SEQ ID NO: 579
  misc_feature 1..251: note = chr6:100050858-100051109
  misc_feature 1..251: note = hyper
  source 1..251: mol_type = genomic DNA

SEQ ID NO: 8616 - DNA, 149 bp, Homo sapiens; identical to SEQ ID NO: 580
  misc_feature 1..149: note = chr6:100051359-100051508
  misc_feature 1..149: note = hyper
  source 1..149: mol_type = genomic DNA

SEQ ID NO: 8617 - DNA, 187 bp, Homo sapiens; identical to SEQ ID NO: 581
  misc_feature 1..187: note = chr6:100051771-100051958
  misc_feature 1..187: note = hyper
  source 1..187: mol_type = genomic DNA

SEQ ID NO: 8618 - DNA, 212 bp, Homo sapiens
  misc_feature 1..212: note = chr6:100053299-100053511
  misc_feature 1..212: note = hyper
  source 1..212: mol_type = genomic DNA
ggtgtcgccaccttgcgtcctgccacccttgctaaccacaatcgctccagcactttcagccgacaaagcctcgaggagaagctagcgtgggcgctgctgagggccctctgcccttttgtgcagtggttgggcctctggcgctaggcttggaaatacaccaccactcaggcctctcttggaagaactgcatcgggctccggtgctggctgcat

SEQ ID NO: 8619 - DNA, 70 bp, Homo sapiens
  misc_feature 1..70: note = chr6:100054866-100054936
  misc_feature 1..70: note = hyper
  source 1..70: mol_type = genomic DNA
aggacctggagcacccgagcgcctgcctggtggcggcggcaacaatgcacggagccgccagagcgccagc

SEQ ID NO: 8620 - DNA, 52 bp, Homo sapiens
  misc_feature 1..52: note = chr6:100055281-100055333
  misc_feature 1..52: note = hyper
  source 1..52: mol_type = genomic DNA
gtggggtgcactgagcgctgtaggtgccgggaccattcgcagcttgtgtttt

SEQ ID NO: 8621 - DNA, 430 bp, Homo sapiens; identical to SEQ ID NO: 2867
  misc_feature 1..430: note = chr6:100061022-100061452
  misc_feature 1..430: note = hyper
  source 1..430: mol_type = genomic DNA

SEQ ID NO: 8622 - DNA, 682 bp, Homo sapiens; identical to SEQ ID NO: 2868
  misc_feature 1..682: note = chr6:100061988-100062670
  misc_feature 1..682: note = hyper
  source 1..682: mol_type = genomic DNA

SEQ ID NO: 8623 - DNA, 178 bp, Homo sapiens
  misc_feature 1..178: note = chr6:100062910-100063088
  misc_feature 1..178: note = hyper
  source 1..178: mol_type = genomic DNA
cctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 8624 - DNA, 39 bp, Homo sapiens
  misc_feature 1..39: note = chr6:100067144-100067183
  misc_feature 1..39: note = hyper
  source 1..39: mol_type = genomic DNA
cgccggcgccatcgcgaggtcaagcgtgacccttggcca

SEQ ID NO: 8625 - DNA, 30 bp, Homo sapiens
  misc_feature 1..30: note = chr6:100067397-100067427
  misc_feature 1..30: note = hyper
  source 1..30: mol_type = genomic DNA
ccttcaaaaagggaccgaaagtgggtggac

SEQ ID NO: 8626 - skipped

SEQ ID NO: 8627 - DNA, 241 bp, Homo sapiens; identical to SEQ ID NO: 583
  misc_feature 1..241: note = chr6:100441497-100441738
  misc_feature 1..241: note = hyper
  source 1..241: mol_type = genomic DNA

SEQ ID NO: 8628 - DNA, 337 bp, Homo sapiens; identical to SEQ ID NO: 584
  misc_feature 1..337: note = chr6:100441761-100442098
  misc_feature 1..337: note = hyper
  source 1..337: mol_type = genomic DNA

SEQ ID NO: 8629 - DNA, 21 bp, Homo sapiens
  misc_feature 1..21: note = chr6:100903384-100903405
  misc_feature 1..21: note = hyper
  source 1..21: mol_type = genomic DNA
tctctttctaaatcccggctc

SEQ ID NO: 8630 - DNA, 90 bp, Homo sapiens
  misc_feature 1..90: note = chr6:100905969-100906059
  misc_feature 1..90: note = hyper
  source 1..90: mol_type = genomic DNA
cgagtttgggcttcccgtagggatagagcctgcgggccaacctggctgcccgagttggagccagccgcgaaaagacggcagaaacccaag

SEQ ID NO: 8631 - DNA, 43 bp, Homo sapiens
  misc_feature 1..43: note = chr6:100912403-100912446
  misc_feature 1..43: note = hyper
  source 1..43: mol_type = genomic DNA
gggtgggaggcgccgcggcctctcccacaccaccgcggagctg

SEQ ID NO: 8632 - DNA, 15 bp, Homo sapiens
  misc_feature 1..15: note = chr6:100912465-100912480
  misc_feature 1..15: note = hyper
  source 1..15: mol_type = genomic DNA
cggggcgtcttctgc

SEQ ID NO: 8633 - DNA, 132 bp, Homo sapiens; identical to SEQ ID NO: 585
  misc_feature 1..132: note = chr6:100912919-100913051
  misc_feature 1..132: note = hyper
  source 1..132: mol_type = genomic DNA

SEQ ID NO: 8634 - DNA, 30 bp, Homo sapiens
  misc_feature 1..30: note = chr6:100915720-100915750
  misc_feature 1..30: note = hyper
  source 1..30: mol_type = genomic DNA
agaaagaagggggagcgggcacctcaaggg

SEQ ID NO: 8635 - DNA, 59 bp, Homo sapiens; identical to SEQ ID NO: 2874
  misc_feature 1..59: note = chr6:101840708-101840767
  misc_feature 1..59: note = hyper
  source 1..59: mol_type = genomic DNA

SEQ ID NO: 8636 - DNA, 238 bp, Homo sapiens
  misc_feature 1..238: note = chr6:101841128-101841366
  misc_feature 1..238: note = hyper
  source 1..238: mol_type = genomic DNA
gcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtc

SEQ ID NO: 8637 - DNA, 54 bp, Homo sapiens
  misc_feature 1..54: note = chr6:101841599-101841653
  misc_feature 1..54: note = hyper
  source 1..54: mol_type = genomic DNA
ggcggctgcgctggtcggtctggtagctggggacttttccgcccgacctcctcc

SEQ ID NO: 8638 - DNA, 30 bp, Homo sapiens
  misc_feature 1..30: note = chr6:101850180-101850210
  misc_feature 1..30: note = hyper
  source 1..30: mol_type = genomic DNA
gacacatgcgccctccgggtgcatttggca

SEQ ID NO: 8639 - DNA, 104 bp, Homo sapiens; identical to SEQ ID NO: 586
  misc_feature 1..104: note = chr6:105389509-105389613
  misc_feature 1..104: note = hyper
  source 1..104: mol_type = genomic DNA

SEQ ID NO: 8640 - DNA, 30 bp, Homo sapiens
  misc_feature 1..30: note = chr6:105400913-105400943
  misc_feature 1..30: note = hyper
  source 1..30: mol_type = genomic DNA
tgtcaagaaagttaccgccaagtggtttac

SEQ ID NO: 8641 - DNA, 161 bp, Homo sapiens; identical to SEQ ID NO: 2876
  misc_feature 1..161: note = chr6:105401596-105401757
  misc_feature 1..161: note = hyper
  source 1..161: mol_type = genomic DNA

SEQ ID NO: 8642 - DNA, 111 bp, Homo sapiens
  misc_feature 1..111: note = chr6:105404519-105404630
  misc_feature 1..111: note = hyper
  source 1..111: mol_type = genomic DNA
taaatatgaaattagcgttccaagcaggtttactgccatggaatagctgaattcttaaggggaaaaaaagcgttaacatcggttgttttatttaaacgaccccctcccatg

SEQ ID NO: 8643 - DNA, 380 bp, Homo sapiens
  misc_feature 1..380: note = chr6:105405656-105406036
  misc_feature 1..380: note = hyper
  source 1..380: mol_type = genomic DNA
atacaagtaaagtatcgcatgctgtaatgtaaaatgtggctgaaaaatggagttaaatgaataagtacacgtatgtatagaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaat

SEQ ID NO: 8644 - DNA, 30 bp, Homo sapiens
  misc_feature 1..30: note = chr6:105406435-105406465
  misc_feature 1..30: note = hyper
  source 1..30: mol_type = genomic DNA
tgttcttgttgtttccggtattacctatac

SEQ ID NO: 8645 - DNA, 83 bp, Homo sapiens; identical to SEQ ID NO: 587
  misc_feature 1..83: note = chr6:105584133-105584216
  misc_feature 1..83: note = hyper
  source 1..83: mol_type = genomic DNA

SEQ ID NO: 8646 - DNA, 103 bp, Homo sapiens; identical to SEQ ID NO: 588
  misc_feature 1..103: note = chr6:105584217-105584320
  misc_feature 1..103: note = hyper
  source 1..103: mol_type = genomic DNA

SEQ ID NO: 8647 - DNA, 185 bp, Homo sapiens; identical to SEQ ID NO: 589
  misc_feature 1..185: note = chr6:105584366-105584551
  misc_feature 1..185: note = hyper
  source 1..185: mol_type = genomic DNA

SEQ ID NO: 8648 - DNA, 1015 bp, Homo sapiens; identical to SEQ ID NO: 590
  misc_feature 1..1015: note = chr6:105584552-105585567
  misc_feature 1..1015: note = hyper
  source 1..1015: mol_type = genomic DNA

SEQ ID NO: 8649 - DNA, 420 bp, Homo sapiens
  misc_feature 1..420: note = chr6:105627657-105628077
  misc_feature 1..420: note = hyper
  source 1..420: mol_type = genomic DNA
gacagcaccggaaggcggcggacgcagcgcccccgggctcaccttcttacctttccttcccagccctgcccggagcttcagcccggcgcccgcagaagtttcccggcggagcgcgcttgacccgggtggcccgcgcggaagccctcagcgtccccctcgtgagtgcctcgccgcccaccctgcggcgccgggcgcagcgtgaccgcagcgggctccggagcggcgcggcggcgcgggcgggtgccgggcacgggcgcgcgccccggggcgcagccgggtgggcgggcgcggcggctgcgtctgggccggggcaggcggttcggccaccggggtgcggggctgcggagaatcctagcggccgctacggaccgaagtttccaaagatgcggttccccgagtgtacaccgctcccggttgtaa

SEQ ID NO: 8650 - DNA, 427 bp, Homo sapiens; identical to SEQ ID NO: 591
  misc_feature 1..427: note = chr6:106429049-106429476
  misc_feature 1..427: note = hyper
  source 1..427: mol_type = genomic DNA

SEQ ID NO: 8651 - DNA, 35 bp, Homo sapiens; identical to SEQ ID NO: 592
  misc_feature 1..35: note = chr6:106429589-106429624
  misc_feature 1..35: note = hyper
  source 1..35: mol_type = genomic DNA

SEQ ID NO: 8652 - DNA, 47 bp, Homo sapiens
  misc_feature 1..47: note = chr6:106434211-106434258
  misc_feature 1..47: note = hyper
  source 1..47: mol_type = genomic DNA
tctcgggcacacgcgcggcttctgcccacccgcgtaaatgccctggg

SEQ ID NO: 8653 - DNA, 1251 bp, Homo sapiens; identical to SEQ ID NO: 593
  misc_feature 1..1251: note = chr6:106441869-106443120
  misc_feature 1..1251: note = hyper
  source 1..1251: mol_type = genomic DNA

SEQ ID NO: 8654 - DNA, 151 bp, Homo sapiens
  misc_feature 1..151: note = chr6:106960833-106960984
  misc_feature 1..151: note = hyper
  source 1..151: mol_type = genomic DNA
tggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctc

SEQ ID NO: 8655 - DNA, 34 bp, Homo sapiens
  misc_feature 1..34: note = chr6:108434966-108435000
  misc_feature 1..34: note = hyper
  source 1..34: mol_type = genomic DNA
cctcggggtcggagtcgcccgagtggagactgga

SEQ ID NO: 8656 - DNA, 715 bp, Homo sapiens; identical to SEQ ID NO: 2884
  misc_feature 1..715: note = chr6:108436072-108436787
  misc_feature 1..715: note = hyper
  source 1..715: mol_type = genomic DNA

SEQ ID NO: 8657 - DNA, 15 bp, Homo sapiens
  misc_feature 1..15: note = chr6:108438142-108438157
  misc_feature 1..15: note = hyper
  source 1..15: mol_type = genomic DNA
gcagcccaactgggg

SEQ ID NO: 8658 - DNA, 303 bp, Homo sapiens; identical to SEQ ID NO: 595
  misc_feature 1..303: note = chr6:108438260-108438563
  misc_feature 1..303: note = hyper
  source 1..303: mol_type = genomic DNA

SEQ ID NO: 8659 - DNA, 53 bp, Homo sapiens
  misc_feature 1..53: note = chr6:108438779-108438832
  misc_feature 1..53: note = hyper
  source 1..53: mol_type = genomic DNA
catgtgatgtgtgagcggtgtgtgatgtgcgtgtggtgcgaagaggggaggtg

SEQ ID NO: 8660 - DNA, 567 bp, Homo sapiens; identical to SEQ ID NO: 596
  misc_feature 1..567: note = chr6:108440078-108440645
  misc_feature 1..567: note = hyper
  source 1..567: mol_type = genomic DNA

SEQ ID NO: 8661 - DNA, 223 bp, Homo sapiens; identical to SEQ ID NO: 597
  misc_feature 1..223: note = chr6:108440744-108440967
  misc_feature 1..223: note = hyper
  source 1..223: mol_type = genomic DNA

SEQ ID NO: 8662 - DNA, 822 bp, Homo sapiens; identical to SEQ ID NO: 2889
  misc_feature 1..822: note = chr6:108478874-108479696
  misc_feature 1..822: note = hyper
  source 1..822: mol_type = genomic DNA

SEQ ID NO: 8663 - DNA, 246 bp, Homo sapiens; identical to SEQ ID NO: 2890
  misc_feature 1..246: note = chr6:108484872-108485118
  misc_feature 1..246: note = hyper
  source 1..246: mol_type = genomic DNA

SEQ ID NO: 8664 - DNA, 494 bp, Homo sapiens; identical to SEQ ID NO: 2891
  misc_feature 1..494: note = chr6:108485513-108486007
  misc_feature 1..494: note = hyper
  source 1..494: mol_type = genomic DNA

SEQ ID NO: 8665 - DNA, 386 bp, Homo sapiens; identical to SEQ ID NO: 2892
  misc_feature 1..386: note = chr6:108486008-108486394
  misc_feature 1..386: note = hyper
  source 1..386: mol_type = genomic DNA

SEQ ID NO: 8666 - DNA, 38 bp, Homo sapiens
  misc_feature 1..38: note = chr6:108487419-108487457
  misc_feature 1..38: note = hyper
  source 1..38: mol_type = genomic DNA
tctgcgcttgggttccggcagcgcggagcccgtctgcc

SEQ ID NO: 8667 - DNA, 665 bp, Homo sapiens; identical to SEQ ID NO: 598
  misc_feature 1..665: note = chr6:108487779-108488444
  misc_feature 1..665: note = hyper
  source 1..665: mol_type = genomic DNA

SEQ ID NO: 8668 - DNA, 79 bp, Homo sapiens; identical to SEQ ID NO: 599
  misc_feature 1..79: note = chr6:108489730-108489809
  misc_feature 1..79: note = hyper
  source 1..79: mol_type = genomic DNA

SEQ ID NO: 8669 - DNA, 180 bp, Homo sapiens; identical to SEQ ID NO: 600
  misc_feature 1..180: note = chr6:108490066-108490246
  misc_feature 1..180: note = hyper
  source 1..180: mol_type = genomic DNA

SEQ ID NO: 8670 - DNA, 219 bp, Homo sapiens; identical to SEQ ID NO: 601
  misc_feature 1..219: note = chr6:108490296-108490515
  misc_feature 1..219: note = hyper
  source 1..219: mol_type = genomic DNA

SEQ ID NO: 8671 - DNA, 60 bp, Homo sapiens; identical to SEQ ID NO: 602
  misc_feature 1..60: note = chr6:108490537-108490597
  misc_feature 1..60: note = hyper
  source 1..60: mol_type = genomic DNA

SEQ ID NO: 8672 - DNA, 41 bp, Homo sapiens; identical to SEQ ID NO: 2898
  misc_feature 1..41: note = chr6:108490960-108491001
  misc_feature 1..41: note = hyper
  source 1..41: mol_type = genomic DNA

SEQ ID NO: 8673 - DNA, 36 bp, Homo sapiens
  misc_feature 1..36: note = chr6:108491374-108491410
  misc_feature 1..36: note = hyper
  source 1..36: mol_type = genomic DNA
agtccccaacccaagcgctttcggcagcagctgtcg

SEQ ID NO: 8674 - DNA, 290 bp, Homo sapiens
  misc_feature 1..290: note = chr6:108492251-108492541
  misc_feature 1..290: note = hyper
  source 1..290: mol_type = genomic DNA
tcaagtttgtctcctcgcgcgctcactaacaactttctctgttaaatgcaaaagcgaaggagggaggcggccaaactttccgcggagcagaaaggcagtggagggccgcactgccgcccgggcctgctgtcatcttttattccaaaatgggtctcggcgattagaagagaaccaaatacatgtagcggtgcatgaataatgctcattgtaggaaactgacacttgctcaaggaaaaaaagtttgggtataaaatcacttcattatttgcttttaccgcagcttcggtgct

SEQ ID NO: 8675 - DNA, 551 bp, Homo sapiens; identical to SEQ ID NO: 603
  misc_feature 1..551: note = chr6:108495915-108496466
  misc_feature 1..551: note = hyper
  source 1..551: mol_type = genomic DNA

SEQ ID NO: 8676 - DNA, 39 bp, Homo sapiens
  misc_feature 1..39: note = chr6:110299546-110299585
  misc_feature 1..39: note = hyper
  source 1..39: mol_type = genomic DNA
cgcttgcctcctccccggcccggccgcctcctgcaggca

SEQ ID NO: 8677 - DNA, 460 bp, Homo sapiens; identical to SEQ ID NO: 2900
  misc_feature 1..460: note = chr6:110678940-110679400
  misc_feature 1..460: note = hyper
  source 1..460: mol_type = genomic DNA

SEQ ID NO: 8678 - DNA, 265 bp, Homo sapiens; identical to SEQ ID NO: 2901
  misc_feature 1..265: note = chr6:110679401-110679666
  misc_feature 1..265: note = hyper
  source 1..265: mol_type = genomic DNA

SEQ ID NO: 8679 - DNA, 103 bp, Homo sapiens
  misc_feature 1..103: note = chr6:111409667-111409770
  misc_feature 1..103: note = hyper
  source 1..103: mol_type = genomic DNA
ttttgtggtctctttcgtgactatgccagttatgtagttcttcacctgcctccctgggccgcagaggggtgtgcgtatgttggcggggcggggggtggagttt

SEQ ID NO: 8680 - DNA, 30 bp, Homo sapiens
  misc_feature 1..30: note = chr6:114663242-114663272
  misc_feature 1..30: note = hyper
  source 1..30: mol_type = genomic DNA
tttgctggcatcacccggatgcttcccttt

SEQ ID NO: 8681 - DNA, 208 bp, Homo sapiens; identical to SEQ ID NO: 604
  misc_feature 1..208: note = chr6:117086271-117086479
  misc_feature 1..208: note = hyper
  source 1..208: mol_type = genomic DNA

SEQ ID NO: 8682 - DNA, 160 bp, Homo sapiens; identical to SEQ ID NO: 605
  misc_feature 1..160: note = chr6:117086480-117086640
  misc_feature 1..160: note = hyper
  source 1..160: mol_type = genomic DNA

SEQ ID NO: 8683 - DNA, 55 bp, Homo sapiens; identical to SEQ ID NO: 2904
  misc_feature 1..55: note = chr6:117586007-117586062
  misc_feature 1..55: note = hyper
  source 1..55: mol_type = genomic DNA

SEQ ID NO: 8684 - DNA, 36 bp, Homo sapiens
  misc_feature 1..36: note = chr6:117586401-117586437
  misc_feature 1..36: note = hyper
  source 1..36: mol_type = genomic DNA
gagcccggatcccttcgtccccgcctccttctctct

SEQ ID NO: 8685 - DNA, 30 bp, Homo sapiens
  misc_feature 1..30: note = chr6:117587193-117587223
  misc_feature 1..30: note = hyper
  source 1..30: mol_type = genomic DNA
tcgcctgtttgctctcgggaagcagctaag

SEQ ID NO: 8686 - DNA, 30 bp, Homo sapiens
  misc_feature 1..30: note = chr6:117587572-117587602
  misc_feature 1..30: note = hyper
  source 1..30: mol_type = genomic DNA
taattttttcctttgcgaagttctgggagc

SEQ ID NO: 8687 - DNA, 310 bp, Homo sapiens; identical to SEQ ID NO: 606
  misc_feature 1..310: note = chr6:117591206-117591516
  misc_feature 1..310: note = hyper
  source 1..310: mol_type = genomic DNA

SEQ ID NO: 8688 - DNA, 75 bp, Homo sapiens
  misc_feature 1..75: note = chr6:117591753-117591828
  misc_feature 1..75: note = hyper
  source 1..75: mol_type = genomic DNA
atagcgcgtaccaggcgccagtgcccccgccgctgggcagccctctggccaccgcgcactcggagctgcccttcg

SEQ ID NO: 8689 - DNA, 39 bp, Homo sapiens
  misc_feature 1..39: note = chr6:117592099-117592138
  misc_feature 1..39: note = hyper
  source 1..39: mol_type = genomic DNA
cggcagtcctccctgcgagctctccggcaaaggcgagcc

SEQ ID NO: 8690 - DNA, 130 bp, Homo sapiens
  misc_feature 1..130: note = chr6:118228102-118228232
  misc_feature 1..130: note = hyper
  source 1..130: mol_type = genomic DNA
ggtggtgctggattccgcggcgcttgggcagaaacgaggaatccccgccaactccacagggaggatctattcccagcccccttatccccctaaaaaacacccaaaccaaaacaatcaccacaacctagac

SEQ ID NO: 8691 - DNA, 218 bp, Homo sapiens; identical to SEQ ID NO: 2906
  misc_feature 1..218: note = chr6:118228651-118228869
  misc_feature 1..218: note = hyper
  source 1..218: mol_type = genomic DNA

SEQ ID NO: 8692 - DNA, 344 bp, Homo sapiens; identical to SEQ ID NO: 2907
  misc_feature 1..344: note = chr6:118228870-118229214
  misc_feature 1..344: note = hyper
  source 1..344: mol_type = genomic DNA

SEQ ID NO: 8693 - DNA, 37 bp, Homo sapiens; identical to SEQ ID NO: 607
  misc_feature 1..37: note = chr6:118229695-118229732
  misc_feature 1..37: note = hyper
  source 1..37: mol_type = genomic DNA

SEQ ID NO: 8694 - DNA, 91 bp, Homo sapiens; identical to SEQ ID NO: 608
  misc_feature 1..91: note = chr6:118229733-118229824
  misc_feature 1..91: note = hyper
  source 1..91: mol_type = genomic DNA

SEQ ID NO: 8695 - DNA, 74 bp, Homo sapiens
  misc_feature 1..74: note = chr6:118241235-118241309
  misc_feature 1..74: note = hyper
  source 1..74: mol_type = genomic DNA
gtgacgccgggttcccggggctggctggagtctctgtacctatctggatcctgctgcaggccggggaaacactg

SEQ ID NO: 8696 - DNA, 45 bp, Homo sapiens
  misc_feature 1..45: note = chr6:119399159-119399204
  misc_feature 1..45: note = hyper
  source 1..45: mol_type = genomic DNA
ttttggaggtgtctccggctgttgcttcggcggaggagtagagtt

SEQ ID NO: 8697 - DNA, 90 bp, Homo sapiens
  misc_feature 1..90: note = chr6:121758632-121758722
  misc_feature 1..90: note = hyper
  source 1..90: mol_type = genomic DNA
ttcccgagaatgaggcggggcggctcaaggggaaagggcagggaggagagaccctcgggaagctgatgacgcgtccggggcaagtcagcc

SEQ ID NO: 8698 - DNA, 35 bp, Homo sapiens; identical to SEQ ID NO: 2910
  misc_feature 1..35: note = chr6:123316972-123317007
  misc_feature 1..35: note = hyper
  source 1..35: mol_type = genomic DNA

SEQ ID NO: 8699 - DNA, 642 bp, Homo sapiens; identical to SEQ ID NO: 2911
  misc_feature 1..642: note = chr6:123317072-123317714
  misc_feature 1..642: note = hyper
  source 1..642: mol_type = genomic DNA

SEQ ID NO: 8700 - DNA, 156 bp, Homo sapiens; identical to SEQ ID NO: 2912
  misc_feature 1..156: note = chr6:123317715-123317871
  misc_feature 1..156: note = hyper
  source 1..156: mol_type = genomic DNA

SEQ ID NO: 8701 - DNA, 292 bp, Homo sapiens
  misc_feature 1..292: note = chr6:124124311-124124603
  misc_feature 1..292: note = hyper
  source 1..292: mol_type = genomic DNA
ccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttg

SEQ ID NO: 8702 - DNA, 87 bp, Homo sapiens
  misc_feature 1..87: note = chr6:124124879-124124966
  misc_feature 1..87: note = hyper
  source 1..87: mol_type = genomic DNA
ctcgcgcgcttctgccgcccccggagccggcgcgcggcgagcgcagggcgagcgcgcgtcgggcggcggccgcgctggggggcgtga

SEQ ID NO: 8703 - DNA, 47 bp, Homo sapiens
  misc_feature 1..47: note = chr6:125282746-125282793
  misc_feature 1..47: note = hyper
  source 1..47: mol_type = genomic DNA
tcgaaagtgctttttcgattatttatgggtttcgaagattcttccta

SEQ ID NO: 8704 - DNA, 269 bp, Homo sapiens
  misc_feature 1..269: note = chr6:125283133-125283402
  misc_feature 1..269: note = hyper
  source 1..269: mol_type = genomic DNA
gggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggg

SEQ ID NO: 8705 - DNA, 239 bp, Homo sapiens
  misc_feature 1..239: note = chr6:125283925-125284164
  misc_feature 1..239: note = hyper
  source 1..239: mol_type = genomic DNA
gtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgcc

SEQ ID NO: 8706 - DNA, 33 bp, Homo sapiens
  misc_feature 1..33: note = chr6:125475551-125475584
  misc_feature 1..33: note = hyper
  source 1..33: mol_type = genomic DNA
agtgagaggatcgcccgccgagggggtggctcc

SEQ ID NO: 8707 - DNA, 94 bp, Homo sapiens
  misc_feature 1..94: note = chr6:125684588-125684682
  misc_feature 1..94: note = hyper
  source 1..94: mol_type = genomic DNA
aaataaaggcctccccgcacagccagccagcttcgttcattcacgtcaccgacaaacactcctagcaggcgttgttaaacgttcagggagcgcc

SEQ ID NO: 8708 - DNA, 110 bp, Homo sapiens; identical to SEQ ID NO: 2913
  misc_feature 1..110: note = chr6:126068068-126068178
  misc_feature 1..110: note = hyper
  source 1..110: mol_type = genomic DNA

SEQ ID NO: 8709 - DNA, 33 bp, Homo sapiens
  misc_feature 1..33: note = chr6:126069106-126069139
  misc_feature 1..33: note = hyper
  source 1..33: mol_type = genomic DNA
agccccacctggccccgccgagtgtgtgctttg

SEQ ID NO: 8710 - DNA, 225 bp, Homo sapiens
  misc_feature 1..225: note = chr6:126069350-126069575
  misc_feature 1..225: note = hyper
  source 1..225: mol_type = genomic DNA
cccgtctttcccagtcgcgtcctttcctcttctccccgccccgcgccgggcttgtgtggacagagaacggagtgtcaaagggacgccctgggccgatccccaggaagctatgaatccctccgtgacggaggggtctggggatcgatagacggccctttctcagaggctctctccactactgaccaagcggccctgccaacgtgtggtttccggctggaccccaac

SEQ ID NO: 8711 - DNA, 51 bp, Homo sapiens
  misc_feature 1..51: note = chr6:126069805-126069856
  misc_feature 1..51: note = hyper
  source 1..51: mol_type = genomic DNA
ccaatcttcacctcccggactctaactctgcggctgcgagtgcatacacca

SEQ ID NO: 8712 - DNA, 42 bp, Homo sapiens
  misc_feature 1..42: note = chr6:126071276-126071318
  misc_feature 1..42: note = hyper
  source 1..42: mol_type = genomic DNA
tgtcacagttggacgcgcgaacggcagcgtctgggcgacagg

SEQ ID NO: 8713 - DNA, 23 bp, Homo sapiens
  misc_feature 1..23: note = chr6:127439250-127439273
  misc_feature 1..23: note = hyper
  source 1..23: mol_type = genomic DNA
gggagagggtagttgcgcgccgg

SEQ ID NO: 8714 - DNA, 166 bp, Homo sapiens
  misc_feature 1..166: note = chr6:127439321-127439487
  misc_feature 1..166: note = hyper
  source 1..166: mol_type = genomic DNA
cggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttcccc

SEQ ID NO: 8715 - DNA, 354 bp, Homo sapiens
  misc_feature 1..354: note = chr6:127439838-127440192
  misc_feature 1..354: note = hyper
  source 1..354: mol_type = genomic DNA
acgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacag

SEQ ID NO: 8716 - DNA, 104 bp, Homo sapiens; identical to SEQ ID NO: 2914
  misc_feature 1..104: note = chr6:127440406-127440510
  misc_feature 1..104: note = hyper
  source 1..104: mol_type = genomic DNA

SEQ ID NO: 8717 - DNA, 452 bp, Homo sapiens; identical to SEQ ID NO: 2915
  misc_feature 1..452: note = chr6:127440511-127440963
  misc_feature 1..452: note = hyper
  source 1..452: mol_type = genomic DNA

SEQ ID NO: 8718 - DNA, 703 bp, Homo sapiens; identical to SEQ ID NO: 2916
  misc_feature 1..703: note = chr6:127441030-127441733
  misc_feature 1..703: note = hyper
  source 1..703: mol_type = genomic DNA

SEQ ID NO: 8719 - DNA, 50 bp, Homo sapiens
  misc_feature 1..50: note = chr6:127442021-127442071
  misc_feature 1..50: note = hyper
  source 1..50: mol_type = genomic DNA
cccactctttcattccggcccggacgcggaaggggaggcctggggttcag

SEQ ID NO: 8720 - DNA, 190 bp, Homo sapiens
  misc_feature 1..190: note = chr6:127442089-127442279
  misc_feature 1..190: note = hyper
  source 1..190: mol_type = genomic DNA
cggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccac

SEQ ID NO: 8721 - DNA, 329 bp, Homo sapiens
  misc_feature 1..329: note = chr6:127836715-127837044
  misc_feature 1..329: note = hyper
  source 1..329: mol_type = genomic DNA
ctcttggagctgctgcgggtgcggctgcgacgaagggggcgctgccgcctgcatgcccccgccgctcgcgctgccctctgcgctctgctgggggccctccgccgccgccgccattggggaggcggaggcgacggccagggtctcgcaaacggcaggggggccagacaccggggagctgcggctactgctgccgccgccgttcttagcgtgcatctgagccgcggccgccgccgctgccgcccgctccttcttgagatggaactggatgagctcagactgcagacatccttctttccagtagctccctccaccaccgctgccgccccccg

SEQ ID NO: 8722 - DNA, 223 bp, Homo sapiens
  misc_feature 1..223: note = chr6:127837399-127837622
  misc_feature 1..223: note = hyper
  source 1..223: mol_type = genomic DNA
aggctggacagctcccggagcggcccctttgggcgccaggggcgtcgccttctcggccccacctccgcctcctcggatgctggcgggcggccccgtgcggctcccggtcttgttaccctgctgttgctgctgctgcagctgctgctgccgaacagaattgagtttagtgccggcccccactggggaccgggtggccgcgattgtctgtcgcagcgaactgtcc

SEQ ID NO: 8723 - DNA, 69 bp, Homo sapiens
  misc_feature 1..69: note = chr6:127840624-127840693
  misc_feature 1..69: note = hyper
  source 1..69: mol_type = genomic DNA
gacaaagggttcttgcgaagccacgactaatttagtgcaaaccgaaataaatatcggcccacagagatc

SEQ ID NO: 8724 - DNA, 30 bp, Homo sapiens
  misc_feature 1..30: note = chr6:129204494-129204524
  misc_feature 1..30: note = hyper
  source 1..30: mol_type = genomic DNA
gcaaagaggtacagtcgaggcatgggcttg

SEQ ID NO: 8725 - DNA, 764 bp, Homo sapiens; identical to SEQ ID NO: 2917
  misc_feature 1..764: note = chr6:130686429-130687193
  misc_feature 1..764: note = hyper
  source 1..764: mol_type = genomic DNA

SEQ ID NO: 8726 - DNA, 120 bp, Homo sapiens; identical to SEQ ID NO: 2918
  misc_feature 1..120: note = chr6:130687224-130687344
  misc_feature 1..120: note = hyper
  source 1..120: mol_type = genomic DNA

SEQ ID NO: 8727 - DNA, 166 bp, Homo sapiens
  misc_feature 1..166: note = chr6:130687620-130687786
  misc_feature 1..166: note = hyper
  source 1..166: mol_type = genomic DNA
gagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccag

SEQ ID NO: 8728 - DNA, 324 bp, Homo sapiens
  misc_feature 1..324: note = chr6:132722157-132722481
  misc_feature 1..324: note = hyper
  source 1..324: mol_type = genomic DNA
cgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggt

SEQ ID NO: 8729 - DNA, 63 bp, Homo sapiens; identical to SEQ ID NO: 2919
  misc_feature 1..63: note = chr6:133562374-133562437
  misc_feature 1..63: note = hyper
  source 1..63: mol_type = genomic DNA

SEQ ID NO: 8730 - DNA, 408 bp, Homo sapiens; identical to SEQ ID NO: 2920
  misc_feature 1..408: note = chr6:133562674-133563082
  misc_feature 1..408: note = hyper
  source 1..408: mol_type = genomic DNA

SEQ ID NO: 8731 - DNA, 604 bp, Homo sapiens; identical to SEQ ID NO: 609
  misc_feature 1..604: note = chr6:133563411-133564015
  misc_feature 1..604: note = hyper
  source 1..604: mol_type = genomic DNA

SEQ ID NO: 8732 - DNA, 30 bp, Homo sapiens
  misc_feature 1..30: note = chr6:134175985-134176015
  misc_feature 1..30: note = hyper
  source 1..30: mol_type = genomic DNA
gcggcgagtctcccccggaggtctaggagg

SEQ ID NO: 8733 - DNA, 437 bp, Homo sapiens; identical to SEQ ID NO: 610
  misc_feature 1..437: note = chr6:134210582-134211019
  misc_feature 1..437: note = hyper
  source 1..437: mol_type = genomic DNA

SEQ ID NO: 8734 - DNA, 224 bp, Homo sapiens; identical to SEQ ID NO: 611
  misc_feature 1..224: note = chr6:134211111-134211335
  misc_feature 1..224: note = hyper
  source 1..224: mol_type = genomic DNA

SEQ ID NO: 8735 - DNA, 30 bp, Homo sapiens
  misc_feature 1..30: note = chr6:134214334-134214364
  misc_feature 1..30: note = hyper
  source 1..30: mol_type = genomic DNA
ccacaggccgcttcgcgggtggagccctct

SEQ ID NO: 8736 - DNA, 97 bp, Homo sapiens
  misc_feature 1..97: note = chr6:134216904-134217001
  misc_feature 1..97: note = hyper
  source 1..97: mol_type = genomic DNA
ggccttgctctggtccggcactgtgtgcgtcgggaagtcggcctggagttggggttgcagggacgccacggctggtggcgagcgcagcaggagtgcc

SEQ ID NO: 8737 - DNA, 30 bp, Homo sapiens
  misc_feature 1..30: note = chr6:134217399-134217429
  misc_feature 1..30: note = hyper
  source 1..30: mol_type = genomic DNA
gcgtttggaggaacacgcctttgatctttg

SEQ ID NO: 8738 - DNA, 281 bp, Homo sapiens
  misc_feature 1..281: note = chr6:134499571-134499852
  misc_feature 1..281: note = hyper
  source 1..281: mol_type = genomic DNA
gggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccactt

SEQ ID NO: 8739 - DNA, 95 bp, Homo sapiens
  misc_feature 1..95: note = chr6:134638851-134638946
  misc_feature 1..95: note = hyper
  source 1..95: mol_type = genomic DNA
caggaccctgggggccggacggtgggatacggccaatctccggggagatgctgtggctcttaccgagcgggagaagggtacgcctccccgccccc

SEQ ID NO: 8740 - DNA, 155 bp, Homo sapiens
  misc_feature 1..155: note = chr6:137241907-137242062
  misc_feature 1..155: note = hyper
  source 1..155: mol_type = genomic DNA
ggcaacgtgatgcagcgctaaaaggttaggaggttacgattcccggggctaagagaaataaactgctggtggtgaacgaaaggggtgctggagcgcagcgatctcgaacctttcccttatagccaaaccctggccaaggccacaaatttcaaatc

SEQ ID NO: 8741 - DNA, 100 bp, Homo sapiens
  misc_feature 1..100: note = chr6:137242063-137242163
  misc_feature 1..100: note = hyper
  source 1..100: mol_type = genomic DNA
cctgaaaaccaaactgtctggcgcttaacggttacctcggctgagcgaaacccttggctgctgctgatttaactacaggtccgcgcgagttactttccag

SEQ ID NO: 8742 - DNA, 44 bp, Homo sapiens
  misc_feature 1..44: note = chr6:137242390-137242434
  misc_feature 1..44: note = hyper
  source 1..44: mol_type = genomic DNA
cagttccctgggatccggagaacgccacgcggagtctccctgca

SEQ ID NO: 8743 - DNA, 35 bp, Homo sapiens; identical to SEQ ID NO: 612
  misc_feature 1..35: note = chr6:137244114-137244149
  misc_feature 1..35: note = hyper
  source 1..35: mol_type = genomic DNA

SEQ ID NO: 8744 - DNA, 231 bp, Homo sapiens; identical to SEQ ID NO: 613
  misc_feature 1..231: note = chr6:137244235-137244466
  misc_feature 1..231: note = hyper
  source 1..231: mol_type = genomic DNA

SEQ ID NO: 8745 - DNA, 97 bp, Homo sapiens
  misc_feature 1..97: note = chr6:137311283-137311380
  misc_feature 1..97: note = hyper
  source 1..97: mol_type = genomic DNA
actcgctccggattccgaacccgagagcagagcagagggaagcccctttgctgagcagctccttagtggagggcaatgaacgcgctgaaatcccaga

SEQ ID NO: 8746 - DNA, 86 bp, Homo sapiens
  misc_feature 1..86: note = chr6:137808768-137808854
  misc_feature 1..86: note = hyper
  source 1..86: mol_type = genomic DNA
gccataaaatgcacccgcgccaccctccatgtcccccagtggaattgaggatcttgcttgtggcaaaagtgcgttcttggcaccac

SEQ ID NO: 8747 - DNA, 258 bp, Homo sapiens; identical to SEQ ID NO: 614
  misc_feature 1..258: note = chr6:137809108-137809366
  misc_feature 1..258: note = hyper
  source 1..258: mol_type = genomic DNA

SEQ ID NO: 8748 - DNA, 472 bp, Homo sapiens; identical to SEQ ID NO: 615
  misc_feature 1..472: note = chr6:137809445-137809917
  misc_feature 1..472: note = hyper
  source 1..472: mol_type = genomic DNA

SEQ ID NO: 8749 - DNA, 929 bp, Homo sapiens; identical to SEQ ID NO: 616
  misc_feature 1..929: note = chr6:137810032-137810961
  misc_feature 1..929: note = hyper
  source 1..929: mol_type = genomic DNA

SEQ ID NO: 8750 - DNA, 30 bp, Homo sapiens
  misc_feature 1..30: note = chr6:137814359-137814389
  misc_feature 1..30: note = hyper
  source 1..30: mol_type = genomic DNA
ggaggctgcgggccccggagcctgccctcc

SEQ ID NO: 8751 - DNA, 15 bp, Homo sapiens
  misc_feature 1..15: note = chr6:137814604-137814619
  misc_feature 1..15: note = hyper
  source 1..15: mol_type = genomic DNA
cccagtgctggaagc

SEQ ID NO: 8752 - DNA, 110 bp, Homo sapiens; identical to SEQ ID NO: 2930
  misc_feature 1..110: note = chr6:137814653-137814763
  misc_feature 1..110: note = hyper
  source 1..110: mol_type = genomic DNA

SEQ ID NO: 8753 - DNA, 151 bp, Homo sapiens; identical to SEQ ID NO: 617
  misc_feature 1..151: note = chr6:137815020-137815171
  misc_feature 1..151: note = hyper
  source 1..151: mol_type = genomic DNA

SEQ ID NO: 8754 - DNA, 515 bp, Homo sapiens; identical to SEQ ID NO: 618
  misc_feature 1..515: note = chr6:137815224-137815739
  misc_feature 1..515: note = hyper
  source 1..515: mol_type = genomic DNA

SEQ ID NO: 8755 - DNA, 777 bp, Homo sapiens; identical to SEQ ID NO: 619
  misc_feature 1..777: note = chr6:137816459-137817236
  misc_feature 1..777: note = hyper
  source 1..777: mol_type = genomic DNA

SEQ ID NO: 8756 - DNA, 198 bp, Homo sapiens
  misc_feature 1..198: note = chr6:137818062-137818260
  misc_feature 1..198: note = hyper
  source 1..198: mol_type = genomic DNA
gggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggac

SEQ ID NO: 8757 - DNA, 94 bp, Homo sapiens; identical to SEQ ID NO: 620
  misc_feature 1..94: note = chr6:137818505-137818599
  misc_feature 1..94: note = hyper
  source 1..94: mol_type = genomic DNA

SEQ ID NO: 8758 - DNA, 649 bp, Homo sapiens; identical to SEQ ID NO: 621
  misc_feature 1..649: note = chr6:137818618-137819267
  misc_feature 1..649: note = hyper
  source 1..649: mol_type = genomic DNA

SEQ ID NO: 8759 - DNA, 280 bp, Homo sapiens; identical to SEQ ID NO: 622
  misc_feature 1..280: note = chr6:137819268-137819548
  misc_feature 1..280: note = hyper
  source 1..280: mol_type = genomic DNA

SEQ ID NO: 8760 - DNA, 30 bp, Homo sapiens
  misc_feature 1..30: note = chr6:142409862-142409892
  misc_feature 1..30: note = hyper
  source 1..30: mol_type = genomic DNA
cgatttaggtttaatcgatgtccctccctc

SEQ ID NO: 8761 - DNA, 148 bp, Homo sapiens
  misc_feature 1..148: note = chr6:146349536-146349684
  misc_feature 1..148: note = hyper
  source 1..148: mol_type = genomic DNA
ccagggtcctgaaggcggcagggctcaggctgccgcggcgagagcaacccggaagctcccctccgttccctttctagcaactatgcaaaccccaaagcaagcgcaggaccccccctaacccgtccacccaccgcgggaaacaagttac

SEQ ID NO: 8762 - DNA, 165 bp, Homo sapiens; identical to SEQ ID NO: 2937
  misc_feature 1..165: note = chr6:146755496-146755661
  misc_feature 1..165: note = hyper
  source 1..165: mol_type = genomic DNA

SEQ ID NO: 8763 - DNA, 134 bp, Homo sapiens
  misc_feature 1..134: note = chr6:149069231-149069365
  misc_feature 1..134: note = hyper
  source 1..134: mol_type = genomic DNA
tcccgtcccgcgccccggggagtgtgggtgggtttagccctttgccaccgtccgctctgagaattctgtcccgcagatcccccgcctgcccgccggccctagtggctccgcgctgtccccgggctggcttgtcc

SEQ ID NO: 8764 - DNA, 30 bp, Homo sapiens
  misc_feature 1..30: note = chr6:150284761-150284791
  misc_feature 1..30: note = hyper
  source 1..30: mol_type = genomic DNA
tgtcgctggcgcaggcggtgacagggagac

SEQ ID NO: 8765 - DNA, 52 bp, Homo sapiens; identical to SEQ ID NO: 623
  misc_feature 1..52: note = chr6:150285317-150285369
  misc_feature 1..52: note = hyper
  source 1..52: mol_type = genomic DNA

SEQ ID NO: 8766 - DNA, 342 bp, Homo sapiens; identical to SEQ ID NO: 624
  misc_feature 1..342: note = chr6:150285544-150285886
  misc_feature 1..342: note = hyper
  source 1..342: mol_type = genomic DNA

SEQ ID NO: 8767 - DNA, 429 bp, Homo sapiens; identical to SEQ ID NO: 625
  misc_feature 1..429: note = chr6:150286099-150286528
  misc_feature 1..429: note = hyper
  source 1..429: mol_type = genomic DNA

SEQ ID NO: 8768 - DNA, 152 bp, Homo sapiens
  misc_feature 1..152: note = chr6:150311146-150311298
  misc_feature 1..152: note = hyper
  source 1..152: mol_type = genomic DNA
gctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagtcc

SEQ ID NO: 8769 - DNA, 170 bp, Homo sapiens
  misc_feature 1..170: note = chr6:150311893-150312063
  misc_feature 1..170: note = hyper
  source 1..170: mol_type = genomic DNA
tttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgcc

SEQ ID NO: 8770 - DNA, 99 bp, Homo sapiens
  misc_feature 1..99: note = chr6:150359094-150359193
  misc_feature 1..99: note = hyper
  source 1..99: mol_type = genomic DNA
gtggggtgaggagcacggggttcctacttcatcctcgcggaaactttgccaccggctcagtgtggagacctcaccgtcccgcttggatccgtggggctc

SEQ ID NO: 8771 - DNA, 15 bp, Homo sapiens
  misc_feature 1..15: note = chr6:150359438-150359453
  misc_feature 1..15: note = hyper
  source 1..15: mol_type = genomic DNA
cgggagaaagggaga

SEQ ID NO: 8772 - DNA, 325 bp, Homo sapiens
  misc_feature 1..325: note = chr6:151561016-151561341
  misc_feature 1..325: note = hyper
  source 1..325: mol_type = genomic DNA
gtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtggg

SEQ ID NO: 8773 - DNA, 624 bp, Homo sapiens
  misc_feature 1..624: note = chr6:151561368-151561992
  misc_feature 1..624: note = hyper
  source 1..624: mol_type = genomic DNA
cgcagcgcctctggtcccggcagcctgggggcagatgctgctgcagggcgtgtctggggctgtgctcatgtgatgaagcgagggaaaaaccggggggaggggggcggaggctaagaggtggcctttttttttttttccttttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtg

SEQ ID NO: 8774 - DNA, 387 bp, Homo sapiens
  misc_feature 1..387: note = chr6:151562056-151562443
  misc_feature 1..387: note = hyper
  source 1..387: mol_type = genomic DNA
cgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagc

SEQ ID NO: 8775 - DNA, 113 bp, Homo sapiens
  misc_feature 1..113: note = chr6:151815244-151815357
  misc_feature 1..113: note = hyper
  source 1..113: mol_type = genomic DNA
cccccgggctcgggtcgtcatgagcctggactgcaccagccatatcgcgctgggtgccgcttcgccagcgcccgaggtacggtcccagccgccggccgcgcgcgggggtggcc

SEQ ID NO: 8776 - DNA, 412 bp, Homo sapiens
  misc_feature 1..412: note = chr6:152622937-152623349
  misc_feature 1..412: note = hyper
  source 1..412: mol_type = genomic DNA
gaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcat

SEQ ID NO: 8777 - DNA, 90 bp, Homo sapiens
  misc_feature 1..90: note = chr6:152957532-152957622
  misc_feature 1..90: note = hyper
  source 1..90: mol_type = genomic DNA
taatagggacatctacgtacgagatgcaaagaggctccccaacctcctagtctccttatctatgagtatcgcacacgtacacacatcact

SEQ ID NO: 8778 - DNA, 46 bp, Homo sapiens
  misc_feature 1..46: note = chr6:152957953-152957999
  misc_feature 1..46: note = hyper
  source 1..46: mol_type = genomic DNA
acaacaatctcagcccgctgcggccggcggccgcggcccggcgccc

SEQ ID NO: 8779 - DNA, 285 bp, Homo sapiens
  misc_feature 1..285: note = chr6:152958000-152958285
  misc_feature 1..285: note = hyper
  source 1..285: mol_type = genomic DNA
cgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagag

SEQ ID NO: 8780 - DNA, 356 bp, Homo sapiens
  misc_feature 1..356: note = chr6:153450977-153451333
  misc_feature 1..356: note = hyper
  source 1..356: mol_type = genomic DNA
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccag

SEQ ID NO: 8781 - DNA, 158 bp, Homo sapiens
  misc_feature 1..158: note = chr6:153451810-153451968
  misc_feature 1..158: note = hyper
  source 1..158: mol_type = genomic DNA
tcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcg

SEQ ID NO: 8782 - DNA, 171 bp, Homo sapiens
  misc_feature 1..171: note = chr6:153452584-153452755
  misc_feature 1..171: note = hyper
  source 1..171: mol_type = genomic DNA
ggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccact

SEQ ID NO: 8783 - DNA, 136 bp, Homo sapiens
  misc_feature 1..136: note = chr6:154360584-154360720
  misc_feature 1..136: note = hyper
  source 1..136: mol_type = genomic DNA
agcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcac

SEQ ID NO: 8784 - DNA, 74 bp, Homo sapiens; identical to SEQ ID NO: 2941
  misc_feature 1..74: note = chr6:155316256-155316330
  misc_feature 1..74: note = hyper
  source 1..74: mol_type = genomic DNA

SEQ ID NO: 8785 - DNA, 533 bp, Homo sapiens; identical to SEQ ID NO: 626
  misc_feature 1..533: note = chr6:157556764-157557297
  misc_feature 1..533: note = hyper
  source 1..533: mol_type = genomic DNA

SEQ ID NO: 8786 - DNA, 30 bp, Homo sapiens
  misc_feature 1..30: note = chr6:158430625-158430655
  misc_feature 1..30: note = hyper
  source 1..30: mol_type = genomic DNA
aagcaaagacattctcgtgtaggaaaactt

SEQ ID NO: 8787 - DNA, 53 bp, Homo sapiens
  misc_feature 1..53: note = chr6:158957871-158957924
  misc_feature 1..53: note = hyper
  source 1..53: mol_type = genomic DNA
cccttcaaggatgaccgctactacaggtgggcgcggcgcgggcagcggcgggg

SEQ ID NO: 8788 - DNA, 39 bp, Homo sapiens; identical to SEQ ID NO: 2943
  misc_feature 1..39: note = chr6:159590048-159590087
  misc_feature 1..39: note = hyper
  source 1..39: mol_type = genomic DNA

SEQ ID NO: 8789 - DNA, 608 bp, Homo sapiens; identical to SEQ ID NO: 2944
  misc_feature 1..608: note = chr6:159590154-159590762
  misc_feature 1..608: note = hyper
  source 1..608: mol_type = genomic DNA

SEQ ID NO: 8790 - DNA, 278 bp, Homo sapiens; identical to SEQ ID NO: 2945
  misc_feature 1..278: note = chr6:159590971-159591249
  misc_feature 1..278: note = hyper
  source 1..278: mol_type = genomic DNA

SEQ ID NO: 8791 - DNA, 90 bp, Homo sapiens
  misc_feature 1..90: note = chr6:159654913-159655003
  misc_feature 1..90: note = hyper
  source 1..90: mol_type = genomic DNA
gaccacaggtcccagcgcggacatgcggcctcccccgccaggcccagccgacccggcggcccccagtcccgcgcccgggtacccagcagg

SEQ ID NO: 8792 - DNA, 187 bp, Homo sapiens
  misc_feature 1..187: note = chr6:161351859-161352046
  misc_feature 1..187: note = hyper
  source 1..187: mol_type = genomic DNA
gcgtggaagcagaagcgaacgtcacccaggccggcagggggcggcacaccccacacttcgctgcgcgccctcgcctccttgggagggagtgtccagctcccaaaacctgtcgtgggttttgtcccaagtgacttcagccagcagatggttcaagtcctgaggctgcaaaattcggggtggaaggagt

SEQ ID NO: 8793 - DNA, 95 bp, Homo sapiens
  misc_feature 1..95: note = chr6:163836610-163836705
  misc_feature 1..95: note = hyper
  source 1..95: mol_type = genomic DNA
caagttggcgcgttgcggagggctgcggggtgagccctgcggcccctctagcttcggcggtcacatttccgagaggtcggcgggggctgcgcgga

SEQ ID NO: 8794 - DNA, 136 bp, Homo sapiens
  misc_feature 1..136: note = chr6:166074525-166074661
  misc_feature 1..136: note = hyper
  source 1..136: mol_type = genomic DNA
cctgcttccttctagcgaacccctgccttgacttttctgctcaatcttgtcccccacccccgtgacatgcctttctgccacctctgcctcagcgcgctctcggccccgcgcccgcgggtggcgaggaggagtggcc

SEQ ID NO: 8795 - DNA, 163 bp, Homo sapiens
  misc_feature 1..163: note = chr6:166074962-166075125
  misc_feature 1..163: note = hyper
  source 1..163: mol_type = genomic DNA
tggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 8796 - DNA, 30 bp, Homo sapiens
  misc_feature 1..30: note = chr6:166075459-166075489
  misc_feature 1..30: note = hyper
  source 1..30: mol_type = genomic DNA
ccttcggaagcagctcgcattattagaagg

SEQ ID NO: 8797 - DNA, 50 bp, Homo sapiens
  misc_feature 1..50: note = chr6:166077583-166077633
  misc_feature 1..50: note = hyper
  source 1..50: mol_type = genomic DNA
cgaggtcaccttccccggagtggagcacacgcgccaaagctcagctttca

SEQ ID NO: 8798 - DNA, 39 bp, Homo sapiens
  misc_feature 1..39: note = chr6:166077961-166078000
  misc_feature 1..39: note = hyper
  source 1..39: mol_type = genomic DNA
gcagattctgagtgtcgcgtgtaacgggcatcagacttg

SEQ ID NO: 8799 - DNA, 116 bp, Homo sapiens
  misc_feature 1..116: note = chr6:166218546-166218662
  misc_feature 1..116: note = hyper
  source 1..116: mol_type = genomic DNA
tggagggacatggggcgtacggaggggcagcggggcctggggtcgagcagaggggcgcatggaggggagcatggagggacgtggggcgcgcggaggggcggcggggcgtgggacgc

SEQ ID NO: 8800 - DNA, 350 bp, Homo sapiens; identical to SEQ ID NO: 2946
  misc_feature 1..350: note = chr6:166267542-166267892
  misc_feature 1..350: note = hyper
  source 1..350: mol_type = genomic DNA

SEQ ID NO: 8801 - DNA, 30 bp, Homo sapiens
  misc_feature 1..30: note = chr6:166400601-166400631
  misc_feature 1..30: note = hyper
  source 1..30: mol_type = genomic DNA
ctcgggaggcacctgcgggtctggcgcggc

SEQ ID NO: 8802 - DNA, 30 bp, Homo sapiens
  misc_feature 1..30: note = chr6:166400920-166400950
  misc_feature 1..30: note = hyper
  source 1..30: mol_type = genomic DNA
gtttttttaagtacacgcacacacacacaa

SEQ ID NO: 8803 - DNA, 30 bp, Homo sapiens
  misc_feature 1..30: note = chr6:166401268-166401298
  misc_feature 1..30: note = hyper
  source 1..30: mol_type = genomic DNA
gcgcgccgatcttctcgcaaaaggcgagtg

SEQ ID NO: 8804 - DNA, 256 bp, Homo sapiens; identical to SEQ ID NO: 2947
  misc_feature 1..256: note = chr6:166402395-166402651
  misc_feature 1..256: note = hyper
  source 1..256: mol_type = genomic DNA

SEQ ID NO: 8805 - DNA, 49 bp, Homo sapiens; identical to SEQ ID NO: 2948
  misc_feature 1..49: note = chr6:166421943-166421992
  misc_feature 1..49: note = hyper
  source 1..49: mol_type = genomic DNA

SEQ ID NO: 8806 - DNA, 192 bp, Homo sapiens; identical to SEQ ID NO: 2949
  misc_feature 1..192: note = chr6:166421993-166422185
  misc_feature 1..192: note = hyper
  source 1..192: mol_type = genomic DNA

SEQ ID NO: 8807 - DNA, 1231 bp, Homo sapiens; identical to SEQ ID NO: 627
  misc_feature 1..1231: note = chr6:166579715-166580946
  misc_feature 1..1231: note = hyper
  source 1..1231: mol_type = genomic DNA

SEQ ID NO: 8808 - DNA, 1021 bp, Homo sapiens; identical to SEQ ID NO: 628
  misc_feature 1..1021: note = chr6:166581218-166582239
  misc_feature 1..1021: note = hyper
  source 1..1021: mol_type = genomic DNA

SEQ ID NO: 8809 - DNA, 292 bp, Homo sapiens; identical to SEQ ID NO: 2952
  misc_feature 1..292: note = chr6:166582505-166582797
  misc_feature 1..292: note = hyper
  source 1..292: mol_type = genomic DNA

SEQ ID NO: 8810 - DNA, 18 bp, Homo sapiens
  misc_feature 1..18: note = chr6:166583078-166583096
  misc_feature 1..18: note = hyper
  source 1..18: mol_type = genomic DNA
ctcatttgctcctgacgc

SEQ ID NO: 8811 - DNA, 88 bp, Homo sapiens
  misc_feature 1..88: note = chr6:166583152-166583240
  misc_feature 1..88: note = hyper
  source 1..88: mol_type = genomic DNA
cgtggtgcgtgttactctccttactccgggtattaaaatgtctaagaggtcatcgctttggcccaaggcctcccgaggataagataaa

SEQ ID NO: 8812 - DNA, 91 bp, Homo sapiens
  misc_feature 1..91: note = chr6:166666972-166667063
  misc_feature 1..91: note = hyper
  source 1..91: mol_type = genomic DNA
ccagggagaaagctccggtgaggggagcagacgctgggacccgtggtctcgccctctgctctttcctggctggggacgggggtagctccca

SEQ ID NO: 8813 - DNA, 34 bp, Homo sapiens
  misc_feature 1..34: note = chr6:168841594-168841628
  misc_feature 1..34: note = hyper
  source 1..34: mol_type = genomic DNA
gtgtgtgtgagagtgcgcgcggggaaggaggcac

SEQ ID NO: 8814 - DNA, 80 bp, Homo sapiens
  misc_feature 1..80: note = chr6:168842084-168842164
  misc_feature 1..80: note = hyper
  source 1..80: mol_type = genomic DNA
tcgctgggctgctcccgccggtgcccgctcagaagttctcggcgctcacggtaagcccgggcccgcgggacctggagctc

SEQ ID NO: 8815 - DNA, 57 bp, Homo sapiens
  misc_feature 1..57: note = chr6:169653992-169654049
  misc_feature 1..57: note = hyper
  source 1..57: mol_type = genomic DNA
tgtcaatcagacacacgaggaagcacgtttaattcattccttcgaaggaatgacatc

SEQ ID NO: 8816 - DNA, 71 bp, Homo sapiens
  misc_feature 1..71: note = chr6:170605686-170605757
  misc_feature 1..71: note = hyper
  source 1..71: mol_type = genomic DNA
cgacggcgcacacctcggagccctgggggccggggtcggcgggcggggccggggcgcgccctttgtgcgct

SEQ ID NO: 8817 - DNA, 85 bp, Homo sapiens
  misc_feature 1..85: note = chr7:330501-330586
  misc_feature 1..85: note = hyper
  source 1..85: mol_type = genomic DNA
cactttccccaacaccgcctcgctcctccgcctctgcgccccacggcgtcctgcgggatggggggaaggacggggggctgcccgg

SEQ ID NO: 8818 - DNA, 163 bp, Homo sapiens; identical to SEQ ID NO: 2953
  misc_feature 1..163: note = chr7:751986-752149
  misc_feature 1..163: note = hyper
  source 1..163: mol_type = genomic DNA

SEQ ID NO: 8819 - DNA, 112 bp, Homo sapiens; identical to SEQ ID NO: 2954
  misc_feature 1..112: note = chr7:752150-752262
  misc_feature 1..112: note = hyper
  source 1..112: mol_type = genomic DNA

SEQ ID NO: 8820 - DNA, 438 bp, Homo sapiens
  misc_feature 1..438: note = chr7:1263736-1264174
  misc_feature 1..438: note = hyper
  source 1..438: mol_type = genomic DNA
ttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagaca

SEQ ID NO: 8821 - DNA, 149 bp, Homo sapiens
  misc_feature 1..149: note = chr7:1265323-1265472
  misc_feature 1..149: note = hyper
  source 1..149: mol_type = genomic DNA
gcgcccctccgagcccgcccggccgcgctctgcaaaccgatgctgtttaattaacgtgcaaattgagtagattaaatgactctaaataattagccacagatcctacaaacaggataacagatttaattaagcagcgatatagattttgg

SEQ ID NO: 8822 - DNA, 227 bp, Homo sapiens
  misc_feature 1..227: note = chr7:1269237-1269464
  misc_feature 1..227: note = hyper
  source 1..227: mol_type = genomic DNA
ccagctgggcccaagcgcaggaggccggtcctcacggtgcgcccgggaagggaagggccgagcggcctggagctgccagaggccgcggcccgggcgggggaaggggcaggcggaaggcgggccccggaggtctccggctgggccgggcgcgcgcgcctgggccctttgtctcgcgcggccgtcgggcccggggccccagccctgtgcgctcggggcgaggaggttcc

SEQ ID NO: 8823 - DNA, 113 bp, Homo sapiens
  misc_feature 1..113: note = chr7:1270162-1270275
  misc_feature 1..113: note = hyper
  source 1..113: mol_type = genomic DNA
aggaggttttcggagcgcgagccggcccgacagcatgaaaaacacagggcgattgaaatgcgagcattgggacgcacggagccgccgcggcgcggactcgctcttgaggtcaa

SEQ ID NO: 8824 - DNA, 334 bp, Homo sapiens
  misc_feature 1..334: note = chr7:1272630-1272964
  misc_feature 1..334: note = hyper
  source 1..334: mol_type = genomic DNA
gccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcgg

SEQ ID NO: 8825 - DNA, 300 bp, Homo sapiens
  misc_feature 1..300: note = chr7:1274514-1274814
  misc_feature 1..300: note = hyper
  source 1..300: mol_type = genomic DNA
aagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaag

SEQ ID NO: 8826 - DNA, 32 bp, Homo sapiens
  misc_feature 1..32: note = chr7:1275579-1275611
  misc_feature 1..32: note = hyper
  source 1..32: mol_type = genomic DNA
acccggaggagatcgcgcgcaaggagctggag

SEQ ID NO: 8827 - DNA, 41 bp, Homo sapiens
  misc_feature 1..41: note = chr7:1276444-1276485
  misc_feature 1..41: note = hyper
  source 1..41: mol_type = genomic DNA
cgcggacgcggggaccgccggccccgcgcccccgccgcccg

SEQ ID NO: 8828 - DNA, 124 bp, Homo sapiens
  misc_feature 1..124: note = chr7:1277174-1277298
  misc_feature 1..124: note = hyper
  source 1..124: mol_type = genomic DNA
ctccccctcctaccccgcgccgcacacgcacgctcacatccgccgcgcgcccccgcgcgcactggcacacgccggggcgcgcggcgcggggtgacggagccgggggctgcgagggccgggccgc

SEQ ID NO: 8829 - DNA, 30 bp, Homo sapiens
  misc_feature 1..30: note = chr7:1280395-1280425
  misc_feature 1..30: note = hyper
  source 1..30: mol_type = genomic DNA
aaattagccaggcctcgcagtctcctaatg

SEQ ID NO: 8830 - DNA, 37 bp, Homo sapiens
  misc_feature 1..37: note = chr7:1281142-1281179
  misc_feature 1..37: note = hyper
  source 1..37: mol_type = genomic DNA
ccagcggctccctggcgcaccccggacacggtggcca

SEQ ID NO: 8831 - DNA, 37 bp, Homo sapiens
  misc_feature 1..37: note = chr7:1282107-1282144
  misc_feature 1..37: note = hyper
  source 1..37: mol_type = genomic DNA
accacactcgggctgcggggagcgagcgcgggcgttg

SEQ ID NO: 8832 - DNA, 59 bp, Homo sapiens
  misc_feature 1..59: note = chr7:1282622-1282681
  misc_feature 1..59: note = hyper
  source 1..59: mol_type = genomic DNA
gcccggccgggccctcgcgcgccggcttctgctgattctttctgcggcctgataataag

SEQ ID NO: 8833 - DNA, 94 bp, Homo sapiens
  misc_feature 1..94: note = chr7:1283626-1283720
  misc_feature 1..94: note = hyper
  source 1..94: mol_type = genomic DNA
gacacaggggctttccgggatcgaaaggtgtttcttccctttctaagtcacgtcaggccacctccgaccccagccgacacgctaccaggcctgc

SEQ ID NO: 8834 - DNA, 27 bp, Homo sapiens
  misc_feature 1..27: note = chr7:1286084-1286111
  misc_feature 1..27: note = hyper
  source 1..27: mol_type = genomic DNA
agggcgggcagaggccgggctgggagg

SEQ ID NO: 8835 - DNA, 135 bp, Homo sapiens
  misc_feature 1..135: note = chr7:1288552-1288687
  misc_feature 1..135: note = hyper
  source 1..135: mol_type = genomic DNA
tctgagggagctttccgtgggatggctgggcctctgttgcagttgcgaccaatgctgcggtttaaattctccctgggtccaatcctgcttccctcccctaagcctctcgcacacacacctcggctcaggctattc

SEQ ID NO: 8836 - DNA, 122 bp, Homo sapiens
  misc_feature 1..122: note = chr7:1289414-1289536
  misc_feature 1..122: note = hyper
  source 1..122: mol_type = genomic DNA
ggggcagcccccctccgcttcctcccacagctctatttagggcagacaggccaaagagagccacggaggcgtgttggacagcctagcagcggccatgaaccctggcacgtttatctgctgga

SEQ ID NO: 8837 - DNA, 124 bp, Homo sapiens; identical to SEQ ID NO: 2955
  misc_feature 1..124: note = chr7:1408647-1408771
  misc_feature 1..124: note = hyper
  source 1..124: mol_type = genomic DNA

SEQ ID NO: 8838 - DNA, 34 bp, Homo sapiens; identical to SEQ ID NO: 2956
  misc_feature 1..34: note = chr7:1408874-1408908
  misc_feature 1..34: note = hyper
  source 1..34: mol_type = genomic DNA

SEQ ID NO: 8839 - DNA, 603 bp, Homo sapiens
  misc_feature 1..603: note = chr7:1704139-1704742
  misc_feature 1..603: note = hyper
  source 1..603: mol_type = genomic DNA
aggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacg

SEQ ID NO: 8840 - DNA, 91 bp, Homo sapiens
  misc_feature 1..91: note = chr7:1706301-1706392
  misc_feature 1..91: note = hyper
  source 1..91: mol_type = genomic DNA
gtgcgctggggtagccgcggcgccccaagttgaaccacagacgaacccctcttcatctgaaacctggtctcggagtcggaggtggggaggg

SEQ ID NO: 8841 - DNA, 128 bp, Homo sapiens
  misc_feature 1..128: note = chr7:1707040-1707168
  misc_feature 1..128: note = hyper
  source 1..128: mol_type = genomic DNA
ggcaggggggacccgcgaagctcctggagcgtttagggatgcagctcgggcggcgtgtgcagggaggaagcagcgtcccggcgtccccccttcagcgtcgccttcgcgcgcctcgagggcccaggagg

SEQ ID NO: 8842 - DNA, 351 bp, Homo sapiens
  misc_feature 1..351: note = chr7:1709093-1709444
  misc_feature 1..351: note = hyper
  source 1..351: mol_type = genomic DNA
ccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgct

SEQ ID NO: 8843 - DNA, 21 bp, Homo sapiens
  misc_feature 1..21: note = chr7:1709902-1709923
  misc_feature 1..21: note = hyper
  source 1..21: mol_type = genomic DNA
gaggaatttcaatcccgggag

SEQ ID NO: 8844 - DNA, 289 bp, Homo sapiens
  misc_feature 1..289: note = chr7:1709955-1710244
  misc_feature 1..289: note = hyper
  source 1..289: mol_type = genomic DNA
cgggcgcagccccggaaccgaggccgggcgggcaggtaagcggcgagcgcggccgggcgctgaacctgggggacttgggacccggaccacccccggggagcggcgcggccaagccccccgccacctcgaaccccgggcgtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggt

SEQ ID NO: 8845 - DNA, 19 bp, Homo sapiens
  misc_feature 1..19: note = chr7:1710324-1710343
  misc_feature 1..19: note = hyper
  source 1..19: mol_type = genomic DNA
cgtccgcaccctgcccggc

SEQ ID NO: 8846 - DNA, 39 bp, Homo sapiens
  misc_feature 1..39: note = chr7:2728085-2728124
  misc_feature 1..39: note = hyper
  source 1..39: mol_type = genomic DNA
cggagacgcgaagggcgcacttggcgagggtttggtgca

SEQ ID NO: 8847 - DNA, 36 bp, Homo sapiens
  misc_feature 1..36: note = chr7:3083169-3083205
  misc_feature 1..36: note = hyper
  source 1..36: mol_type = genomic DNA
ccccgacgccccccccgccaccgtgtcatctcactg

SEQ ID NO: 8848 - DNA, 361 bp, Homo sapiens
  misc_feature 1..361: note = chr7:3340254-3340615
  misc_feature 1..361: note = hyper
  source 1..361: mol_type = genomic DNA
aaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtcccca

SEQ ID NO: 8849 - DNA, 30 bp, Homo sapiens
  misc_feature 1..30: note = chr7:3341956-3341986
  misc_feature 1..30: note = hyper
  source 1..30: mol_type = genomic DNA
ccctccccagggcctcgtcctctccccagc

SEQ ID NO: 8850 - DNA, 67 bp, Homo sapiens
  misc_feature 1..67: note = chr7:4922640-4922707
  misc_feature 1..67: note = hyper
  source 1..67: mol_type = genomic DNA
ggatgcagtatttgtcgaggggctggaaatggtacataaatagccgggaaacaatgctttgagctgg

SEQ ID NO: 8851 - DNA, 34 bp, Homo sapiens; identical to SEQ ID NO: 2957
  misc_feature 1..34: note = chr7:4923327-4923361
  misc_feature 1..34: note = hyper
  source 1..34: mol_type = genomic DNA

SEQ ID NO: 8852 - DNA, 386 bp, Homo sapiens; identical to SEQ ID NO: 2958
  misc_feature 1..386: note = chr7:4998201-4998587
  misc_feature 1..386: note = hyper
  source 1..386: mol_type = genomic DNA

SEQ ID NO: 8853 - DNA, 189 bp, Homo sapiens
  misc_feature 1..189: note = chr7:6566347-6566536
  misc_feature 1..189: note = hyper
  source 1..189: mol_type = genomic DNA
cctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctgggggg

SEQ ID NO: 8854 - DNA, 244 bp, Homo sapiens
  misc_feature 1..244: note = chr7:6570454-6570698
  misc_feature 1..244: note = hyper
  source 1..244: mol_type = genomic DNA
gactctttagggccacgcacgggttctgagcgcccaacgcttagacctcgccgccccggtacccaccgagtttatttccaacctccctgggcctcgggctccgcccaggctcggagggtgcccacccagggcagggaagcccctccacgctccagccccacccgctttcagaccagcccgaggcggatccgtggcgcagagggcgcacggttcccggaggcgcgggacgcgatggggaagctac

SEQ ID NO: 8855 - DNA, 244 bp, Homo sapiens
  misc_feature 1..244: note = chr7:6570933-6571177
  misc_feature 1..244: note = hyper
  source 1..244: mol_type = genomic DNA
tgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagg

SEQ ID NO: 8856 - DNA, 297 bp, Homo sapiens
  misc_feature 1..297: note = chr7:6654798-6655095
  misc_feature 1..297: note = hyper
  source 1..297: mol_type = genomic DNA
cgcctactccctctccgagtgccatcgaattgtgtgctaattagccacaatttgcaccgcggcaggggcgccccgaggccacgcctgccctctagggggtggcagggatcgggttgggtaccccccacccagacacccaggcagtgacagtcgccaaccccgtggcgcgaggacacgcgcagcagggatgcggcacagcgcgcgctgcgctcggcaccggccagcccgggacgccccaggggccgccgcatcgtgtcccccgggccgggtgagtggccgggccgggaatggttaagc

SEQ ID NO: 8857 - DNA, 110 bp, Homo sapiens
  misc_feature 1..110: note = chr7:6703598-6703708
  misc_feature 1..110: note = hyper
  source 1..110: mol_type = genomic DNA
ggctttgtgcgcaggcgcttgcggcttcgcggggctgaccgtgcgcttcgcctgcggggtcgtgctggggcggcgggtgagcctggggggctgcagagcgggcgcggggc

SEQ ID NO: 8858 - DNA, 94 bp, Homo sapiens
  misc_feature 1..94: note = chr7:6703709-6703803
  misc_feature 1..94: note = hyper
  source 1..94: mol_type = genomic DNA
cgtccgaacagtcgcagccccgagcccctgggaccgccttccccgcggaggcttgggctcagcgcctggggcggaggtggggcgggggcggtcc

SEQ ID NO: 8859 - DNA, 66 bp, Homo sapiens
  misc_feature 1..66: note = chr7:6703804-6703870
  misc_feature 1..66: note = hyper
  source 1..66: mol_type = genomic DNA
cccgcagcagggggtgccggggccgcctccgggtttcctccgctggatgcggcggtggtgcgctgt

SEQ ID NO: 8860 - DNA, 173 bp, Homo sapiens
  misc_feature 1..173: note = chr7:6703915-6704088
  misc_feature 1..173: note = hyper
  source 1..173: mol_type = genomic DNA
cgccctgggccctcctccgaggtgcctcgcgtggggcccgtgccagggcccgctgagtcggggccgctcgtgggccgcctggctgccgcctggggcctccggccgctgcgtcccgcggcttctgggaaccgtgcgcgctcacaggcggacttgggcctcgaacaaggttcctg

SEQ ID NO: 8861 - DNA, 154 bp, Homo sapiens; identical to SEQ ID NO: 2959
  misc_feature 1..154: note = chr7:8473139-8473293
  misc_feature 1..154: note = hyper
  source 1..154: mol_type = genomic DNA

SEQ ID NO: 8862 - DNA, 607 bp, Homo sapiens; identical to SEQ ID NO: 629
  misc_feature 1..607: note = chr7:8473635-8474242
  misc_feature 1..607: note = hyper
  source 1..607: mol_type = genomic DNA

SEQ ID NO: 8863 - DNA, 47 bp, Homo sapiens; identical to SEQ ID NO: 630
  misc_feature 1..47: note = chr7:8474515-8474562
  misc_feature 1..47: note = hyper
  source 1..47: mol_type = genomic DNA

SEQ ID NO: 8864 - DNA, 140 bp, Homo sapiens
  misc_feature 1..140: note = chr7:8474957-8475097
  misc_feature 1..140: note = hyper
  source 1..140: mol_type = genomic DNA
ctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcg

SEQ ID NO: 8865 - DNA, 54 bp, Homo sapiens
  misc_feature 1..54: note = chr7:8475348-8475402
  misc_feature 1..54: note = hyper
  source 1..54: mol_type = genomic DNA
ggctgcgtgctggtacgtgcttttcctcctgcagcccaccgtctacttggtaag

SEQ ID NO: 8866 - DNA, 53 bp, Homo sapiens
  misc_feature 1..53: note = chr7:8476668-8476721
  misc_feature 1..53: note = hyper
  source 1..53: mol_type = genomic DNA
tctttgcccctttatcgcctgaccgtagcagccgcggacgccagagggcgctg

SEQ ID NO: 8867 - DNA, 264 bp, Homo sapiens; identical to SEQ ID NO: 631
  misc_feature 1..264: note = chr7:8480763-8481027
  misc_feature 1..264: note = hyper
  source 1..264: mol_type = genomic DNA

SEQ ID NO: 8868 - DNA, 61 bp, Homo sapiens; identical to SEQ ID NO: 2963
  misc_feature 1..61: note = chr7:8481642-8481703
  misc_feature 1..61: note = hyper
  source 1..61: mol_type = genomic DNA

SEQ ID NO: 8869 - DNA, 282 bp, Homo sapiens; identical to SEQ ID NO: 2964
  misc_feature 1..282: note = chr7:8482016-8482298
  misc_feature 1..282: note = hyper
  source 1..282: mol_type = genomic DNA

SEQ ID NO: 8870 - DNA, 156 bp, Homo sapiens; identical to SEQ ID NO: 2965
  misc_feature 1..156: note = chr7:8482669-8482825
  misc_feature 1..156: note = hyper
  source 1..156: mol_type = genomic DNA

SEQ ID NO: 8871 - DNA, 139 bp, Homo sapiens; identical to SEQ ID NO: 2966
  misc_feature 1..139: note = chr7:8482884-8483023
  misc_feature 1..139: note = hyper
  source 1..139: mol_type = genomic DNA

SEQ ID NO: 8872 - DNA, 596 bp, Homo sapiens; identical to SEQ ID NO: 632
  misc_feature 1..596: note = chr7:8483358-8483954
  misc_feature 1..596: note = hyper
  source 1..596: mol_type = genomic DNA

SEQ ID NO: 8873 - DNA, 197 bp, Homo sapiens
  misc_feature 1..197: note = chr7:11871392-11871589
  misc_feature 1..197: note = hyper
  source 1..197: mol_type = genomic DNA
cagatagagggtgggcgcctccgcctcgccctgcgccgcagccctgccggcgcccgggcgtagcagcagcagcaggagcagcggcagcggcagcggcagcggcagcagctgcaggacgccccggcgcggccccgcagcgccccggctcccggacgcccagcgcctggcttgcagccccatgccgcctgcagccactc

SEQ ID NO: 8874 - DNA, 98 bp, Homo sapiens
  misc_feature 1..98: note = chr7:12151205-12151303
  misc_feature 1..98: note = hyper
  source 1..98: mol_type = genomic DNA
ctggggttctctctgcgcacgaaatccggggcgggcactatgtgattcgagcccgctgcgccctgggctcctcgtgtcgcccgcggggaaaggaggag

SEQ ID NO: 8875 - DNA, 30 bp, Homo sapiens
  misc_feature 1..30: note = chr7:12151622-12151652
  misc_feature 1..30: note = hyper
  source 1..30: mol_type = genomic DNA
ggtcccctgcatgtccgcactcctgttctg

SEQ ID NO: 8876 - DNA, 32 bp, Homo sapiens
  misc_feature 1..32: note = chr7:12443294-12443326
  misc_feature 1..32: note = hyper
  source 1..32: mol_type = genomic DNA
ggccaggaacatcagcgcgatcaccagcacgc

SEQ ID NO: 8877 - DNA, 30 bp, Homo sapiens
  misc_feature 1..30: note = chr7:15725085-15725115
  misc_feature 1..30: note = hyper
  source 1..30: mol_type = genomic DNA
cgagccactcagagtcggcaacttgcaaga

SEQ ID NO: 8878 - DNA, 64 bp, Homo sapiens
  misc_feature 1..64: note = chr7:15725949-15726013
  misc_feature 1..64: note = hyper
  source 1..64: mol_type = genomic DNA
agaggattgggagaacgggtgcaagccttgcgccgtggcgtgagggctgcgcaggcagccaaag

SEQ ID NO: 8879 - DNA, 350 bp, Homo sapiens
  misc_feature 1..350: note = chr7:15726686-15727036
  misc_feature 1..350: note = hyper
  source 1..350: mol_type = genomic DNA
gaaaagctagggatacgcctatcctttcaggaacacgaaagaagtaatagggttaaaggaaaagaccagagctagtttggcgcaccctcgaagtttttcaaactttgcatcttcccgtgccccgggcgccgcagcgcgcctaggttttcgcagctggtttctgtcggtgggttgttaataggctgggacgccagatctgaggttgcggggatgagcaccatggcctggaaaaggcggttctcagtgcagaaagaagacggacctggttgggtgggtgggaggaaggcgtgagtctgaaagggttgcagatgcctgctccctggcatcctcacgtgcgatgccaggtggag

SEQ ID NO: 8880 - DNA, 30 bp, Homo sapiens
  misc_feature 1..30: note = chr7:15727290-15727320
  misc_feature 1..30: note = hyper
  source 1..30: mol_type = genomic DNA
agaattcttacatttcgatagctcccaaaa

SEQ ID NO: 8881 - DNA, 82 bp, Homo sapiens
  misc_feature 1..82: note = chr7:18125980-18126062
  misc_feature 1..82: note = hyper
  source 1..82: mol_type = genomic DNA
gggggcgcgagagggcgaggcagcggcctggcttctccccagcaccgttctctgtcacggccgccgcctgaccatcaccccg

SEQ ID NO: 8882 - skipped

SEQ ID NO: 8883 - DNA, 94 bp, Homo sapiens
  misc_feature 1..94: note = chr7:18126664-18126758
  misc_feature 1..94: note = hyper
  source 1..94: mol_type = genomic DNA
cggctggaggagcagcggcggcccccgagtcaactttcattccctttttgcttctgcctcaccattctcttctcctcctcgaaagatggctgtt

SEQ ID NO: 8884 - DNA, 37 bp, Homo sapiens; identical to SEQ ID NO: 633
  misc_feature 1..37: note = chr7:19145857-19145894
  misc_feature 1..37: note = hyper
  source 1..37: mol_type = genomic DNA

SEQ ID NO: 8885 - DNA, 154 bp, Homo sapiens; identical to SEQ ID NO: 634
  misc_feature 1..154: note = chr7:19146031-19146185
  misc_feature 1..154: note = hyper
  source 1..154: mol_type = genomic DNA

SEQ ID NO: 8886 - DNA, 345 bp, Homo sapiens; identical to SEQ ID NO: 635
  misc_feature 1..345: note = chr7:19146237-19146582
  misc_feature 1..345: note = hyper
  source 1..345: mol_type = genomic DNA

SEQ ID NO: 8887 - DNA, 932 bp, Homo sapiens; identical to SEQ ID NO: 636
  misc_feature 1..932: note = chr7:19146942-19147874
  misc_feature 1..932: note = hyper
  source 1..932: mol_type = genomic DNA

SEQ ID NO: 8888 - skipped

SEQ ID NO: 8889 - DNA, 340 bp, Homo sapiens; identical to SEQ ID NO: 638
  misc_feature 1..340: note = chr7:19156303-19156643
  misc_feature 1..340: note = hyper
  source 1..340: mol_type = genomic DNA

SEQ ID NO: 8890 - DNA, 43 bp, Homo sapiens; identical to SEQ ID NO: 639
  misc_feature 1..43: note = chr7:19156703-19156746
  misc_feature 1..43: note = hyper
  source 1..43: mol_type = genomic DNA

SEQ ID NO: 8891 - DNA, 138 bp, Homo sapiens; identical to SEQ ID NO: 640
  misc_feature 1..138: note = chr7:19157055-19157193
  misc_feature 1..138: note = hyper
  source 1..138: mol_type = genomic DNA

SEQ ID NO: 8892 - DNA, 69 bp, Homo sapiens; identical to SEQ ID NO: 641
  misc_feature 1..69: note = chr7:19157194-19157263
  misc_feature 1..69: note = hyper
  source 1..69: mol_type = genomic DNA

SEQ ID NO: 8893 - DNA, 303 bp, Homo sapiens; identical to SEQ ID NO: 642
  misc_feature 1..303: note = chr7:19157264-19157567
  misc_feature 1..303: note = hyper
  source 1..303: mol_type = genomic DNA

SEQ ID NO: 8894 - DNA, 302 bp, Homo sapiens; identical to SEQ ID NO: 643
  misc_feature 1..302: note = chr7:19157633-19157935
  misc_feature 1..302: note = hyper
  source 1..302: mol_type = genomic DNA

SEQ ID NO: 8895 - DNA, 30 bp, Homo sapiens
  misc_feature 1..30: note = chr7:19183647-19183677
  misc_feature 1..30: note = hyper
  source 1..30: mol_type = genomic DNA
actttagatgcaaagcgtagatttgcactc

SEQ ID NO: 8896 - DNA, 268 bp, Homo sapiens; identical to SEQ ID NO: 2979
  misc_feature 1..268: note = chr7:19184148-19184416
  misc_feature 1..268: note = hyper
  source 1..268: mol_type = genomic DNA

SEQ ID NO: 8897 - DNA, 32 bp, Homo sapiens
  misc_feature 1..32: note = chr7:19184803-19184835
  misc_feature 1..32: note = hyper
  source 1..32: mol_type = genomic DNA
tccccctcttcaaaccgcgccatcctcctggg

SEQ ID NO: 8898 - DNA, 156 bp, Homo sapiens; identical to SEQ ID NO: 644
  misc_feature 1..156: note = chr7:20816291-20816447
  misc_feature 1..156: note = hyper
  source 1..156: mol_type = genomic DNA

SEQ ID NO: 8899 - DNA, 30 bp, Homo sapiens
  misc_feature 1..30: note = chr7:20817170-20817200
  misc_feature 1..30: note = hyper
  source 1..30: mol_type = genomic DNA
agtcacacttaattgcgccttctttatgat

SEQ ID NO: 8900 - DNA, 121 bp, Homo sapiens
  misc_feature 1..121: note = chr7:20817836-20817957
  misc_feature 1..121: note = hyper
  source 1..121: mol_type = genomic DNA
cggtgcctttgtgtgcggtgggcgcggcgatgggctgctccggcccgcagcccgaggggagcggcgggcccgggccggggccagggctcgcggggagaccccagaccaccacctcactctt

SEQ ID NO: 8901 - DNA, 297 bp, Homo sapiens
  misc_feature 1..297: note = chr7:20817982-20818279
  misc_feature 1..297: note = hyper
  source 1..297: mol_type = genomic DNA
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaa

SEQ ID NO: 8902 - DNA, 70 bp, Homo sapiens; identical to SEQ ID NO: 645
  misc_feature 1..70: note = chr7:20823261-20823331
  misc_feature 1..70: note = hyper
  source 1..70: mol_type = genomic DNA

SEQ ID NO: 8903 - DNA, 497 bp, Homo sapiens; identical to SEQ ID NO: 646
  misc_feature 1..497: note = chr7:20823382-20823879
  misc_feature 1..497: note = hyper
  source 1..497: mol_type = genomic DNA

SEQ ID NO: 8904 - DNA, 90 bp, Homo sapiens; identical to SEQ ID NO: 647
  misc_feature 1..90: note = chr7:20823919-20824009
  misc_feature 1..90: note = hyper
  source 1..90: mol_type = genomic DNA

SEQ ID NO: 8905 - DNA, 275 bp, Homo sapiens; identical to SEQ ID NO: 2984
  misc_feature 1..275: note = chr7:20824475-20824750
  misc_feature 1..275: note = hyper
  source 1..275: mol_type = genomic DNA

SEQ ID NO: 8906 - DNA, 49 bp, Homo sapiens
  misc_feature 1..49: note = chr7:20826611-20826660
  misc_feature 1..49: note = hyper
  source 1..49: mol_type = genomic DNA
gcgccgtgaggtcatcggcgccgccgcctgccgccgtggtggaaggggg

SEQ ID NO: 8907 - DNA, 41 bp, Homo sapiens
  misc_feature 1..41: note = chr7:20827412-20827453
  misc_feature 1..41: note = hyper
  source 1..41: mol_type = genomic DNA
ttatttttagggatgcgttgggacgtggatgcgcgcctgcg

SEQ ID NO: 8908 - DNA, 144 bp, Homo sapiens
  misc_feature 1..144: note = chr7:20830686-20830830
  misc_feature 1..144: note = hyper
  source 1..144: mol_type = genomic DNA
gcagtgctggcactgcgtccctggcctgcgcctctcccagaatgggaagacgacccccaaccccttgactagtgtgcggggtcctcgcacgcggacgtgttggctactaaataaagcgtgaagagggatcgctgggtagctgag

SEQ ID NO: 8909 - DNA, 30 bp, Homo sapiens
  misc_feature 1..30: note = chr7:20833089-20833119
  misc_feature 1..30: note = hyper
  source 1..30: mol_type = genomic DNA
tgctttagaatcattcgactctgagtccag

SEQ ID NO: 8910 - DNA, 30 bp, Homo sapiens
  misc_feature 1..30: note = chr7:20836099-20836129
  misc_feature 1..30: note = hyper
  source 1..30: mol_type = genomic DNA
aagggcagctattaacgacagaaagttctt

SEQ ID NO: 8911 - DNA, 30 bp, Homo sapiens
  misc_feature 1..30: note = chr7:20836810-20836840
  misc_feature 1..30: note = hyper
  source 1..30: mol_type = genomic DNA
ttgaaaggcctggcacgtcccagtctatat

SEQ ID NO: 8912 - DNA, 50 bp, Homo sapiens
  misc_feature 1..50: note = chr7:20838460-20838510
  misc_feature 1..50: note = hyper
  source 1..50: mol_type = genomic DNA
aagggctagttaaaacgcagatggctgggctcgtccgcagagtttctgct

SEQ ID NO: 8913 - DNA, 30 bp, Homo sapiens
  misc_feature 1..30: note = chr7:21582593-21582623
  misc_feature 1..30: note = hyper
  source 1..30: mol_type = genomic DNA
tcactccgcccccagcgggctggggcgggg

SEQ ID NO: 8914 - DNA, 74 bp, Homo sapiens
  misc_feature 1..74: note = chr7:21582834-21582908
  misc_feature 1..74: note = hyper
  source 1..74: mol_type = genomic DNA
ggcctcgcgttccctcggacggttgcccaatggcagcccaggtggcagcccgggaggcgcgagacttcagagaa

SEQ ID NO: 8915 - DNA, 545 bp, Homo sapiens; identical to SEQ ID NO: 648
  misc_feature 1..545: note = chr7:22589325-22589870
  misc_feature 1..545: note = hyper
  source 1..545: mol_type = genomic DNA

SEQ ID NO: 8916 - DNA, 98 bp, Homo sapiens; identical to SEQ ID NO: 2986
  misc_feature 1..98: note = chr7:23287253-23287351
  misc_feature 1..98: note = hyper
  source 1..98: mol_type = genomic DNA

SEQ ID NO: 8917 - DNA, 92 bp, Homo sapiens; identical to SEQ ID NO: 2987
  misc_feature 1..92: note = chr7:23287532-23287624
  misc_feature 1..92: note = hyper
  source 1..92: mol_type = genomic DNA

SEQ ID NO: 8918 - DNA, 476 bp, Homo sapiens
  misc_feature 1..476: note = chr7:23508261-23508737
  misc_feature 1..476: note = hyper
  source 1..476: mol_type = genomic DNA
ccctcgaagggcccccgaggcccggacgcggctccaggcggagggagaagccgaccccctcgagcggcgtgggcatttaactcgcagatggttggggagcagggtccgctggcgggcccactacttgggtatcagtccagtctccaagcctcccccacccacccctgggggccaccaacaccacgaggcccgcaagagggacgcggcccaccctctcaccgccctggacacgctccacagggcagactcggggcagggggctcccctggctttcttcaggagggggcgccctggccctgccctctgcttcagcccagacccgccgggaacactcagcggtgggcttgaggaagacagggagtggcgagaaagggtcggggacggcaggggagaccacgaacgggagaactggcagaggcgcagctcggcacaggctgaaccaggcgcgaaggacggcgaggcgcccgcaccacgtc

SEQ ID NO: 8919 - DNA, 220 bp, Homo sapiens
  misc_feature 1..220: note = chr7:23509018-23509238
  misc_feature 1..220: note = hyper
  source 1..220: mol_type = genomic DNA
agggtggggaggaagcgcggggccgcctgtgcgaggcaccagcctcgcggtctcactcggcagcacggtcgaggccactttccgttctccacggccgggggtttcggggcgcagcacagacagcgccgtaaataacgaccgaggaaagcaggaaggaacgaggcacaggcgggcattctagctcggcccccgaggcccagcgtgccggggcctggagcac

SEQ ID NO: 8920 - DNA, 30 bp, Homo sapiens
  misc_feature 1..30: note = chr7:23509641-23509671
  misc_feature 1..30: note = hyper
  source 1..30: mol_type = genomic DNA
acaccgggatcttggcgtccttgaagatac

SEQ ID NO: 8921 - DNA, 406 bp, Homo sapiens
  misc_feature 1..406: note = chr7:23513721-23514127
  misc_feature 1..406: note = hyper
  source 1..406: mol_type = genomic DNA
caccccacctgagtccgccggccagcgcggggacgcaccgggcagcgtgtgtttggcgaccctcccgcacctctggtctcagttgcgtgtgtgcacgaggggttccatagggcccagggatgcttggtacccacgggggagaatccctcgccgaaccctgcgggtctgcggggcgggccgcgagactggcgcgcaaaagcggctccaaggcggggctcccgcgctccccggggccggcttgccgagtccaagttgagcaaccggcgtcgagagagacaccgcccctgctgcgggcgggggcctctcctcgcttccgattggctgacggggggaacctatcgccgtcggccgcctccgccagagcggtttgctggttttcattcattggccccggagccgcccctgg

SEQ ID NO: 8922 - DNA, 36 bp, Homo sapiens
  misc_feature 1..36: note = chr7:23514666-23514702
  misc_feature 1..36: note = hyper
  source 1..36: mol_type = genomic DNA
actatgctgagaccacgttttcgttgaagctgccct

SEQ ID NO: 8923 - DNA, 84 bp, Homo sapiens
  misc_feature 1..84: note = chr7:24796506-24796590
  misc_feature 1..84: note = hyper
  source 1..84: mol_type = genomic DNA
agggggacttttttccgtccagagagactgaactccgtatctgttccgcggtccgcctccctgcacacacgcccccgagccggg

SEQ ID NO: 8924 - DNA, 301 bp, Homo sapiens
  misc_feature 1..301: note = chr7:24797253-24797554
  misc_feature 1..301: note = hyper
  source 1..301: mol_type = genomic DNA
tgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacggttcaaccaggaaagtccaaggcctgtccagcctgtgggagcccctaatgcccgtgcctggagtagt

SEQ ID NO: 8925 - DNA, 159 bp, Homo sapiens; identical to SEQ ID NO: 649
  misc_feature 1..159: note = chr7:25896441-25896600
  misc_feature 1..159: note = hyper
  source 1..159: mol_type = genomic DNA

SEQ ID NO: 8926 - DNA, 278 bp, Homo sapiens; identical to SEQ ID NO: 650
  misc_feature 1..278: note = chr7:25896660-25896938
  misc_feature 1..278: note = hyper
  source 1..278: mol_type = genomic DNA

SEQ ID NO: 8927 - DNA, 30 bp, Homo sapiens
  misc_feature 1..30: note = chr7:25902574-25902604
  misc_feature 1..30: note = hyper
  source 1..30: mol_type = genomic DNA
ttggttcttacaagtcgttaagagttgtaa

SEQ ID NO: 8928 - DNA, 281 bp, Homo sapiens
  misc_feature 1..281: note = chr7:26415803-26416084
  misc_feature 1..281: note = hyper
  source 1..281: mol_type = genomic DNA
cccgcgcgcatcccccgcgctgcgtcccgcacacgcgcgctcccgccgcgtcccgcccgggccgctccgctggcggcggcgactgggctgcaggtagcgagccagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttaccgcgcgggcctgcggctcccggccgcacctgctg

SEQ ID NO: 8929 - DNA, 505 bp, Homo sapiens; identical to SEQ ID NO: 651
  misc_feature 1..505: note = chr7:27135266-27135771
  misc_feature 1..505: note = hyper
  source 1..505: mol_type = genomic DNA

SEQ ID NO: 8930 - DNA, 445 bp, Homo sapiens; identical to SEQ ID NO: 652
  misc_feature 1..445: note = chr7:27135979-27136424
  misc_feature 1..445: note = hyper
  source 1..445: mol_type = genomic DNA

SEQ ID NO: 8931 - DNA, 324 bp, Homo sapiens; identical to SEQ ID NO: 653
  misc_feature 1..324: note = chr7:27136425-27136749
  misc_feature 1..324: note = hyper
  source 1..324: mol_type = genomic DNA

SEQ ID NO: 8932 - DNA, 699 bp, Homo sapiens; identical to SEQ ID NO: 654
  misc_feature 1..699: note = chr7:27190372-27191071
  misc_feature 1..699: note = hyper
  source 1..699: mol_type = genomic DNA

SEQ ID NO: 8933 - DNA, 16 bp, Homo sapiens
  misc_feature 1..16: note = chr7:27195586-27195602
  misc_feature 1..16: note = hyper
  source 1..16: mol_type = genomic DNA
atgctatgggctccac

SEQ ID NO: 8934 - DNA, 27 bp, Homo sapiens
  misc_feature 1..27: note = chr7:27195866-27195893
  misc_feature 1..27: note = hyper
  source 1..27: mol_type = genomic DNA
cgcctttggcgaggtcactgcagagcc

SEQ ID NO: 8935 - skipped

SEQ ID NO: 8936 - DNA, 132 bp, Homo sapiens; identical to SEQ ID NO: 658
  misc_feature 1..132: note = chr7:27196154-27196286
  misc_feature 1..132: note = hyper
  source 1..132: mol_type = genomic DNA

SEQ ID NO: 8937 - DNA, 351 bp, Homo sapiens; identical to SEQ ID NO: 659
  misc_feature 1..351: note = chr7:27196287-27196638
  misc_feature 1..351: note = hyper
  source 1..351: mol_type = genomic DNA

SEQ ID NO: 8938 - DNA, 354 bp, Homo sapiens
  misc_feature 1..354: note = chr7:27204416-27204770
  misc_feature 1..354: note = hyper
  source 1..354: mol_type = genomic DNA
tcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccgg

SEQ ID NO: 8939 - DNA, 99 bp, Homo sapiens
  misc_feature 1..99: note = chr7:27205265-27205364
  misc_feature 1..99: note = hyper
  source 1..99: mol_type = genomic DNA
cgctattaatggtccgatgttttgcagtcataatttttatagcaaaagccatatgtttttatgtaaagggatcgtgccgctctacgatggggtttgttt

SEQ ID NO: 8940 - DNA, 84 bp, Homo sapiens
  misc_feature 1..84: note = chr7:27205706-27205790
  misc_feature 1..84: note = hyper
  source 1..84: mol_type = genomic DNA
agctgtaaaaatttacgaggacttggaaaggttagactgttgtgtttggttggcgagctccctgtaaataatccctgcggtccc

SEQ ID NO: 8941 - DNA, 80 bp, Homo sapiens
  misc_feature 1..80: note = chr7:27209584-27209664
  misc_feature 1..80: note = hyper
  source 1..80: mol_type = genomic DNA
ctccctgtctggccccggcctcccgcctctcgctctccccctctccctcctagctgcccgcccgccggggcgcgcgctcc

SEQ ID NO: 8942 - DNA, 324 bp, Homo sapiens; identical to SEQ ID NO: 660
  misc_feature 1..324: note = chr7:27212660-27212984
  misc_feature 1..324: note = hyper
  source 1..324: mol_type = genomic DNA

SEQ ID NO: 8943 - DNA, 796 bp, Homo sapiens; identical to SEQ ID NO: 661
  misc_feature 1..796: note = chr7:27213188-27213984
  misc_feature 1..796: note = hyper
  source 1..796: mol_type = genomic DNA

SEQ ID NO: 8944 - DNA, 277 bp, Homo sapiens; identical to SEQ ID NO: 662
  misc_feature 1..277: note = chr7:27213985-27214262
  misc_feature 1..277: note = hyper
  source 1..277: mol_type = genomic DNA

SEQ ID NO: 8945 - DNA, 448 bp, Homo sapiens
  misc_feature 1..448: note = chr7:27219396-27219844
  misc_feature 1..448: note = hyper
  source 1..448: mol_type = genomic DNA
tgttatgaaggggagcgggacaagtgaaataatgtaccgtgctgctcttagtatcagaagcgaacaaaggccaagaatcatgctggggttcccggctccccggcggctttgacattgatcggaagtgcgccatctcgtggcggctgcgcgcctaggttgggccggagttccagccccgagccgagagacggaaaccagctccgggcagagagagaaggagagaggagaggatgtgcccagcccgctgctattgagatctcatttttacatctaagaaatcgctgcaaaaccccagccgggtttatagcggcgcattccaaatatgcaaattggccggccccggacgggtttacgaccacattgtcacagccatcggaggatgggcttttatagggctcagaaatcaaacccgcgcccgcccgccgcccgcccgcgagcagtcctcctg

SEQ ID NO: 8946 - DNA, 27 bp, Homo sapiens
  misc_feature 1..27: note = chr7:27223166-27223193
  misc_feature 1..27: note = hyper
  source 1..27: mol_type = genomic DNA
cagcttctgcctccccggccagccttc

SEQ ID NO: 8947 - DNA, 59 bp, Homo sapiens
  misc_feature 1..59: note = chr7:27223221-27223280
  misc_feature 1..59: note = hyper
  source 1..59: mol_type = genomic DNA
cggaagccccctaccctaggccttcgctgagcaccacggccacacggccatcctgcaca

SEQ ID NO: 8948 - DNA, 159 bp, Homo sapiens
  misc_feature 1..159: note = chr7:27223601-27223760
  misc_feature 1..159: note = hyper
  source 1..159: mol_type = genomic DNA
gccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctg

SEQ ID NO: 8949 - DNA, 633 bp, Homo sapiens; identical to SEQ ID NO: 3002
  misc_feature 1..633: note = chr7:27223976-27224609
  misc_feature 1..633: note = hyper
  source 1..633: mol_type = genomic DNA

SEQ ID NO: 8950 - skipped

SEQ ID NO: 8951 - DNA, 680 bp, Homo sapiens; identical to SEQ ID NO: 3003
  misc_feature 1..680: note = chr7:27232300-27232980
  misc_feature 1..680: note = hyper
  source 1..680: mol_type = genomic DNA

SEQ ID NO: 8952 - DNA, 32 bp, Homo sapiens
  misc_feature 1..32: note = chr7:27239141-27239173
  misc_feature 1..32: note = hyper
  source 1..32: mol_type = genomic DNA
gcccatgcgggcgcacgggtagtagccgctgc

SEQ ID NO: 8953 - DNA, 223 bp, Homo sapiens
  misc_feature 1..223: note = chr7:27239225-27239448
  misc_feature 1..223: note = hyper
  source 1..223: mol_type = genomic DNA
cgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggcc

SEQ ID NO: 8954 - DNA, 162 bp, Homo sapiens
  misc_feature 1..162: note = chr7:27239668-27239830
  misc_feature 1..162: note = hyper
  source 1..162: mol_type = genomic DNA
gggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccg

SEQ ID NO: 8955 - DNA, 35 bp, Homo sapiens
  misc_feature 1..35: note = chr7:27240230-27240265
  misc_feature 1..35: note = hyper
  source 1..35: mol_type = genomic DNA
tttctttccaggaaccggcgcgtatttctgcagtg

SEQ ID NO: 8956 - DNA, 30 bp, Homo sapiens
  misc_feature 1..30: note = chr7:27240997-27241027
  misc_feature 1..30: note = hyper
  source 1..30: mol_type = genomic DNA
aaccaagcagcgacccgtcttgtagctgcc

SEQ ID NO: 8957 - DNA, 72 bp, Homo sapiens
  misc_feature 1..72: note = chr7:27244539-27244611
  misc_feature 1..72: note = hyper
  source 1..72: mol_type = genomic DNA
actcctcagagctggcgcaaactccgtcctccaaaactcggctctgggaggcctaagtgactccgaagccgg

SEQ ID NO: 8958 - DNA, 378 bp, Homo sapiens; identical to SEQ ID NO: 663
  misc_feature 1..378: note = chr7:27244932-27245310
  misc_feature 1..378: note = hyper
  source 1..378: mol_type = genomic DNA

SEQ ID NO: 8959 - DNA, 24 bp, Homo sapiens
  misc_feature 1..24: note = chr7:27252795-27252819
  misc_feature 1..24: note = hyper
  source 1..24: mol_type = genomic DNA
tttttctttctctcccggattgtt

SEQ ID NO: 8960 - DNA, 270 bp, Homo sapiens
  misc_feature 1..270: note = chr7:27252895-27253165
  misc_feature 1..270: note = hyper
  source 1..270: mol_type = genomic DNA
cggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggccc

SEQ ID NO: 8961 - DNA, 437 bp, Homo sapiens; identical to SEQ ID NO: 664
  misc_feature 1..437: note = chr7:27264875-27265312
  misc_feature 1..437: note = hyper
  source 1..437: mol_type = genomic DNA

SEQ ID NO: 8962 - DNA, 46 bp, Homo sapiens; identical to SEQ ID NO: 3006
  misc_feature 1..46: note = chr7:27265538-27265584
  misc_feature 1..46: note = hyper
  source 1..46: mol_type = genomic DNA

SEQ ID NO: 8963 - DNA, 132 bp, Homo sapiens; identical to SEQ ID NO: 665
  misc_feature 1..132: note = chr7:27279237-27279369
  misc_feature 1..132: note = hyper
  source 1..132: mol_type = genomic DNA

SEQ ID NO: 8964 - DNA, 18 bp, Homo sapiens
  misc_feature 1..18: note = chr7:27279453-27279471
  misc_feature 1..18: note = hyper
  source 1..18: mol_type = genomic DNA
cgccgggcctggagcggc

SEQ ID NO: 8965 - DNA, 200 bp, Homo sapiens
  misc_feature 1..200: note = chr7:27282262-27282462
  misc_feature 1..200: note = hyper
  source 1..200: mol_type = genomic DNA
ccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtga

SEQ ID NO: 8966 - DNA, 549 bp, Homo sapiens
  misc_feature 1..549: note = chr7:27282746-27283295
  misc_feature 1..549: note = hyper
  source 1..549: mol_type = genomic DNA
gcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 8967 - DNA, 118 bp, Homo sapiens; identical to SEQ ID NO: 3009
  misc_feature 1..118: note = chr7:27285707-27285825
  misc_feature 1..118: note = hyper
  source 1..118: mol_type = genomic DNA

SEQ ID NO: 8968 - DNA, 30 bp, Homo sapiens
  misc_feature 1..30: note = chr7:27289482-27289512
  misc_feature 1..30: note = hyper
  source 1..30: mol_type = genomic DNA
ggcatgccccacgaacggtttctttagtga

SEQ ID NO: 8969 - DNA, 44 bp, Homo sapiens
  misc_feature 1..44: note = chr7:27289813-27289857
  misc_feature 1..44: note = hyper
  source 1..44: mol_type = genomic DNA
cagccaccatatgtccgccggagaataagcgtgagtgtcgcggt

SEQ ID NO: 8970 - DNA, 173 bp, Homo sapiens; identical to SEQ ID NO: 667
  misc_feature 1..173: note = chr7:27290946-27291119
  misc_feature 1..173: note = hyper
  source 1..173: mol_type = genomic DNA

SEQ ID NO: 8971 - DNA, 537 bp, Homo sapiens; identical to SEQ ID NO: 668
  misc_feature 1..537: note = chr7:27291314-27291851
  misc_feature 1..537: note = hyper
  source 1..537: mol_type = genomic DNA

SEQ ID NO: 8972 - DNA, 38 bp, Homo sapiens; identical to SEQ ID NO: 3012
  misc_feature 1..38: note = chr7:28449253-28449291
  misc_feature 1..38: note = hyper
  source 1..38: mol_type = genomic DNA

SEQ ID NO: 8973 - DNA, 124 bp, Homo sapiens; identical to SEQ ID NO: 3013
  misc_feature 1..124: note = chr7:28449658-28449782
  misc_feature 1..124: note = hyper
  source 1..124: mol_type = genomic DNA

SEQ ID NO: 8974 - DNA, 184 bp, Homo sapiens; identical to SEQ ID NO: 3014
  misc_feature 1..184: note = chr7:28449857-28450041
  misc_feature 1..184: note = hyper
  source 1..184: mol_type = genomic DNA

SEQ ID NO: 8975 - DNA, 33 bp, Homo sapiens
  misc_feature 1..33: note = chr7:28995925-28995958
  misc_feature 1..33: note = hyper
  source 1..33: mol_type = genomic DNA
tgggtcggacaccagcggcggcagcccggcccc

SEQ ID NO: 8976 - DNA, 256 bp, Homo sapiens
  misc_feature 1..256: note = chr7:28996623-28996879
  misc_feature 1..256: note = hyper
  source 1..256: mol_type = genomic DNA
cggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcc

SEQ ID NO: 8977 - DNA, 239 bp, Homo sapiens
  misc_feature 1..239: note = chr7:28997128-28997367
  misc_feature 1..239: note = hyper
  source 1..239: mol_type = genomic DNA
caagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggt

SEQ ID NO: 8978 - DNA, 62 bp, Homo sapiens
  misc_feature 1..62: note = chr7:28997584-28997646
  misc_feature 1..62: note = hyper
  source 1..62: mol_type = genomic DNA
acacgggctcggcagcggcgggagcgcgaggcagccgcacaccacgagcaggaggcgcaagg

SEQ ID NO: 8979 - DNA, 479 bp, Homo sapiens
  misc_feature 1..479: note = chr7:28997676-28998155
  misc_feature 1..479: note = hyper
  source 1..479: mol_type = genomic DNA
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcg

SEQ ID NO: 8980 - DNA, 332 bp, Homo sapiens; identical to SEQ ID NO: 3015
  misc_feature 1..332: note = chr7:29185865-29186197
  misc_feature 1..332: note = hyper
  source 1..332: mol_type = genomic DNA

SEQ ID NO: 8981 - DNA, 43 bp, Homo sapiens
  misc_feature 1..43: note = chr7:29604285-29604328
  misc_feature 1..43: note = hyper
  source 1..43: mol_type = genomic DNA
aatgacttgggggtacgggttgcttttccgatctgcaaagtag

SEQ ID NO: 8982 - DNA, 95 bp, Homo sapiens
  misc_feature 1..95: note = chr7:29846202-29846297
  misc_feature 1..95: note = hyper
  source 1..95: mol_type = genomic DNA
ctgcgggacggagcccggagccggaggcggcggcggcggagacgtcggccggagctcgagtccagtccagcccccggctccgccacctgcaggta

SEQ ID NO: 8983 - DNA, 476 bp, Homo sapiens; identical to SEQ ID NO: 669
  misc_feature 1..476: note = chr7:30721202-30721678
  misc_feature 1..476: note = hyper
  source 1..476: mol_type = genomic DNA

SEQ ID NO: 8984 - DNA, 88 bp, Homo sapiens
  misc_feature 1..88: note = chr7:30722026-30722114
  misc_feature 1..88: note = hyper
  source 1..88: mol_type = genomic DNA
cgggcagcctttgggcgccacctccggtcgcccagagctgtcaagtggggaccttcccggagaggagccgccgagtgcacggagctgc

SEQ ID NO: 8985 - DNA, 260 bp, Homo sapiens
  misc_feature 1..260: note = chr7:30722115-30722375
  misc_feature 1..260: note = hyper
  source 1..260: mol_type = genomic DNA
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgc

SEQ ID NO: 8986 - DNA, 39 bp, Homo sapiens
  misc_feature 1..39: note = chr7:31092310-31092349
  misc_feature 1..39: note = hyper
  source 1..39: mol_type = genomic DNA
gcggctgcccctccacgcctcggccgtcttctccccctc

SEQ ID NO: 8987 - DNA, 15 bp, Homo sapiens
  misc_feature 1..15: note = chr7:31092684-31092699
  misc_feature 1..15: note = hyper
  source 1..15: mol_type = genomic DNA
ctacccttaggtgga

SEQ ID NO: 8988 - DNA, 167 bp, Homo sapiens
  misc_feature 1..167: note = chr7:31092713-31092880
  misc_feature 1..167: note = hyper
  source 1..167: mol_type = genomic DNA
cggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtctt

SEQ ID NO: 8989 - DNA, 296 bp, Homo sapiens
  misc_feature 1..296: note = chr7:31092894-31093190
  misc_feature 1..296: note = hyper
  source 1..296: mol_type = genomic DNA
cggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcgggaccttggcaggttagggggctcagaagggacaggggagccgatggatgcaactagaccctcaggagggaacccagccggaagccgattgcatttcacgtggagctgaggag

SEQ ID NO: 8990 - DNA, 39 bp, Homo sapiens
  misc_feature 1..39: note = chr7:32110353-32110392
  misc_feature 1..39: note = hyper
  source 1..39: mol_type = genomic DNA
acaaagccacagaagcgatcagcgcgcagctaaagggtt

SEQ ID NO: 8991 - DNA, 89 bp, Homo sapiens; identical to SEQ ID NO: 3017
  misc_feature 1..89: note = chr7:32110706-32110795
  misc_feature 1..89: note = hyper
  source 1..89: mol_type = genomic DNA

SEQ ID NO: 8992 - DNA, 73 bp, Homo sapiens; identical to SEQ ID NO: 3018
  misc_feature 1..73: note = chr7:32338145-32338218
  misc_feature 1..73: note = hyper
  source 1..73: mol_type = genomic DNA

SEQ ID NO: 8993 - DNA, 305 bp, Homo sapiens; identical to SEQ ID NO: 3019
  misc_feature 1..305: note = chr7:32338283-32338588
  misc_feature 1..305: note = hyper
  source 1..305: mol_type = genomic DNA

SEQ ID NO: 8994 - DNA, 90 bp, Homo sapiens
  misc_feature 1..90: note = chr7:32338925-32339015
  misc_feature 1..90: note = hyper
  source 1..90: mol_type = genomic DNA
tccaaacaaggaagtcgggaaaatcgccacgcccacttccttctagccactgcccccagcactggcctggagccccgatagtgtttcttc

SEQ ID NO: 8995 - DNA, 237 bp, Homo sapiens; identical to SEQ ID NO: 670
  misc_feature 1..237: note = chr7:32467419-32467656
  misc_feature 1..237: note = hyper
  source 1..237: mol_type = genomic DNA

SEQ ID NO: 8996 - DNA, 69 bp, Homo sapiens; identical to SEQ ID NO: 671
  misc_feature 1..69: note = chr7:32467946-32468015
  misc_feature 1..69: note = hyper
  source 1..69: mol_type = genomic DNA

SEQ ID NO: 8997 - DNA, 30 bp, Homo sapiens
  misc_feature 1..30: note = chr7:32468472-32468502
  misc_feature 1..30: note = hyper
  source 1..30: mol_type = genomic DNA
gtgtggtggtgcctacgtagagcagaagca

SEQ ID NO: 8998 - DNA, 266 bp, Homo sapiens; identical to SEQ ID NO: 672
  misc_feature 1..266: note = chr7:33943692-33943958
  misc_feature 1..266: note = hyper
  source 1..266: mol_type = genomic DNA

SEQ ID NO: 8999 - DNA, 123 bp, Homo sapiens
  misc_feature 1..123: note = chr7:33944250-33944373
  misc_feature 1..123: note = hyper
  source 1..123: mol_type = genomic DNA
acttgcccctctgtccgctcagccccctgagttcgctgtcgcgcccccgccagagggaagcaaagcagggcatgaaaagttgcgggggccctactgccccgggtgtgtcgctccttcccaaag

SEQ ID NO: 9000 - DNA, 81 bp, Homo sapiens
  misc_feature 1..81: note = chr7:33944751-33944832
  misc_feature 1..81: note = hyper
  source 1..81: mol_type = genomic DNA
aggaggtgaggagtgcgggagtggaggacgctgcggcagcgacagcgacagcccccgaaacagtagcggcagcccgggcgg

SEQ ID NO: 9001 - DNA, 66 bp, Homo sapiens
  misc_feature 1..66: note = chr7:33945406-33945472
  misc_feature 1..66: note = hyper
  source 1..66: mol_type = genomic DNA
acctgggaaaggtggcgctggcttgccccggggatgggagggtggggagcgcgcaccttggcgctt

SEQ ID NO: 9002 - DNA, 554 bp, Homo sapiens; identical to SEQ ID NO: 3023
  misc_feature 1..554: note = chr7:35225280-35225834
  misc_feature 1..554: note = hyper
  source 1..554: mol_type = genomic DNA

SEQ ID NO: 9003 - DNA, 420 bp, Homo sapiens; identical to SEQ ID NO: 3024
  misc_feature 1..420: note = chr7:35226044-35226464
  misc_feature 1..420: note = hyper
  source 1..420: mol_type = genomic DNA

SEQ ID NO: 9004 - DNA, 296 bp, Homo sapiens; identical to SEQ ID NO: 673
  misc_feature 1..296: note = chr7:35293182-35293478
  misc_feature 1..296: note = hyper
  source 1..296: mol_type = genomic DNA

SEQ ID NO: 9005 - DNA, 110 bp, Homo sapiens; identical to SEQ ID NO: 674
  misc_feature 1..110: note = chr7:35294031-35294141
  misc_feature 1..110: note = hyper
  source 1..110: mol_type = genomic DNA

SEQ ID NO: 9006 - DNA, 73 bp, Homo sapiens; identical to SEQ ID NO: 3027
  misc_feature 1..73: note = chr7:35294502-35294575
  misc_feature 1..73: note = hyper
  source 1..73: mol_type = genomic DNA

SEQ ID NO: 9007 - DNA, 53 bp, Homo sapiens; identical to SEQ ID NO: 675
  misc_feature 1..53: note = chr7:35296952-35297005
  misc_feature 1..53: note = hyper
  source 1..53: mol_type = genomic DNA

SEQ ID NO: 9008 - DNA, 217 bp, Homo sapiens; identical to SEQ ID NO: 676
  misc_feature 1..217: note = chr7:35297137-35297354
  misc_feature 1..217: note = hyper
  source 1..217: mol_type = genomic DNA

SEQ ID NO: 9009 - DNA, 547 bp, Homo sapiens; identical to SEQ ID NO: 677
  misc_feature 1..547: note = chr7:35297470-35298017
  misc_feature 1..547: note = hyper
  source 1..547: mol_type = genomic DNA

SEQ ID NO: 9010 - DNA, 58 bp, Homo sapiens
  misc_feature 1..58: note = chr7:35300951-35301009
  misc_feature 1..58: note = hyper
  source 1..58: mol_type = genomic DNA
ctttcacttggcctgcgctcaggtcagtgcgccccttaccggagcacccatggcctcc

SEQ ID NO: 9011 - DNA, 500 bp, Homo sapiens; identical to SEQ ID NO: 678
  misc_feature 1..500: note = chr7:35301244-35301744
  misc_feature 1..500: note = hyper
  source 1..500: mol_type = genomic DNA

SEQ ID NO: 9012 - DNA, 147 bp, Homo sapiens; identical to SEQ ID NO: 679
  misc_feature 1..147: note = chr7:37487113-37487260
  misc_feature 1..147: note = hyper
  source 1..147: mol_type = genomic DNA

SEQ ID NO: 9013 - DNA, 74 bp, Homo sapiens; identical to SEQ ID NO: 680
  misc_feature 1..74: note = chr7:37487380-37487454
  misc_feature 1..74: note = hyper
  source 1..74: mol_type = genomic DNA

SEQ ID NO: 9014 - DNA, 71 bp, Homo sapiens; identical to SEQ ID NO: 681
  misc_feature 1..71: note = chr7:37487755-37487826
  misc_feature 1..71: note = hyper
  source 1..71: mol_type = genomic DNA

SEQ ID NO: 9015 - DNA, 878 bp, Homo sapiens; identical to SEQ ID NO: 3035
  misc_feature 1..878: note = chr7:37488141-37489019
  misc_feature 1..878: note = hyper
  source 1..878: mol_type = genomic DNA

SEQ ID NO: 9016 - DNA, 234 bp, Homo sapiens
  misc_feature 1..234: note = chr7:37955745-37955979
  misc_feature 1..234: note = hyper
  source 1..234: mol_type = genomic DNA
catagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactccagggtgcaaatgggcgcgtacatggcacagaggaagaagcgcagcacggcgctgcagttcacgtccaccagctcctcgtactgctcgatggccaggatgg

SEQ ID NO: 9017 - DNA, 222 bp, Homo sapiens
  misc_feature 1..222: note = chr7:37956271-37956493
  misc_feature 1..222: note = hyper
  source 1..222: mol_type = genomic DNA
cagtcggcagcaaagcggggccgcggggtccggccgcggagctccgccgtctggcacacagggcacgagcagcgccagctctcagccttcggggcgcgaacccgcccgggcagctccagtcccggactccgcagctcggagcgcagccagccacggccattgcgggaccctatttatcccgacacctcccctgacgtgggctcggaacgctcccttggcagc

SEQ ID NO: 9018 - DNA, 72 bp, Homo sapiens
  misc_feature 1..72: note = chr7:37960465-37960537
  misc_feature 1..72: note = hyper
  source 1..72: mol_type = genomic DNA
gagccactctgatcccggacgcctcagcgcccccttgggcttgggcttgccctcgggccggggaaggctgac

SEQ ID NO: 9019 - DNA, 396 bp, Homo sapiens
  misc_feature 1..396: note = chr7:37960562-37960958
  misc_feature 1..396: note = hyper
  source 1..396: mol_type = genomic DNA
cgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagaggtacaggtcatcggcccgcggggcgggagtagggagccgcgcgggcatggggagggcgaggtcgcagaggcctgcgccctgtaactctttccggccccttgcagctcctcccttctcccagagagatctttcgcgaggagggtctctt

SEQ ID NO: 9020 - DNA, 268 bp, Homo sapiens; identical to SEQ ID NO: 682
  misc_feature 1..268: note = chr7:38670396-38670664
  misc_feature 1..268: note = hyper
  source 1..268: mol_type = genomic DNA

SEQ ID NO: 9021 - DNA, 44 bp, Homo sapiens
  misc_feature 1..44: note = chr7:38671120-38671164
  misc_feature 1..44: note = hyper
  source 1..44: mol_type = genomic DNA
gggaccagcttaaagcgacagagcgggggcgggatgcgtcggga

SEQ ID NO: 9022 - DNA, 269 bp, Homo sapiens
  misc_feature 1..269: note = chr7:39015574-39015843
  misc_feature 1..269: note = hyper
  source 1..269: mol_type = genomic DNA
ctgcactacagaggacgcaggacgccaaaaccaccccggggctcacgccatccgcgcaccggctctgctgcctaagtccgaggacgcaggcggagggcgcggggctcccgggcgcccaggagggcggtgccgccggggtgcgctccaggcttggctgcaaaccccccaagaattagaaagcgggggcggctgctcagcggctgctgcggcctgggactgcagctcgcccctcctccgcaacttcccactggtcccgtcacctggctttc

SEQ ID NO: 9023 - DNA, 64 bp, Homo sapiens
  misc_feature 1..64: note = chr7:39453541-39453605
  misc_feature 1..64: note = hyper
  source 1..64: mol_type = genomic DNA
aagatgccccacaaacgacggtcccctggtccgaggagccgggcagcgccgcgcagccgtctcg

SEQ ID NO: 9024 - DNA, 30 bp, Homo sapiens
  misc_feature 1..30: note = chr7:39454074-39454104
  misc_feature 1..30: note = hyper
  source 1..30: mol_type = genomic DNA
cggaagtgccctcgccgtcctgaggcctgg

SEQ ID NO: 9025 - DNA, 52 bp, Homo sapiens
  misc_feature 1..52: note = chr7:42267660-42267712
  misc_feature 1..52: note = hyper
  source 1..52: mol_type = genomic DNA
cccgaggtcccaggccgcggcggcggcgcggtgggttcattagcgggcgcgc

SEQ ID NO: 9026 - DNA, 42 bp, Homo sapiens
  misc_feature 1..42: note = chr7:42275797-42275839
  misc_feature 1..42: note = hyper
  source 1..42: mol_type = genomic DNA
ctctctgccttctcccgcccgttttcccgctgctactcaaga

SEQ ID NO: 9027 - DNA, 50 bp, Homo sapiens
  misc_feature 1..50: note = chr7:42276128-42276178
  misc_feature 1..50: note = hyper
  source 1..50: mol_type = genomic DNA
cctcccgcctccttccgcccatcccgagcgccgtgcgcgcccgaagcccg

SEQ ID NO: 9028 - DNA, 338 bp, Homo sapiens
  misc_feature 1..338: note = chr7:42276557-42276895
  misc_feature 1..338: note = hyper
  source 1..338: mol_type = genomic DNA
agcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcc

SEQ ID NO: 9029 - DNA, 47 bp, Homo sapiens
  misc_feature 1..47: note = chr7:42277420-42277467
  misc_feature 1..47: note = hyper
  source 1..47: mol_type = genomic DNA
cccgcttctcccgcccgccgggtccccaagcccggagtgggtcccag

SEQ ID NO: 9030 - DNA, 73 bp, Homo sapiens
  misc_feature 1..73: note = chr7:42277748-42277821
  misc_feature 1..73: note = hyper
  source 1..73: mol_type = genomic DNA
gaggggaagggggcccgggcgtgatgtcacccgcgccctctctcttctctctccacaccgccaggacaccccc

SEQ ID NO: 9031 - DNA, 15 bp, Homo sapiens
  misc_feature 1..15: note = chr7:43152193-43152208
  misc_feature 1..15: note = hyper
  source 1..15: mol_type = genomic DNA
gggaggggatgcaag

SEQ ID NO: 9032 - DNA, 502 bp, Homo sapiens; identical to SEQ ID NO: 3038
  misc_feature 1..502: note = chr7:43152413-43152915
  misc_feature 1..502: note = hyper
  source 1..502: mol_type = genomic DNA

SEQ ID NO: 9033 - DNA, 252 bp, Homo sapiens
  misc_feature 1..252: note = chr7:43153229-43153481
  misc_feature 1..252: note = hyper
  source 1..252: mol_type = genomic DNA
cgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtctt

SEQ ID NO: 9034 - DNA, 41 bp, Homo sapiens
  misc_feature 1..41: note = chr7:44144029-44144070
  misc_feature 1..41: note = hyper
  source 1..41: mol_type = genomic DNA
cgaccacccctgagcccctctggcttcggagccccccagca

SEQ ID NO: 9035 - DNA, 346 bp, Homo sapiens
  misc_feature 1..346: note = chr7:44364736-44365082
  misc_feature 1..346: note = hyper
  source 1..346: mol_type = genomic DNA
agagctgggcagggccgcgcgcgctgaggtcaggcagccaggcccggggccgggggctcgcgggtcggggccgcgcggggccgtgcgcttgggcccggagcccagagaagccggcggcgcgcgggcccgcagtgcgcctggagccggcggcgcggagggtcccggaggtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcc

SEQ ID NO: 9036 - DNA, 66 bp, Homo sapiens
  misc_feature 1..66: note = chr7:44365117-44365183
  misc_feature 1..66: note = hyper
  source 1..66: mol_type = genomic DNA
cgggagacacctcggctcgcggcgccaggcgggggccgggctgggctgcgccgggcggcgagcgca

SEQ ID NO: 9037 - DNA, 279 bp, Homo sapiens; identical to SEQ ID NO: 3039
  misc_feature 1..279: note = chr7:45613535-45613814
  misc_feature 1..279: note = hyper
  source 1..279: mol_type = genomic DNA

SEQ ID NO: 9038 - DNA, 880 bp, Homo sapiens; identical to SEQ ID NO: 3040
  misc_feature 1..880: note = chr7:45613857-45614737
  misc_feature 1..880: note = hyper
  source 1..880: mol_type = genomic DNA

SEQ ID NO: 9039 - DNA, 87 bp, Homo sapiens
  misc_feature 1..87: note = chr7:45928490-45928577
  misc_feature 1..87: note = hyper
  source 1..87: mol_type = genomic DNA
gggactcagttgccgcgcgctgccgggggagcagcaacctctgcacgccctcacccgcggccaaggcgcctgcgtgcaggagtctga

SEQ ID NO: 9040 - DNA, 373 bp, Homo sapiens
  misc_feature 1..373: note = chr7:45960743-45961116
  misc_feature 1..373: note = hyper
  source 1..373: mol_type = genomic DNA
cctgcaaccggggcacgctgcttggcaggctgggcgcgcagggatggggcgacagtacacggcgcgaagctgtggaatccaggcaggaagcggctgatcctcagcgcccagccgcagtgctcgcatctgggcggcccgggcgcgccggccgctatatagaagccggggtggcccaggacacgccccggaacggcgcgcccaggagtgggggttgggaggggggcgggtcggcgcaggcacggctgcgggggcccgtgcttcgccctgagcagccggggccgagctcgggggcgtgcagctcgagactcgcccgggcacctgctcctcgtgcgcacgcccggagcccgggtcaccttgtcgtctacaagaacca

SEQ ID NO: 9041 - DNA, 30 bp, Homo sapiens
  misc_feature 1..30: note = chr7:45961508-45961538
  misc_feature 1..30: note = hyper
  source 1..30: mol_type = genomic DNA
gcaagaagactctcacgtgttgctacaccg

SEQ ID NO: 9042 - DNA, 179 bp, Homo sapiens
  misc_feature 1..179: note = chr7:45961778-45961957
  misc_feature 1..179: note = hyper
  source 1..179: mol_type = genomic DNA
gtattactgtattctcgatgcgttgggattctagcttatctctgcaatctaaacacttttcagtaaagttcgggggcgcaattgcgcgctgaggtcgctgtaactcctgtcggccttctctggcactcgagtttcttcagttttgtctgcgcaccccctcccttcggtgaccaacagag

SEQ ID NO: 9043 - DNA, 713 bp, Homo sapiens
  misc_feature 1..713: note = chr7:48074975-48075688
  misc_feature 1..713: note = hyper
  source 1..713: mol_type = genomic DNA
ttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccc

SEQ ID NO: 9044 - DNA, 198 bp, Homo sapiens; identical to SEQ ID NO: 683
  misc_feature 1..198: note = chr7:49812820-49813018
  misc_feature 1..198: note = hyper
  source 1..198: mol_type = genomic DNA

SEQ ID NO: 9045 - DNA, 197 bp, Homo sapiens; identical to SEQ ID NO: 684
  misc_feature 1..197: note = chr7:49813809-49814006
  misc_feature 1..197: note = hyper
  source 1..197: mol_type = genomic DNA

SEQ ID NO: 9046 - DNA, 78 bp, Homo sapiens
  misc_feature 1..78: note = chr7:49814581-49814659
  misc_feature 1..78: note = hyper
  source 1..78: mol_type = genomic DNA
tgggtgcctgaattacgtggttcaaggcagagctttgcaggggggcgcgggcctggctcgctgcgttccctgggctcc

SEQ ID NO: 9047 - DNA, 134 bp, Homo sapiens; identical to SEQ ID NO: 685
  misc_feature 1..134: note = chr7:49815116-49815250
  misc_feature 1..134: note = hyper
  source 1..134: mol_type = genomic DNA

SEQ ID NO: 9048 - DNA, 109 bp, Homo sapiens; identical to SEQ ID NO: 686
  misc_feature 1..109: note = chr7:49815656-49815765
  misc_feature 1..109: note = hyper
  source 1..109: mol_type = genomic DNA

SEQ ID NO: 9049 - DNA, 256 bp, Homo sapiens; identical to SEQ ID NO: 3045
  misc_feature 1..256: note = chr7:50343234-50343490
  misc_feature 1..256: note = hyper
  source 1..256: mol_type = genomic DNA

SEQ ID NO: 9050 - DNA, 320 bp, Homo sapiens; identical to SEQ ID NO: 3046
  misc_feature 1..320: note = chr7:50343974-50344294
  misc_feature 1..320: note = hyper
  source 1..320: mol_type = genomic DNA

SEQ ID NO: 9051 - DNA, 36 bp, Homo sapiens; identical to SEQ ID NO: 3047
  misc_feature 1..36: note = chr7:50344295-50344331
  misc_feature 1..36: note = hyper
  source 1..36: mol_type = genomic DNA

SEQ ID NO: 9052 - DNA, 406 bp, Homo sapiens; identical to SEQ ID NO: 3048
  misc_feature 1..406: note = chr7:50344332-50344738
  misc_feature 1..406: note = hyper
  source 1..406: mol_type = genomic DNA

SEQ ID NO: 9053 - DNA, 289 bp, Homo sapiens; identical to SEQ ID NO: 3049
  misc_feature 1..289: note = chr7:54612441-54612730
  misc_feature 1..289: note = hyper
  source 1..289: mol_type = genomic DNA

SEQ ID NO: 9054 - DNA, 71 bp, Homo sapiens
  misc_feature 1..71: note = chr7:54614037-54614108
  misc_feature 1..71: note = hyper
  source 1..71: mol_type = genomic DNA
gaggggaagggggtccgggcgagggagacctagttgagcgagaggcggcgcccctgcgagccagcaagaga

SEQ ID NO: 9055 - DNA, 72 bp, Homo sapiens
  misc_feature 1..72: note = chr7:54732296-54732368
  misc_feature 1..72: note = hyper
  source 1..72: mol_type = genomic DNA
atgacgctgaccggccggtgatgaggaagccaccaagggaagcaattagacacaggacgtgctggacctgca

SEQ ID NO: 9056 - DNA, 49 bp, Homo sapiens
  misc_feature 1..49: note = chr7:64349041-64349090
  misc_feature 1..49: note = hyper
  source 1..49: mol_type = genomic DNA
cgcgtcttcggcaaagtcttcggggtgagaggtccggctcctggaggac

SEQ ID NO: 9057 - DNA, 37 bp, Homo sapiens
  misc_feature 1..37: note = chr7:64407804-64407841
  misc_feature 1..37: note = hyper
  source 1..37: mol_type = genomic DNA
caggcaagccagttccggaccgcgtggcaccaggagc

SEQ ID NO: 9058 - DNA, 282 bp, Homo sapiens
  misc_feature 1..282: note = chr7:64700367-64700649
  misc_feature 1..282: note = hyper
  source 1..282: mol_type = genomic DNA
ccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccg

SEQ ID NO: 9059 - DNA, 262 bp, Homo sapiens
  misc_feature 1..262: note = chr7:64712422-64712684
  misc_feature 1..262: note = hyper
  source 1..262: mol_type = genomic DNA
cgcgcacccggtcagcgacgcggcgggctccactgtggcgcgcgcactccgagcacggagggctgcaggctcacgccacctggctccgcgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgt

SEQ ID NO: 9060 - DNA, 215 bp, Homo sapiens
  misc_feature 1..215: note = chr7:64734490-64734705
  misc_feature 1..215: note = hyper
  source 1..215: mol_type = genomic DNA
gaaccggcctccccacggtcagctcccgggtccacagacctgagtccccgttggcgcagctgggccctcagtacccccggagagtggggtggggggcggtgcaagacggcagctgagccagcggactttgacccctcaccgtcctcttcccgcgccgcgacctgcctgaaactctctgggcagcgctgcacccgcagccccgactctctcccaga

SEQ ID NO: 9061 - DNA, 180 bp, Homo sapiens; identical to SEQ ID NO: 3050
  misc_feature 1..180: note = chr7:64974270-64974450
  misc_feature 1..180: note = hyper
  source 1..180: mol_type = genomic DNA

SEQ ID NO: 9062 - DNA, 480 bp, Homo sapiens; identical to SEQ ID NO: 3051
  misc_feature 1..480: note = chr7:64974510-64974990
  misc_feature 1..480: note = hyper
  source 1..480: mol_type = genomic DNA

SEQ ID NO: 9063 - DNA, 77 bp, Homo sapiens
  misc_feature 1..77: note = chr7:65037634-65037711
  misc_feature 1..77: note = hyper
  source 1..77: mol_type = genomic DNA
gaaaagccgcggcagcggggggccaaaagccggacgggcagaaagccgtggcagcggcgggcaaaaagccgcggcgg

SEQ ID NO: 9064 - DNA, 56 bp, Homo sapiens
  misc_feature 1..56: note = chr7:65446028-65446084
  misc_feature 1..56: note = hyper
  source 1..56: mol_type = genomic DNA
ccttctcccgatccccgggcccagctctgtgcagtgcatgccgctgtggccagagt

SEQ ID NO: 9065 - DNA, 35 bp, Homo sapiens
  misc_feature 1..35: note = chr7:65508965-65509000
  misc_feature 1..35: note = hyper
  source 1..35: mol_type = genomic DNA
cagcctgctaagtcccgggtcggataccaggctgg

SEQ ID NO: 9066 - DNA, 593 bp, Homo sapiens
  misc_feature 1..593: note = chr7:69062375-69062968
  misc_feature 1..593: note = hyper
  source 1..593: mol_type = genomic DNA
gcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatctgaagccgcccgtgcgtccctaggtcccccgctggaagacgaggcgggaatcccaggggtcatccgggcgcggggtcgctcgtccacgcactgtggtgccacgtggaggaaaagtttccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcc

SEQ ID NO: 9067 - DNA, 286 bp, Homo sapiens
  misc_feature 1..286: note = chr7:69064841-69065127
  misc_feature 1..286: note = hyper
  source 1..286: mol_type = genomic DNA
cccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcag

SEQ ID NO: 9068 - DNA, 30 bp, Homo sapiens
  misc_feature 1..30: note = chr7:70596147-70596177
  misc_feature 1..30: note = hyper
  source 1..30: mol_type = genomic DNA
atttgaacagagcagcgggtgggcctagaa

SEQ ID NO: 9069 - DNA, 235 bp, Homo sapiens; identical to SEQ ID NO: 3052
  misc_feature 1..235: note = chr7:70596453-70596688
  misc_feature 1..235: note = hyper
  source 1..235: mol_type = genomic DNA

SEQ ID NO: 9070 - DNA, 140 bp, Homo sapiens
  misc_feature 1..140: note = chr7:70598169-70598309
  misc_feature 1..140: note = hyper
  source 1..140: mol_type = genomic DNA
cgtttcgggcagatggccggggctgctggaaagaacaacttgcctgattcttttctgtgccccacctgcaaatttggttttatcctggaaacatgtcagtacagttggctcccggtccccgcgtgcggactggaaatcat

SEQ ID NO: 9071 - DNA, 111 bp, Homo sapiens
  misc_feature 1..111: note = chr7:71217046-71217157
  misc_feature 1..111: note = hyper
  source 1..111: mol_type = genomic DNA
aacgtttcgcagcaccgggtccaaggaagtgcaatacaacagcaaaatgcaatggccgcagcagctcagtgatgggccgagactcgtcccgtgtggcggagatgctggcat

SEQ ID NO: 9072 - DNA, 126 bp, Homo sapiens; identical to SEQ ID NO: 3053
  misc_feature 1..126: note = chr7:71800631-71800757
  misc_feature 1..126: note = hyper
  source 1..126: mol_type = genomic DNA

SEQ ID NO: 9073 - DNA, 40 bp, Homo sapiens; identical to SEQ ID NO: 3054
  misc_feature 1..40: note = chr7:71800933-71800973
  misc_feature 1..40: note = hyper
  source 1..40: mol_type = genomic DNA

SEQ ID NO: 9074 - DNA, 72 bp, Homo sapiens; identical to SEQ ID NO: 687
  misc_feature 1..72: note = chr7:71802451-71802523
  misc_feature 1..72: note = hyper
  source 1..72: mol_type = genomic DNA

SEQ ID NO: 9075 - DNA, 95 bp, Homo sapiens; identical to SEQ ID NO: 688
  misc_feature 1..95: note = chr7:71802577-71802672
  misc_feature 1..95: note = hyper
  source 1..95: mol_type = genomic DNA

SEQ ID NO: 9076 - DNA, 138 bp, Homo sapiens
  misc_feature 1..138: note = chr7:76145381-76145519
  misc_feature 1..138: note = hyper
  source 1..138: mol_type = genomic DNA
atctgtgcacaaggccggtggttcccgtcgtcgccactcggggtcgccggtgagccgcagccaggccgcctcacggccagtgtgcatgctcgctgctattcgctgccccttctgcctccgaggcggtagcagatgcca

SEQ ID NO: 9077 - DNA, 46 bp, Homo sapiens
  misc_feature 1..46: note = chr7:79081775-79081821
  misc_feature 1..46: note = hyper
  source 1..46: mol_type = genomic DNA
gtcccttcttttcttcgccagcggtggctcacggatccctaaggga

SEQ ID NO: 9078 - DNA, 59 bp, Homo sapiens
  misc_feature 1..59: note = chr7:79082159-79082218
  misc_feature 1..59: note = hyper
  source 1..59: mol_type = genomic DNA
ctttagcccccaagtcgaatccccggcgaaactcacttgcactgcgggtgctctctggc

SEQ ID NO: 9079 - DNA, 644 bp, Homo sapiens; identical to SEQ ID NO: 689
  misc_feature 1..644: note = chr7:79083190-79083834
  misc_feature 1..644: note = hyper
  source 1..644: mol_type = genomic DNA

SEQ ID NO: 9080 - DNA, 158 bp, Homo sapiens
  misc_feature 1..158: note = chr7:82072350-82072508
  misc_feature 1..158: note = hyper
  source 1..158: mol_type = genomic DNA
cttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccag

SEQ ID NO: 9081 - DNA, 45 bp, Homo sapiens
  misc_feature 1..45: note = chr7:83278225-83278270
  misc_feature 1..45: note = hyper
  source 1..45: mol_type = genomic DNA
acaaaaccgagcacacgcactcccttctcccgtggaggtcctctc

SEQ ID NO: 9082 - DNA, 46 bp, Homo sapiens
  misc_feature 1..46: note = chr7:84814651-84814697
  misc_feature 1..46: note = hyper
  source 1..46: mol_type = genomic DNA
tgcgcgcccccaccccgccatcccccgctagcgcacacatgcagga

SEQ ID NO: 9083 - DNA, 102 bp, Homo sapiens
  misc_feature 1..102: note = chr7:84815744-84815846
  misc_feature 1..102: note = hyper
  source 1..102: mol_type = genomic DNA
ggcggggtgggactgcgccccaggggccgcgctgaagctggcgccgcgattactgcgcaccgatttcgcccactctctgtccgctcccgggagccttctctg

SEQ ID NO: 9084 - DNA, 71 bp, Homo sapiens
  misc_feature 1..71: note = chr7:84816281-84816352
  misc_feature 1..71: note = hyper
  source 1..71: mol_type = genomic DNA
tggcgaggaaaggcacgctccaaacaggagggcggcttttaagtttgtggtgtgaccgcagcagctgtcct

SEQ ID NO: 9085 - DNA, 510 bp, Homo sapiens; identical to SEQ ID NO: 3058
  misc_feature 1..510: note = chr7:86273208-86273718
  misc_feature 1..510: note = hyper
  source 1..510: mol_type = genomic DNA

SEQ ID NO: 9086 - DNA, 13 bp, Homo sapiens
  misc_feature 1..13: note = chr7:86273719-86273732
  misc_feature 1..13: note = hyper
  source 1..13: mol_type = genomic DNA
gcttcagcctggt

SEQ ID NO: 9087 - DNA, 109 bp, Homo sapiens
  misc_feature 1..109: note = chr7:87104813-87104922
  misc_feature 1..109: note = hyper
  source 1..109: mol_type = genomic DNA
caagtacaccctctccggcggcccggcgcacgagtcgcggggcccgggggcactgggtggaggtccggccactcccgccccgcgccccacgtcccgggtctcccttcga

SEQ ID NO: 9088 - DNA, 335 bp, Homo sapiens; identical to SEQ ID NO: 690
  misc_feature 1..335: note = chr7:87229568-87229903
  misc_feature 1..335: note = hyper
  source 1..335: mol_type = genomic DNA

SEQ ID NO: 9089 - DNA, 131 bp, Homo sapiens; identical to SEQ ID NO: 3061
  misc_feature 1..131: note = chr7:87230213-87230344
  misc_feature 1..131: note = hyper
  source 1..131: mol_type = genomic DNA

SEQ ID NO: 9090 - DNA, 178 bp, Homo sapiens; identical to SEQ ID NO: 3062
  misc_feature 1..178: note = chr7:87230345-87230523
  misc_feature 1..178: note = hyper
  source 1..178: mol_type = genomic DNA

SEQ ID NO: 9091 - DNA, 148 bp, Homo sapiens
  misc_feature 1..148: note = chr7:87257340-87257488
  misc_feature 1..148: note = hyper
  source 1..148: mol_type = genomic DNA
gtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatcc

SEQ ID NO: 9092 - DNA, 41 bp, Homo sapiens
  misc_feature 1..41: note = chr7:87258357-87258398
  misc_feature 1..41: note = hyper
  source 1..41: mol_type = genomic DNA
gccgcccagtgcccccgcctatgttgcgccagccaaatctg

SEQ ID NO: 9093 - DNA, 57 bp, Homo sapiens
  misc_feature 1..57: note = chr7:87936127-87936184
  misc_feature 1..57: note = hyper
  source 1..57: mol_type = genomic DNA
ggaggaagcgtccagcgccaacggtgcgcgccgcgggccgggcgggtagagggaagt

SEQ ID NO: 9094 - DNA, 40 bp, Homo sapiens; identical to SEQ ID NO: 3063
  misc_feature 1..40: note = chr7:88388606-88388646
  misc_feature 1..40: note = hyper
  source 1..40: mol_type = genomic DNA

SEQ ID NO: 9095 - DNA, 255 bp, Homo sapiens; identical to SEQ ID NO: 3064
  misc_feature 1..255: note = chr7:88388647-88388902
  misc_feature 1..255: note = hyper
  source 1..255: mol_type = genomic DNA

SEQ ID NO: 9096 - DNA, 207 bp, Homo sapiens; identical to SEQ ID NO: 3065
  misc_feature 1..207: note = chr7:88389046-88389253
  misc_feature 1..207: note = hyper
  source 1..207: mol_type = genomic DNA

SEQ ID NO: 9097 - DNA, 101 bp, Homo sapiens
  misc_feature 1..101: note = chr7:89748330-89748431
  misc_feature 1..101: note = hyper
  source 1..101: mol_type = genomic DNA
tgggggtgctgcaggcgctggggagagtgtggagaggctgcgtggagctgcgcgctcggggtgggggctgcactcccaatgaagcgcgtgaagggcaagcg

SEQ ID NO: 9098 - DNA, 467 bp, Homo sapiens; identical to SEQ ID NO: 3066
  misc_feature 1..467: note = chr7:89950183-89950650
  misc_feature 1..467: note = hyper
  source 1..467: mol_type = genomic DNA

SEQ ID NO: 9099 - DNA, 16 bp, Homo sapiens
  misc_feature 1..16: note = chr7:90226268-90226284
  misc_feature 1..16: note = hyper
  source 1..16: mol_type = genomic DNA
ggttctcccctcctcc

SEQ ID NO: 9100 - DNA, 264 bp, Homo sapiens
  misc_feature 1..264: note = chr7:90226285-90226549
  misc_feature 1..264: note = hyper
  source 1..264: mol_type = genomic DNA
ccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagc

SEQ ID NO: 9101 - DNA, 329 bp, Homo sapiens
  misc_feature 1..329: note = chr7:91808202-91808531
  misc_feature 1..329: note = hyper
  source 1..329: mol_type = genomic DNA
ttcagtacaggctaacgtaacgtgggacagcatgcaaagccatgagaagtgggaaaatgagagagaatctgggcgtggcttacagggctgctgaagtaagacacacccttcgcttcacctgtggcctcccgcggcggctgcggctccttcgcaggaccggtagggggcgcgcgcggttgagtccagcaattgcgaggacctccgcaggcgcagcccagcactgacgcctctccgggccgtggctcctctttcccaggccgaaagcggccgggccctctgctccgctgcgccctggcgcggccgcacccactgcgcgtttgtgagctggc

SEQ ID NO: 9102 - DNA, 34 bp, Homo sapiens
  misc_feature 1..34: note = chr7:93203722-93203756
  misc_feature 1..34: note = hyper
  source 1..34: mol_type = genomic DNA
ccgcagggtgaggtgcggacgtgcgcacttctcc

SEQ ID NO: 9103 - DNA, 130 bp, Homo sapiens
  misc_feature 1..130: note = chr7:93204298-93204428
  misc_feature 1..130: note = hyper
  source 1..130: mol_type = genomic DNA
cgctccagtcagggctggggctcaccctgcgagtccgggagactaaagcgccgcgtaaacacaggaagcaggcgagggacccgagttagaccttgagtagggagggagaggggggcgacagtctggactg

SEQ ID NO: 9104 - DNA, 309 bp, Homo sapiens
  misc_feature 1..309: note = chr7:93519457-93519766
  misc_feature 1..309: note = hyper
  source 1..309: mol_type = genomic DNA
tccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggag

SEQ ID NO: 9105 - DNA, 170 bp, Homo sapiens
  misc_feature 1..170: note = chr7:93519854-93520024
  misc_feature 1..170: note = hyper
  source 1..170: mol_type = genomic DNA
cgccctctccgccggttggggagagaagctcctggagcggccagatacctgttggctcctgagcagcatcgcccagtgcagcctccgtcaggaaaagcagcagaatcgacagccccagggggcgagcggggtccatggtgcagggggtcgggcggcccgctgggcaaggc

SEQ ID NO: 9106 - DNA, 112 bp, Homo sapiens
  misc_feature 1..112: note = chr7:93520025-93520137
  misc_feature 1..112: note = hyper
  source 1..112: mol_type = genomic DNA
tccgagaaagcgcctggcgggaggaggtgcgcggctttctgctccaggcggcccgggtgcccgctttatgcggggcgagcgtccggccgacccccgccggggcggagcctga

SEQ ID NO: 9107 - DNA, 421 bp, Homo sapiens
  misc_feature 1..421: note = chr7:93551060-93551481
  misc_feature 1..421: note = hyper
  source 1..421: mol_type = genomic DNA
agcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccaga

SEQ ID NO: 9108 - DNA, 402 bp, Homo sapiens; identical to SEQ ID NO: 3067
  misc_feature 1..402: note = chr7:94284694-94285096
  misc_feature 1..402: note = hyper
  source 1..402: mol_type = genomic DNA

SEQ ID NO: 9109 - DNA, 61 bp, Homo sapiens
  misc_feature 1..61: note = chr7:94536939-94537000
  misc_feature 1..61: note = hyper
  source 1..61: mol_type = genomic DNA
tctctctccctctcccgggattttgctgccgggctccctctctctgcggccctagagttaa

SEQ ID NO: 9110 - DNA, 96 bp, Homo sapiens; identical to SEQ ID NO: 691
  misc_feature 1..96: note = chr7:96621715-96621811
  misc_feature 1..96: note = hyper
  source 1..96: mol_type = genomic DNA

SEQ ID NO: 9111 - DNA, 180 bp, Homo sapiens; identical to SEQ ID NO: 3069
  misc_feature 1..180: note = chr7:96622169-96622349
  misc_feature 1..180: note = hyper
  source 1..180: mol_type = genomic DNA

SEQ ID NO: 9112 - DNA, 30 bp, Homo sapiens
  misc_feature 1..30: note = chr7:96625690-96625720
  misc_feature 1..30: note = hyper
  source 1..30: mol_type = genomic DNA
gcactggtgtgaattcgctttgaaactcaa

SEQ ID NO: 9113 - DNA, 112 bp, Homo sapiens; identical to SEQ ID NO: 3070
  misc_feature 1..112: note = chr7:96625974-96626086
  misc_feature 1..112: note = hyper
  source 1..112: mol_type = genomic DNA

SEQ ID NO: 9114 - DNA, 118 bp, Homo sapiens
  misc_feature 1..118: note = chr7:96627308-96627426
  misc_feature 1..118: note = hyper
  source 1..118: mol_type = genomic DNA
agtactcagttgccacgtctcgcaggaactttggagcaagttttcagctcccaggtgtccaacctttaaaaggaaaagcataataatactaacctttctttcacgaccacgcgaaacg

SEQ ID NO: 9115 - DNA, 150 bp, Homo sapiens
  misc_feature 1..150: note = chr7:96635239-96635389
  misc_feature 1..150: note = hyper
  source 1..150: mol_type = genomic DNA
agggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaac

SEQ ID NO: 9116 - skipped

SEQ ID NO: 9117 - DNA, 104 bp, Homo sapiens
  misc_feature 1..104: note = chr7:96635486-96635590
  misc_feature 1..104: note = hyper
  source 1..104: mol_type = genomic DNA
cgcgcactaccctctgcactgcctgcactcggcggcggcggcggcagcggccggctcgcaccaccaccaccaccaccagcaccaccaccacggctcgccctacg

SEQ ID NO: 9118 - DNA, 159 bp, Homo sapiens
  misc_feature 1..159: note = chr7:96635619-96635778
  misc_feature 1..159: note = hyper
  source 1..159: mol_type = genomic DNA
cgctcgctcgccgcctacccctacatgagccactcgcagcacagcccttacctccagtcctaccacaacagcagcgcagccgcccagacgcgaggggacgacacaggtgagaggccgctggggcagctcgcttctcccgcctcccgactgccccctacc

SEQ ID NO: 9119 - DNA, 340 bp, Homo sapiens; identical to SEQ ID NO: 692
  misc_feature 1..340: note = chr7:96636033-96636373
  misc_feature 1..340: note = hyper
  source 1..340: mol_type = genomic DNA

SEQ ID NO: 9120 - DNA, 65 bp, Homo sapiens; identical to SEQ ID NO: 3072
  misc_feature 1..65: note = chr7:96636595-96636660
  misc_feature 1..65: note = hyper
  source 1..65: mol_type = genomic DNA

SEQ ID NO: 9121 - DNA, 36 bp, Homo sapiens
  misc_feature 1..36: note = chr7:96642045-96642081
  misc_feature 1..36: note = hyper
  source 1..36: mol_type = genomic DNA
gattggtaggaggggcgtgggcgaaaggcatcgccc

SEQ ID NO: 9122 - DNA, 157 bp, Homo sapiens
  misc_feature 1..157: note = chr7:96645902-96646059
  misc_feature 1..157: note = hyper
  source 1..157: mol_type = genomic DNA
gaggagctgggtgaccgcaggcggatccgccggcgtggcgagcttcccagaggtgcccgagggcgtctgccctctgggtgtgcctccgggagggctagagagctctaggttggcaagatcccagtgaccattgggaggcgcgcgatccaaggggttg

SEQ ID NO: 9123 - DNA, 469 bp, Homo sapiens
  misc_feature 1..469: note = chr7:96646662-96647131
  misc_feature 1..469: note = hyper
  source 1..469: mol_type = genomic DNA
gaatgcggcttctctcggatccccaggccgccccttgtcccacaaggaggtggccgccaggaaaaaggggggaaaaggggcagaaatccgcctagctcaacccgagcctcaaacaaaggccaatttatctgatctcttacaggatggcccaggaggtggtctgggcaccgaagaatcgcgctggccctgaccgcatgccccagccttcctggggtttgtgaggagctctgaaggtgggggtgaggtgttgtaagtaaggggtggggagtatgaagacgcccactgaaaagaacattaatcttagaaaggacttgattcgtcttgggagcactatactgagagctaggcaagtggaaaccggaaggggcaggcagaggggtcacccagtgcgatgtcaagagtggggccggctggtccgggaatatgctggggagtggagcacgtttatattcgacgtaggaaaaacaat

SEQ ID NO: 9124 - DNA, 370 bp, Homo sapiens; identical to SEQ ID NO: 3073
  misc_feature 1..370: note = chr7:96647849-96648219
  misc_feature 1..370: note = hyper
  source 1..370: mol_type = genomic DNA

SEQ ID NO: 9125 - DNA, 41 bp, Homo sapiens
  misc_feature 1..41: note = chr7:96652088-96652129
  misc_feature 1..41: note = hyper
  source 1..41: mol_type = genomic DNA
tgaccctacttctgtcggcgtctgttcgggcgcccgcagaa

SEQ ID NO: 9126 - DNA, 240 bp, Homo sapiens; identical to SEQ ID NO: 693
  misc_feature 1..240: note = chr7:96653580-96653820
  misc_feature 1..240: note = hyper
  source 1..240: mol_type = genomic DNA

SEQ ID NO: 9127 - DNA, 131 bp, Homo sapiens; identical to SEQ ID NO: 694
  misc_feature 1..131: note = chr7:96653862-96653993
  misc_feature 1..131: note = hyper
  source 1..131: mol_type = genomic DNA

SEQ ID NO: 9128 - DNA, 30 bp, Homo sapiens
  misc_feature 1..30: note = chr7:96656812-96656842
  misc_feature 1..30: note = hyper
  source 1..30: mol_type = genomic DNA
gcggcttcggacccacgctcaggacataca

SEQ ID NO: 9129 - DNA, 99 bp, Homo sapiens
  misc_feature 1..99: note = chr7:97361029-97361128
  misc_feature 1..99: note = hyper
  source 1..99: mol_type = genomic DNA
ggacggaaaagttaccgaagtccaaggaatgagtcactttgctcaaatttgatgagtaatatcaggtgtcatgaaacccagtttcgaaggagaggggag

SEQ ID NO: 9130 - DNA, 63 bp, Homo sapiens; identical to SEQ ID NO: 3076
  misc_feature 1..63: note = chr7:97361360-97361423
  misc_feature 1..63: note = hyper
  source 1..63: mol_type = genomic DNA

SEQ ID NO: 9131 - DNA, 38 bp, Homo sapiens
  misc_feature 1..38: note = chr7:97361743-97361781
  misc_feature 1..38: note = hyper
  source 1..38: mol_type = genomic DNA
gggacgcgattctctcgcctaaccggtacaggtgagac

SEQ ID NO: 9132 - DNA, 507 bp, Homo sapiens; identical to SEQ ID NO: 3077
  misc_feature 1..507: note = chr7:97362198-97362705
  misc_feature 1..507: note = hyper
  source 1..507: mol_type = genomic DNA

SEQ ID NO: 9133 - DNA, 222 bp, Homo sapiens; identical to SEQ ID NO: 3078
  misc_feature 1..222: note = chr7:97362706-97362928
  misc_feature 1..222: note = hyper
  source 1..222: mol_type = genomic DNA

SEQ ID NO: 9134 - DNA, 223 bp, Homo sapiens; identical to SEQ ID NO: 695
  misc_feature 1..223: note = chr7:98245856-98246079
  misc_feature 1..223: note = hyper
  source 1..223: mol_type = genomic DNA

SEQ ID NO: 9135 - DNA, 204 bp, Homo sapiens; identical to SEQ ID NO: 696
  misc_feature 1..204: note = chr7:98246304-98246508
  misc_feature 1..204: note = hyper
  source 1..204: mol_type = genomic DNA

SEQ ID NO: 9136 - DNA, 1085 bp, Homo sapiens; identical to SEQ ID NO: 697
  misc_feature 1..1085: note = chr7:98246533-98247618
  misc_feature 1..1085: note = hyper
  source 1..1085: mol_type = genomic DNA

SEQ ID NO: 9137 - DNA, 127 bp, Homo sapiens
  misc_feature 1..127: note = chr7:99149251-99149378
  misc_feature 1..127: note = hyper
  source 1..127: mol_type = genomic DNA
cagaattttacaactcggggtacccaggaaaccagaaaagcccccaccacaagaaaaaccagtgggcacaactggggagcacagatatctgactggggtcattttgtccgcgcgtctttggggtaaa

SEQ ID NO: 9138 - DNA, 15 bp, Homo sapiens
  misc_feature 1..15: note = chr7:99155799-99155814
  misc_feature 1..15: note = hyper
  source 1..15: mol_type = genomic DNA
aggccccgcaatcct

SEQ ID NO: 9139 - DNA, 195 bp, Homo sapiens
  misc_feature 1..195: note = chr7:99155931-99156126
  misc_feature 1..195: note = hyper
  source 1..195: mol_type = genomic DNA
cgggccgcctccttgcagggagtctcaaggatgggctggcgtcagggaggggcccagggggcgctttcccaacactggtcgcagtcattgttggtataacggctagagacgcccagtgagttagcatggagggcagtgggaccggaaaaagacgtggaaaagctgcgaaaacgagccttcgaatcatggacgcgc

SEQ ID NO: 9140 - DNA, 50 bp, Homo sapiens
  misc_feature 1..50: note = chr7:99156127-99156177
  misc_feature 1..50: note = hyper
  source 1..50: mol_type = genomic DNA
ggcccagctcctcctccgagttcctcatccggggccgtcactcacatccg

SEQ ID NO: 9141 - DNA, 100 bp, Homo sapiens
  misc_feature 1..100: note = chr7:99156815-99156915
  misc_feature 1..100: note = hyper
  source 1..100: mol_type = genomic DNA
ccgctcaaacctgttcgaaccgcagctcttacctgcgttgctctcaggattccgggaaaaggccggtctagctggtctgagttagcgaagggcctgaccc

SEQ ID NO: 9142 - DNA, 176 bp, Homo sapiens
  misc_feature 1..176: note = chr7:99177694-99177870
  misc_feature 1..176: note = hyper
  source 1..176: mol_type = genomic DNA
cggaagggacagccagttagagtctaggcccacttaggcgatgaagggcaggtgaagaaatcccgttccatcttcctgcagtcctcccttggggagtccacatcctatccttctctggaccggggcggctcctggagggaccgcgatcgaaatgaggcctccgagccgcccagaga

SEQ ID NO: 9143 - DNA, 85 bp, Homo sapiens
  misc_feature 1..85: note = chr7:99178159-99178244
  misc_feature 1..85: note = hyper
  source 1..85: mol_type = genomic DNA
ttcttgggaaagctccgcctaccattgcccttgtacctgccctctctctccctttcctgaagtgactgcccgtctctagcatcgt

SEQ ID NO: 9144 - DNA, 30 bp, Homo sapiens
  misc_feature 1..30: note = chr7:99595151-99595181
  misc_feature 1..30: note = hyper
  source 1..30: mol_type = genomic DNA
aggtacgagtcactgcgcccaggcttttct

SEQ ID NO: 9145 - DNA, 16 bp, Homo sapiens
  misc_feature 1..16: note = chr7:100091165-100091181
  misc_feature 1..16: note = hyper
  source 1..16: mol_type = genomic DNA
gcttctgaggggagac

SEQ ID NO: 9146 - DNA, 132 bp, Homo sapiens
  misc_feature 1..132: note = chr7:100167379-100167511
  misc_feature 1..132: note = hyper
  source 1..132: mol_type = genomic DNA
actccagttcctgggcgacgtgaggattagtctcgtggggtgggggttccggagcggtcggcggagggagggaggtagtggggagcccaggccaggggcaacagtcaccgggacactcgctgtgcgcagagt

SEQ ID NO: 9147 - DNA, 32 bp, Homo sapiens
  misc_feature 1..32: note = chr7:100318466-100318498
  misc_feature 1..32: note = hyper
  source 1..32: mol_type = genomic DNA
cgcgccccctggacagccgccctctcctccag

SEQ ID NO: 9148 - DNA, 30 bp, Homo sapiens
  misc_feature 1..30: note = chr7:100809491-100809521
  misc_feature 1..30: note = hyper
  source 1..30: mol_type = genomic DNA
gatgggtggatcttgcggttttggtaatcc

SEQ ID NO: 9149 - DNA, 100 bp, Homo sapiens
  misc_feature 1..100: note = chr7:100823251-100823351
  misc_feature 1..100: note = hyper
  source 1..100: mol_type = genomic DNA
tgctgccccattctgcggtggaggagcacgctagccccctccccagtccccaggcccggccgcccccctacctcgccggagccggagctggagccagggc

SEQ ID NO: 9150 - DNA, 179 bp, Homo sapiens
  misc_feature 1..179: note = chr7:100823380-100823559
  misc_feature 1..179: note = hyper
  source 1..179: mol_type = genomic DNA
cggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcag

SEQ ID NO: 9151 - DNA, 30 bp, Homo sapiens
  misc_feature 1..30: note = chr7:100845392-100845422
  misc_feature 1..30: note = hyper
  source 1..30: mol_type = genomic DNA
gccaggatcgcggggcggaggccggggctc

SEQ ID NO: 9152 - DNA, 52 bp, Homo sapiens
  misc_feature 1..52: note = chr7:100943301-100943353
  misc_feature 1..52: note = hyper
  source 1..52: mol_type = genomic DNA
tgcagctgcagcccccgccaccccgagagtccagccccgagggcagctcctg

SEQ ID NO: 9153 - DNA, 127 bp, Homo sapiens
  misc_feature 1..127: note = chr7:101006326-101006453
  misc_feature 1..127: note = hyper
  source 1..127: mol_type = genomic DNA
tgctcctgccctgggcgtgttgctgcctctgcgggtcggcgctggccaccggcttcctctatcccttctcggccgcagctctgcagcagcacggctaccccgagcccggcgccggctcccctggcag

SEQ ID NO: 9154 - DNA, 390 bp, Homo sapiens; identical to SEQ ID NO: 3082
  misc_feature 1..390: note = chr7:103085842-103086232
  misc_feature 1..390: note = hyper
  source 1..390: mol_type = genomic DNA

SEQ ID NO: 9155 - DNA, 554 bp, Homo sapiens; identical to SEQ ID NO: 3083
  misc_feature 1..554: note = chr7:103629059-103629613
  misc_feature 1..554: note = hyper
  source 1..554: mol_type = genomic DNA

SEQ ID NO: 9156 - DNA, 29 bp, Homo sapiens
  misc_feature 1..29: note = chr7:103630054-103630083
  misc_feature 1..29: note = hyper
  source 1..29: mol_type = genomic DNA
gcctccgtgcgccgccgccgcctctgcgc

SEQ ID NO: 9157 - DNA, 109 bp, Homo sapiens
  misc_feature 1..109: note = chr7:103630363-103630472
  misc_feature 1..109: note = hyper
  source 1..109: mol_type = genomic DNA
cgctgagcccgcgactcttctgcgagggacgtcaaagccccgcagagggcacctcccgtccagctgtctgaaggggaaggccagcccctttggccgtcagtgtgccctg

SEQ ID NO: 9158 - DNA, 47 bp, Homo sapiens
  misc_feature 1..47: note = chr7:103630841-103630888
  misc_feature 1..47: note = hyper
  source 1..47: mol_type = genomic DNA
ggcggagctaagatccgacaggctctcttcgccggactgttctgtta

SEQ ID NO: 9159 - DNA, 251 bp, Homo sapiens; identical to SEQ ID NO: 3084
  misc_feature 1..251: note = chr7:103968915-103969166
  misc_feature 1..251: note = hyper
  source 1..251: mol_type = genomic DNA

SEQ ID NO: 9160 - DNA, 355 bp, Homo sapiens; identical to SEQ ID NO: 3085
  misc_feature 1..355: note = chr7:103969167-103969522
  misc_feature 1..355: note = hyper
  source 1..355: mol_type = genomic DNA

SEQ ID NO: 9161 - DNA, 15 bp, Homo sapiens
  misc_feature 1..15: note = chr7:103969562-103969577
  misc_feature 1..15: note = hyper
  source 1..15: mol_type = genomic DNA
cggcctctccatgat

SEQ ID NO: 9162 - DNA, 766 bp, Homo sapiens; identical to SEQ ID NO: 3087
  misc_feature 1..766: note = chr7:107301015-107301781
  misc_feature 1..766: note = hyper
  source 1..766: mol_type = genomic DNA

SEQ ID NO: 9163 - DNA, 30 bp, Homo sapiens
  misc_feature 1..30: note = chr7:107642639-107642669
  misc_feature 1..30: note = hyper
  source 1..30: mol_type = genomic DNA
tgtgagcttgggaagcgagagtgcgtgtgc

SEQ ID NO: 9164 - DNA, 56 bp, Homo sapiens
  misc_feature 1..56: note = chr7:108095821-108095877
  misc_feature 1..56: note = hyper
  source 1..56: mol_type = genomic DNA
ctcaacacagcatcccgggcggagcggatgccagatcccaccgctaagagcctggg

SEQ ID NO: 9165 - DNA, 30 bp, Homo sapiens
  misc_feature 1..30: note = chr7:108096780-108096810
  misc_feature 1..30: note = hyper
  source 1..30: mol_type = genomic DNA
gctgctccagccaggcggcccctgcgccgt

SEQ ID NO: 9166 - DNA, 302 bp, Homo sapiens; identical to SEQ ID NO: 698
  misc_feature 1..302: note = chr7:108097189-108097491
  misc_feature 1..302: note = hyper
  source 1..302: mol_type = genomic DNA

SEQ ID NO: 9167 - DNA, 57 bp, Homo sapiens
  misc_feature 1..57: note = chr7:112726853-112726910
  misc_feature 1..57: note = hyper
  source 1..57: mol_type = genomic DNA
tcttcccaaaggcagcgcacgaggaagtcacagtgcccgtgacgcccgccccctccc

SEQ ID NO: 9168 - DNA, 105 bp, Homo sapiens
  misc_feature 1..105: note = chr7:113722810-113722915
  misc_feature 1..105: note = hyper
  source 1..105: mol_type = genomic DNA
atctttcactaggaccgtactagagcagtgtctcgaattttgttgatttgtggtttcgtcgtaaaataaacttgaaatcaaataaactttcgtgaggaagctttg

SEQ ID NO: 9169 - DNA, 198 bp, Homo sapiens
  misc_feature 1..198: note = chr7:113723385-113723583
  misc_feature 1..198: note = hyper
  source 1..198: mol_type = genomic DNA
caaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacagga

SEQ ID NO: 9170 - DNA, 572 bp, Homo sapiens
  misc_feature 1..572: note = chr7:113724755-113725327
  misc_feature 1..572: note = hyper
  source 1..572: mol_type = genomic DNA
ttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcct

SEQ ID NO: 9171 - DNA, 47 bp, Homo sapiens
  misc_feature 1..47: note = chr7:113726751-113726798
  misc_feature 1..47: note = hyper
  source 1..47: mol_type = genomic DNA
ctttactctgctccgcgctcctcccgcggtggcgacaaagtttcgcc

SEQ ID NO: 9172 - DNA, 54 bp, Homo sapiens
  misc_feature 1..54: note = chr7:113727754-113727808
  misc_feature 1..54: note = hyper
  source 1..54: mol_type = genomic DNA
cctctgcccacccgcgaggccgcaacgcgccctgacacccgacctcagtgtgga

SEQ ID NO: 9173 - DNA, 77 bp, Homo sapiens
  misc_feature 1..77: note = chr7:114562200-114562277
  misc_feature 1..77: note = hyper
  source 1..77: mol_type = genomic DNA
cgagccagcccaggccggctctggcctcctgacccagacagcgcagggcgcgagggatcgcgcggccgagcccgggt

SEQ ID NO: 9174 - skipped

SEQ ID NO: 9175 - DNA, 372 bp, Homo sapiens
  misc_feature 1..372: note = chr7:114563009-114563381
  misc_feature 1..372: note = hyper
  source 1..372: mol_type = genomic DNA
tcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgg

SEQ ID NO: 9176 - DNA, 227 bp, Homo sapiens
  misc_feature 1..227: note = chr7:115117500-115117727
  misc_feature 1..227: note = hyper
  source 1..227: mol_type = genomic DNA
cgtctcggctgcctccgtggagatcccgagaaaagctcctgcgctccaagttaacttctctctgggccgcgcggcgcagtggagtctcggtgcagcccgcgtccctggaggcgcgcagcgaagcccagcgggcgtggacagggaaggggcgggaaggcaggggacaaggcggggtcctaagggttggtggggttgagctgggggggggggggcggaaaaagagatct

SEQ ID NO: 9177 - DNA, 503 bp, Homo sapiens; identical to SEQ ID NO: 699
  misc_feature 1..503: note = chr7:116962644-116963147
  misc_feature 1..503: note = hyper
  source 1..503: mol_type = genomic DNA

SEQ ID NO: 9178 - DNA, 68 bp, Homo sapiens; identical to SEQ ID NO: 700
  misc_feature 1..68: note = chr7:116963330-116963398
  misc_feature 1..68: note = hyper
  source 1..68: mol_type = genomic DNA

SEQ ID NO: 9179 - DNA, 32 bp, Homo sapiens
  misc_feature 1..32: note = chr7:116964126-116964158
  misc_feature 1..32: note = hyper
  source 1..32: mol_type = genomic DNA
agaggggcttgggcccgcgggtggagcatttt

SEQ ID NO: 9180 - DNA, 40 bp, Homo sapiens
  misc_feature 1..40: note = chr7:116964570-116964610
  misc_feature 1..40: note = hyper
  source 1..40: mol_type = genomic DNA
acccagatacatccccgtttgggtccggaaagggagggga

SEQ ID NO: 9181 - DNA, 392 bp, Homo sapiens; identical to SEQ ID NO: 701
  misc_feature 1..392: note = chr7:117119505-117119897
  misc_feature 1..392: note = hyper
  source 1..392: mol_type = genomic DNA

SEQ ID NO: 9182 - DNA, 40 bp, Homo sapiens
  misc_feature 1..40: note = chr7:117120210-117120250
  misc_feature 1..40: note = hyper
  source 1..40: mol_type = genomic DNA
tggccaaccgagcttcggaaagacacgtgcccacgaaaga

SEQ ID NO: 9183 - DNA, 60 bp, Homo sapiens
  misc_feature 1..60: note = chr7:119913034-119913094
  misc_feature 1..60: note = hyper
  source 1..60: mol_type = genomic DNA
caccgcagcccagcacgtgaagcttccctttgttcatccgaggctcgcttttctccccag

SEQ ID NO: 9184 - DNA, 69 bp, Homo sapiens
  misc_feature 1..69: note = chr7:120969770-120969839
  misc_feature 1..69: note = hyper
  source 1..69: mol_type = genomic DNA
gagccagttcagacacgagagatggaactgcatgatcaccgccgccgccactaccgccccgatgggcgc

SEQ ID NO: 9185 - DNA, 314 bp, Homo sapiens
  misc_feature 1..314: note = chr7:120970100-120970414
  misc_feature 1..314: note = hyper
  source 1..314: mol_type = genomic DNA
tcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagca

SEQ ID NO: 9186 - DNA, 30 bp, Homo sapiens
  misc_feature 1..30: note = chr7:120970627-120970657
  misc_feature 1..30: note = hyper
  source 1..30: mol_type = genomic DNA
tttcatgttcatttccgttccccctccgcc

SEQ ID NO: 9187 - DNA, 53 bp, Homo sapiens
  misc_feature 1..53: note = chr7:121513589-121513642
  misc_feature 1..53: note = hyper
  source 1..53: mol_type = genomic DNA
ctcctctgtgtttgccgcctgggtgagtgagaagagctcggtggggtttcagc

SEQ ID NO: 9188 - DNA, 30 bp, Homo sapiens
  misc_feature 1..30: note = chr7:121783592-121783622
  misc_feature 1..30: note = hyper
  source 1..30: mol_type = genomic DNA
cccagacttgcaaggcgcccaacttccacc

SEQ ID NO: 9189 - DNA, 40 bp, Homo sapiens
  misc_feature 1..40: note = chr7:121939677-121939717
  misc_feature 1..40: note = hyper
  source 1..40: mol_type = genomic DNA
ggagctacttagggccgcatagattcggaatccagccaac

SEQ ID NO: 9190 - DNA, 254 bp, Homo sapiens; identical to SEQ ID NO: 702
  misc_feature 1..254: note = chr7:121939991-121940245
  misc_feature 1..254: note = hyper
  source 1..254: mol_type = genomic DNA

SEQ ID NO: 9191 - DNA, 25 bp, Homo sapiens
  misc_feature 1..25: note = chr7:121940433-121940458
  misc_feature 1..25: note = hyper
  source 1..25: mol_type = genomic DNA
cggtgtggaccgatggtggattctc

SEQ ID NO: 9192 - DNA, 149 bp, Homo sapiens
  misc_feature 1..149: note = chr7:121940903-121941052
  misc_feature 1..149: note = hyper
  source 1..149: mol_type = genomic DNA
gaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgt

SEQ ID NO: 9193 - DNA, 306 bp, Homo sapiens; identical to SEQ ID NO: 704
  misc_feature 1..306: note = chr7:121941881-121942187
  misc_feature 1..306: note = hyper
  source 1..306: mol_type = genomic DNA

SEQ ID NO: 9194 - DNA, 15 bp, Homo sapiens
  misc_feature 1..15: note = chr7:121943974-121943989
  misc_feature 1..15: note = hyper
  source 1..15: mol_type = genomic DNA
ccgggtggcatgggc

SEQ ID NO: 9195 - DNA, 123 bp, Homo sapiens; identical to SEQ ID NO: 706
  misc_feature 1..123: note = chr7:121944176-121944299
  misc_feature 1..123: note = hyper
  source 1..123: mol_type = genomic DNA

SEQ ID NO: 9196 - DNA, 49 bp, Homo sapiens
  misc_feature 1..49: note = chr7:121945680-121945729
  misc_feature 1..49: note = hyper
  source 1..49: mol_type = genomic DNA
tttcttaagtacctgcgctcagctagagctctcccggagcattttaaat

SEQ ID NO: 9197 - DNA, 46 bp, Homo sapiens
  misc_feature 1..46: note = chr7:121946080-121946126
  misc_feature 1..46: note = hyper
  source 1..46: mol_type = genomic DNA
cgctggaagctgcggcgcgcaccttccccggcgcagtctcttgcca

SEQ ID NO: 9198 - DNA, 488 bp, Homo sapiens; identical to SEQ ID NO: 707
  misc_feature 1..488: note = chr7:121946495-121946983
  misc_feature 1..488: note = hyper
  source 1..488: mol_type = genomic DNA

SEQ ID NO: 9199 - DNA, 64 bp, Homo sapiens; identical to SEQ ID NO: 708
  misc_feature 1..64: note = chr7:121947097-121947161
  misc_feature 1..64: note = hyper
  source 1..64: mol_type = genomic DNA

SEQ ID NO: 9200 - DNA, 128 bp, Homo sapiens; identical to SEQ ID NO: 709
  misc_feature 1..128: note = chr7:121950137-121950265
  misc_feature 1..128: note = hyper
  source 1..128: mol_type = genomic DNA

SEQ ID NO: 9201 - DNA, 125 bp, Homo sapiens; identical to SEQ ID NO: 710
  misc_feature 1..125: note = chr7:121950428-121950553
  misc_feature 1..125: note = hyper
  source 1..125: mol_type = genomic DNA

SEQ ID NO: 9202 - DNA, 148 bp, Homo sapiens; identical to SEQ ID NO: 711
  misc_feature 1..148: note = chr7:121951863-121952011
  misc_feature 1..148: note = hyper
  source 1..148: mol_type = genomic DNA

SEQ ID NO: 9203 - DNA, 15 bp, Homo sapiens
  misc_feature 1..15: note = chr7:121952043-121952058
  misc_feature 1..15: note = hyper
  source 1..15: mol_type = genomic DNA
cgagggtgggaaggg

SEQ ID NO: 9204 - DNA, 88 bp, Homo sapiens; identical to SEQ ID NO: 3103
  misc_feature 1..88: note = chr7:121955425-121955513
  misc_feature 1..88: note = hyper
  source 1..88: mol_type = genomic DNA

SEQ ID NO: 9205 - DNA, 124 bp, Homo sapiens; identical to SEQ ID NO: 713
  misc_feature 1..124: note = chr7:121956458-121956582
  misc_feature 1..124: note = hyper
  source 1..124: mol_type = genomic DNA

SEQ ID NO: 9206 - DNA, 123 bp, Homo sapiens; identical to SEQ ID NO: 714
  misc_feature 1..123: note = chr7:121956954-121957077
  misc_feature 1..123: note = hyper
  source 1..123: mol_type = genomic DNA

SEQ ID NO: 9207 - DNA, 276 bp, Homo sapiens
  misc_feature 1..276: note = chr7:123172968-123173244
  misc_feature 1..276: note = hyper
  source 1..276: mol_type = genomic DNA
ggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatgcagacccc

SEQ ID NO: 9208 - DNA, 16 bp, Homo sapiens
  misc_feature 1..16: note = chr7:123672430-123672446
  misc_feature 1..16: note = hyper
  source 1..16: mol_type = genomic DNA
gggagggacggggagc

SEQ ID NO: 9209 - DNA, 56 bp, Homo sapiens
  misc_feature 1..56: note = chr7:123672928-123672984
  misc_feature 1..56: note = hyper
  source 1..56: mol_type = genomic DNA
ttcagcagtggacagcggctccgggcagccggctgccgcctcgcttcctggcccgc

SEQ ID NO: 9210 - DNA, 113 bp, Homo sapiens
  misc_feature 1..113: note = chr7:123673226-123673339
  misc_feature 1..113: note = hyper
  source 1..113: mol_type = genomic DNA
tgcactcaggggactcgcgggccgcccggctagcggaatccccccgccgtggccccgctgcgccctcccttccagtcccgggcgaggtgccgcccgcccgcgcccgctctagc

SEQ ID NO: 9211 - DNA, 75 bp, Homo sapiens
  misc_feature 1..75: note = chr7:124404370-124404445
  misc_feature 1..75: note = hyper
  source 1..75: mol_type = genomic DNA
ggccagcgcccggcccgggagtgcaattgtccacccttcgtgccccgccagtccattggccgtcttggacagggg

SEQ ID NO: 9212 - DNA, 191 bp, Homo sapiens
  misc_feature 1..191: note = chr7:124404769-124404960
  misc_feature 1..191: note = hyper
  source 1..191: mol_type = genomic DNA
gtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagagg

SEQ ID NO: 9213 - DNA, 37 bp, Homo sapiens
  misc_feature 1..37: note = chr7:124405619-124405656
  misc_feature 1..37: note = hyper
  source 1..37: mol_type = genomic DNA
cccacctaaccccagcgacttgcgagcctactgctgc

SEQ ID NO: 9214 - DNA, 44 bp, Homo sapiens
  misc_feature 1..44: note = chr7:124405918-124405962
  misc_feature 1..44: note = hyper
  source 1..44: mol_type = genomic DNA
gaaggggaggtggcccggcctcgcccccgcgctccagccgctgc

SEQ ID NO: 9215 - DNA, 44 bp, Homo sapiens
  misc_feature 1..44: note = chr7:126891206-126891250
  misc_feature 1..44: note = hyper
  source 1..44: mol_type = genomic DNA
gtctgttttcacccccgctatcttgggtgcgcagacactctctg

SEQ ID NO: 9216 - DNA, 730 bp, Homo sapiens
  misc_feature 1..730: note = chr7:126891633-126892363
  misc_feature 1..730: note = hyper
  source 1..730: mol_type = genomic DNA
gatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgg

SEQ ID NO: 9217 - DNA, 153 bp, Homo sapiens; identical to SEQ ID NO: 715
  misc_feature 1..153: note = chr7:127744057-127744210
  misc_feature 1..153: note = hyper
  source 1..153: mol_type = genomic DNA

SEQ ID NO: 9218 - DNA, 459 bp, Homo sapiens; identical to SEQ ID NO: 716
  misc_feature 1..459: note = chr7:127744211-127744670
  misc_feature 1..459: note = hyper
  source 1..459: mol_type = genomic DNA

SEQ ID NO: 9219 - DNA, 36 bp, Homo sapiens
  misc_feature 1..36: note = chr7:127806571-127806607
  misc_feature 1..36: note = hyper
  source 1..36: mol_type = genomic DNA
gggaacgccaatgcccgggagcggcctttgggagga

SEQ ID NO: 9220 - DNA, 835 bp, Homo sapiens; identical to SEQ ID NO: 3108
  misc_feature 1..835: note = chr7:127807845-127808680
  misc_feature 1..835: note = hyper
  source 1..835: mol_type = genomic DNA

SEQ ID NO: 9221 - DNA, 159 bp, Homo sapiens; identical to SEQ ID NO: 3109
  misc_feature 1..159: note = chr7:127841338-127841497
  misc_feature 1..159: note = hyper
  source 1..159: mol_type = genomic DNA

SEQ ID NO: 9222 - DNA, 97 bp, Homo sapiens
  misc_feature 1..97: note = chr7:127991826-127991923
  misc_feature 1..97: note = hyper
  source 1..97: mol_type = genomic DNA
agggcccttccaggccggattggccgccgtagcccagggcgtgcagcacctcatagccctgcagggctccgctcagcagcccgaaggtgcccgccac

SEQ ID NO: 9223 - DNA, 91 bp, Homo sapiens
  misc_feature 1..91: note = chr7:127992044-127992135
  misc_feature 1..91: note = hyper
  source 1..91: mol_type = genomic DNA
cgcccgccccagcaggagagcgccagcagcagcccggaaaggaaagcggcgagaaaggcgtgcagcccgcgcgaggcgagccgcaggggcc

SEQ ID NO: 9224 - DNA, 41 bp, Homo sapiens
  misc_feature 1..41: note = chr7:127992478-127992519
  misc_feature 1..41: note = hyper
  source 1..41: mol_type = genomic DNA
aaccaggccgaagagcgcgcctaccccgtacacgtgggcct

SEQ ID NO: 9225 - DNA, 100 bp, Homo sapiens; identical to SEQ ID NO: 717
  misc_feature 1..100: note = chr7:128337422-128337522
  misc_feature 1..100: note = hyper
  source 1..100: mol_type = genomic DNA

SEQ ID NO: 9226 - DNA, 13 bp, Homo sapiens
  misc_feature 1..13: note = chr7:128337582-128337595
  misc_feature 1..13: note = hyper
  source 1..13: mol_type = genomic DNA
cgcctggaaatac

SEQ ID NO: 9227 - DNA, 134 bp, Homo sapiens; identical to SEQ ID NO: 719
  misc_feature 1..134: note = chr7:128337787-128337921
  misc_feature 1..134: note = hyper
  source 1..134: mol_type = genomic DNA

SEQ ID NO: 9228 - DNA, 125 bp, Homo sapiens; identical to SEQ ID NO: 3113
  misc_feature 1..125: note = chr7:128430757-128430882
  misc_feature 1..125: note = hyper
  source 1..125: mol_type = genomic DNA

SEQ ID NO: 9229 - DNA, 560 bp, Homo sapiens; identical to SEQ ID NO: 3114
  misc_feature 1..560: note = chr7:128470497-128471057
  misc_feature 1..560: note = hyper
  source 1..560: mol_type = genomic DNA

SEQ ID NO: 9230 - DNA, 90 bp, Homo sapiens; identical to SEQ ID NO: 3115
  misc_feature 1..90: note = chr7:128471125-128471215
  misc_feature 1..90: note = hyper
  source 1..90: mol_type = genomic DNA

SEQ ID NO: 9231 - DNA, 56 bp, Homo sapiens
  misc_feature 1..56: note = chr7:128510097-128510153
  misc_feature 1..56: note = hyper
  source 1..56: mol_type = genomic DNA
gcccacgccccctcccgggcggcccccagctttgccaccgccggtgccgacctttg

SEQ ID NO: 9232 - DNA, 253 bp, Homo sapiens
  misc_feature 1..253: note = chr7:128828130-128828383
  misc_feature 1..253: note = hyper
  source 1..253: mol_type = genomic DNA
tggaacagaagtccccgttgacttcaggcatcccctgtctttcccatcctgagccaggagaaaagtccgcttcctgcagacgacctcagaccaagcaaggtgcccgccgagtctctccttgcaggtccggcccacgatttccactcatctctttcccccgggcgcggggcggcggcaggcggggtcaccagatccccctagcccgggcccctccaggcgccagggacgctgacgctcgcgctcttcctctctc

SEQ ID NO: 9233 - DNA, 262 bp, Homo sapiens
  misc_feature 1..262: note = chr7:128829105-128829367
  misc_feature 1..262: note = hyper
  source 1..262: mol_type = genomic DNA
gcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggtaagtgcggcggagccgggtctggggggcgggaggtgccgcgg

SEQ ID NO: 9234 - DNA, 30 bp, Homo sapiens
  misc_feature 1..30: note = chr7:129418279-129418309
  misc_feature 1..30: note = hyper
  source 1..30: mol_type = genomic DNA
ttctttgcgtaaggccgactccagaggtcc

SEQ ID NO: 9235 - skipped

SEQ ID NO: 9236 - DNA, 854 bp, Homo sapiens; identical to SEQ ID NO: 721
  misc_feature 1..854: note = chr7:129422115-129422969
  misc_feature 1..854: note = hyper
  source 1..854: mol_type = genomic DNA

SEQ ID NO: 9237 - DNA, 299 bp, Homo sapiens; identical to SEQ ID NO: 722
  misc_feature 1..299: note = chr7:129423125-129423424
  misc_feature 1..299: note = hyper
  source 1..299: mol_type = genomic DNA

SEQ ID NO: 9238 - DNA, 1355 bp, Homo sapiens; identical to SEQ ID NO: 723
  misc_feature 1..1355: note = chr7:129424591-129425946
  misc_feature 1..1355: note = hyper
  source 1..1355: mol_type = genomic DNA

SEQ ID NO: 9239 - DNA, 62 bp, Homo sapiens
  misc_feature 1..62: note = chr7:131242762-131242824
  misc_feature 1..62: note = hyper
  source 1..62: mol_type = genomic DNA
attaaccttggaacccgggtacggcgtaaatttggctcacgtgactccggggttgctaatct

SEQ ID NO: 9240 - DNA, 30 bp, Homo sapiens
  misc_feature 1..30: note = chr7:132260536-132260566
  misc_feature 1..30: note = hyper
  source 1..30: mol_type = genomic DNA
cacgcttcagaaaggcgtttgtgctgcctc

SEQ ID NO: 9241 - DNA, 89 bp, Homo sapiens
  misc_feature 1..89: note = chr7:132260852-132260941
  misc_feature 1..89: note = hyper
  source 1..89: mol_type = genomic DNA
ggtgggaggcagagccgggaatacacagaatcccaccccgaaagtcccgggaaagagaagtctgagtccaggagcgtgagaggagaaca

SEQ ID NO: 9242 - DNA, 141 bp, Homo sapiens
  misc_feature 1..141: note = chr7:132261845-132261986
  misc_feature 1..141: note = hyper
  source 1..141: mol_type = genomic DNA
ctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagg

SEQ ID NO: 9243 - DNA, 532 bp, Homo sapiens
  misc_feature 1..532: note = chr7:134143055-134143587
  misc_feature 1..532: note = hyper
  source 1..532: mol_type = genomic DNA
attatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggc

SEQ ID NO: 9244 - DNA, 164 bp, Homo sapiens; identical to SEQ ID NO: 3120
  misc_feature 1..164: note = chr7:134143807-134143971
  misc_feature 1..164: note = hyper
  source 1..164: mol_type = genomic DNA

SEQ ID NO: 9245 - DNA, 83 bp, Homo sapiens; identical to SEQ ID NO: 3121
  misc_feature 1..83: note = chr7:134143972-134144055
  misc_feature 1..83: note = hyper
  source 1..83: mol_type = genomic DNA

SEQ ID NO: 9246 - DNA, 76 bp, Homo sapiens; identical to SEQ ID NO: 3122
  misc_feature 1..76: note = chr7:134144056-134144132
  misc_feature 1..76: note = hyper
  source 1..76: mol_type = genomic DNA

SEQ ID NO: 9247 - DNA, 99 bp, Homo sapiens; identical to SEQ ID NO: 3123
  misc_feature 1..99: note = chr7:136553927-136554026
  misc_feature 1..99: note = hyper
  source 1..99: mol_type = genomic DNA

SEQ ID NO: 9248 - DNA, 263 bp, Homo sapiens; identical to SEQ ID NO: 3124
  misc_feature 1..263: note = chr7:136554103-136554366
  misc_feature 1..263: note = hyper
  source 1..263: mol_type = genomic DNA

SEQ ID NO: 9249 - DNA, 63 bp, Homo sapiens; identical to SEQ ID NO: 3125
  misc_feature 1..63: note = chr7:136554903-136554966
  misc_feature 1..63: note = hyper
  source 1..63: mol_type = genomic DNA

SEQ ID NO: 9250 - DNA, 89 bp, Homo sapiens
  misc_feature 1..89: note = chr7:136555702-136555791
  misc_feature 1..89: note = hyper
  source 1..89: mol_type = genomic DNA
gtggcagtgggtatgcggcagccgtgtgatttgcccatcccctagtacacgcagccagcgacacaagcacacagcgaccagtccccacg

SEQ ID NO: 9251 - DNA, 627 bp, Homo sapiens; identical to SEQ ID NO: 724
  misc_feature 1..627: note = chr7:137531262-137531889
  misc_feature 1..627: note = hyper
  source 1..627: mol_type = genomic DNA

SEQ ID NO: 9252 - DNA, 176 bp, Homo sapiens; identical to SEQ ID NO: 725
  misc_feature 1..176: note = chr7:137531908-137532084
  misc_feature 1..176: note = hyper
  source 1..176: mol_type = genomic DNA

SEQ ID NO: 9253 - DNA, 105 bp, Homo sapiens; identical to SEQ ID NO: 3128
  misc_feature 1..105: note = chr7:139167722-139167827
  misc_feature 1..105: note = hyper
  source 1..105: mol_type = genomic DNA

SEQ ID NO: 9254 - DNA, 423 bp, Homo sapiens; identical to SEQ ID NO: 3129
  misc_feature 1..423: note = chr7:139168114-139168537
  misc_feature 1..423: note = hyper
  source 1..423: mol_type = genomic DNA

SEQ ID NO: 9255 - DNA, 55 bp, Homo sapiens
  misc_feature 1..55: note = chr7:139208245-139208300
  misc_feature 1..55: note = hyper
  source 1..55: mol_type = genomic DNA
tagaaccaggtctcccggctccaagactgcgctcccagctcgacagcatccagcc

SEQ ID NO: 9256 - DNA, 133 bp, Homo sapiens; identical to SEQ ID NO: 3130
  misc_feature 1..133: note = chr7:139208629-139208762
  misc_feature 1..133: note = hyper
  source 1..133: mol_type = genomic DNA

SEQ ID NO: 9257 - DNA, 15 bp, Homo sapiens
  misc_feature 1..15: note = chr7:140339853-140339868
  misc_feature 1..15: note = hyper
  source 1..15: mol_type = genomic DNA
gcccggctgctcagc

SEQ ID NO: 9258 - DNA, 40 bp, Homo sapiens
  misc_feature 1..40: note = chr7:140771769-140771809
  misc_feature 1..40: note = hyper
  source 1..40: mol_type = genomic DNA
ccattaaatttctctcgtcttgagtcgatcagccaaattt

SEQ ID NO: 9259 - DNA, 246 bp, Homo sapiens
  misc_feature 1..246: note = chr7:140772343-140772589
  misc_feature 1..246: note = hyper
  source 1..246: mol_type = genomic DNA
aagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagagg

SEQ ID NO: 9260 - DNA, 1196 bp, Homo sapiens
  misc_feature 1..1196: note = chr7:140773024-140774220
  misc_feature 1..1196: note = hyper
  source 1..1196: mol_type = genomic DNA
cgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccag

SEQ ID NO: 9261 - DNA, 212 bp, Homo sapiens
  misc_feature 1..212: note = chr7:143579739-143579951
  misc_feature 1..212: note = hyper
  source 1..212: mol_type = genomic DNA
ccctgccctcccccccgcagcacccaggccgagtccaccgttgctggccccttctccagcctgccaggcttttggagagggccactcaccaggtcaccctgcgatttccacgggggcaggtgggagcgggcagagcctggcgcagagaggaatgcacagggaagaggcttccctgtaccagtgactgggcgaccgagccgggatttgggagc

SEQ ID NO: 9262 - DNA, 143 bp, Homo sapiens
  misc_feature 1..143: note = chr7:143579952-143580095
  misc_feature 1..143: note = hyper
  source 1..143: mol_type = genomic DNA
gggaggaggctggagctggaggagaggaggggtttccacgggagtcccctcctccccacttcctcccaggctggagtgggagctccagggggcggcgcttggcgggggacagcgcttctttgtgtcgccggccctggtggctt

SEQ ID NO: 9263 - DNA, 113 bp, Homo sapiens; identical to SEQ ID NO: 3131
  misc_feature 1..113: note = chr7:145813015-145813128
  misc_feature 1..113: note = hyper
  source 1..113: mol_type = genomic DNA

SEQ ID NO: 9264 - DNA, 33 bp, Homo sapiens
  misc_feature 1..33: note = chr7:145813544-145813577
  misc_feature 1..33: note = hyper
  source 1..33: mol_type = genomic DNA
ctgcaccaccgtccccgtcgctctgccttcctc

SEQ ID NO: 9265 - DNA, 72 bp, Homo sapiens
  misc_feature 1..72: note = chr7:145813945-145814017
  misc_feature 1..72: note = hyper
  source 1..72: mol_type = genomic DNA
cgccgccggccgggaggcgaaggatgcaggcggctccgcgcgccggctgcggggcagcgctcctgctgtgga

SEQ ID NO: 9266 - DNA, 113 bp, Homo sapiens; identical to SEQ ID NO: 726
  misc_feature 1..113: note = chr7:149112136-149112249
  misc_feature 1..113: note = hyper
  source 1..113: mol_type = genomic DNA

SEQ ID NO: 9267 - DNA, 30 bp, Homo sapiens
  misc_feature 1..30: note = chr7:149119930-149119960
  misc_feature 1..30: note = hyper
  source 1..30: mol_type = genomic DNA
gcgccaaatggagggcgcagggttttagga

SEQ ID NO: 9268 - DNA, 246 bp, Homo sapiens
  misc_feature 1..246: note = chr7:149411482-149411728
  misc_feature 1..246: note = hyper
  source 1..246: mol_type = genomic DNA
ggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccc

SEQ ID NO: 9269 - DNA, 530 bp, Homo sapiens
  misc_feature 1..530: note = chr7:149411834-149412364
  misc_feature 1..530: note = hyper
  source 1..530: mol_type = genomic DNA
cgcttccgagccggcgccgcggcgccttctgggaagtgtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccac

SEQ ID NO: 9270 - DNA, 57 bp, Homo sapiens
  misc_feature 1..57: note = chr7:149744469-149744526
  misc_feature 1..57: note = hyper
  source 1..57: mol_type = genomic DNA
ccagccaccaactcccggccgccgcggctgcagacacagacccgctccctccgggac

SEQ ID NO: 9271 - skipped

SEQ ID NO: 9272 - DNA, 65 bp, Homo sapiens
  misc_feature 1..65: note = chr7:149744950-149745015
  misc_feature 1..65: note = hyper
  source 1..65: mol_type = genomic DNA
cgcgctcctgctggctgtctttagggctttttaatattttgctttctctccggttcccactcccc

SEQ ID NO: 9273 - DNA, 56 bp, Homo sapiens; identical to SEQ ID NO: 3133
  misc_feature 1..56: note = chr7:149917321-149917377
  misc_feature 1..56: note = hyper
  source 1..56: mol_type = genomic DNA

SEQ ID NO: 9274 - DNA, 103 bp, Homo sapiens
  misc_feature 1..103: note = chr7:150716169-150716272
  misc_feature 1..103: note = hyper
  source 1..103: mol_type = genomic DNA
gcagctcccagcccccgcggaagagcgagaagggaccgcggaagagcagcaggtcgacattgagcgccaggccgcggctgaggaaagccgcactgcctcccca

SEQ ID NO: 9275 - DNA, 361 bp, Homo sapiens
  misc_feature 1..361: note = chr7:150748158-150748519
  misc_feature 1..361: note = hyper
  source 1..361: mol_type = genomic DNA
agaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccg

SEQ ID NO: 9276 - DNA, 165 bp, Homo sapiens
  misc_feature 1..165: note = chr7:150864232-150864397
  misc_feature 1..165: note = hyper
  source 1..165: mol_type = genomic DNA
ttcgggcggcagtggcggcggcggcggcagcggcggcggcgagctcctggggcccgtagaaagcgtcgggcggctccgcgaagctgggcagcgcggtggtcagcgccaccatcgagggcacagcctgacccagccccgcgcagaaggtgttggtaaggcggccgg

SEQ ID NO: 9277 - DNA, 148 bp, Homo sapiens; identical to SEQ ID NO: 3134
  misc_feature 1..148: note = chr7:151106418-151106566
  misc_feature 1..148: note = hyper
  source 1..148: mol_type = genomic DNA

SEQ ID NO: 9278 - DNA, 400 bp, Homo sapiens; identical to SEQ ID NO: 3135
  misc_feature 1..400: note = chr7:151106589-151106989
  misc_feature 1..400: note = hyper
  source 1..400: mol_type = genomic DNA

SEQ ID NO: 9279 - DNA, 181 bp, Homo sapiens; identical to SEQ ID NO: 3136
  misc_feature 1..181: note = chr7:151107395-151107576
  misc_feature 1..181: note = hyper
  source 1..181: mol_type = genomic DNA

SEQ ID NO: 9280 - DNA, 30 bp, Homo sapiens
  misc_feature 1..30: note = chr7:151107782-151107812
  misc_feature 1..30: note = hyper
  source 1..30: mol_type = genomic DNA
ttccggcgccgacttcgctggggacgggga

SEQ ID NO: 9281 - DNA, 175 bp, Homo sapiens
  misc_feature 1..175: note = chr7:151145538-151145713
  misc_feature 1..175: note = hyper
  source 1..175: mol_type = genomic DNA
cggttccaggagcctcgccccctgctggggacccagcttgtgccctggcgtcgtggccgccggcaggcagcaaggaagggggtgtaaagagcccggttaggctgagtccctgcccttccgagggagcccgtctgcgagtgagcccgtctgcaagtgagcccgtctgcaagtgagc

SEQ ID NO: 9282 - DNA, 30 bp, Homo sapiens
  misc_feature 1..30: note = chr7:152622731-152622761
  misc_feature 1..30: note = hyper
  source 1..30: mol_type = genomic DNA
cggcctgagcccctgcggtgattccccagg

SEQ ID NO: 9283 - DNA, 117 bp, Homo sapiens
  misc_feature 1..117: note = chr7:153446175-153446292
  misc_feature 1..117: note = hyper
  source 1..117: mol_type = genomic DNA
cggcaggtttgtggagggagtgtgagcagccgctggtgcgtctgcatgccttgcaggggtcggtgactgaggatggttggcggatcgcgggggttgagagaacgtgtgctgttttgt

SEQ ID NO: 9284 - DNA, 64 bp, Homo sapiens
  misc_feature 1..64: note = chr7:153583466-153583530
  misc_feature 1..64: note = hyper
  source 1..64: mol_type = genomic DNA
ggttagagaaatgggcgctgggatttggccccggccagtgctggggttccagggtagggagagc

SEQ ID NO: 9285 - DNA, 71 bp, Homo sapiens; identical to SEQ ID NO: 3137
  misc_feature 1..71: note = chr7:153583933-153584004
  misc_feature 1..71: note = hyper
  source 1..71: mol_type = genomic DNA

SEQ ID NO: 9286 - DNA, 30 bp, Homo sapiens
  misc_feature 1..30: note = chr7:153584421-153584451
  misc_feature 1..30: note = hyper
  source 1..30: mol_type = genomic DNA
gtcagagctgcctctcgccctcgctagctg

SEQ ID NO: 9287 - DNA, 180 bp, Homo sapiens
  misc_feature 1..180: note = chr7:153584889-153585069
  misc_feature 1..180: note = hyper
  source 1..180: mol_type = genomic DNA
tgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggcttt

SEQ ID NO: 9288 - DNA, 194 bp, Homo sapiens; identical to SEQ ID NO: 3138
  misc_feature 1..194: note = chr7:153749733-153749927
  misc_feature 1..194: note = hyper
  source 1..194: mol_type = genomic DNA

SEQ ID NO: 9289 - DNA, 40 bp, Homo sapiens
  misc_feature 1..40: note = chr7:153750249-153750289
  misc_feature 1..40: note = hyper
  source 1..40: mol_type = genomic DNA
cgccctccccccgcccacgactctccgggcgcccccagac

SEQ ID NO: 9290 - DNA, 10 bp, Homo sapiens
  misc_feature 1..10: note = chr7:154002083-154002093
  misc_feature 1..10: note = hyper
  source 1..10: mol_type = genomic DNA
cgctgcctcc

SEQ ID NO: 9291 - DNA, 89 bp, Homo sapiens
  misc_feature 1..89: note = chr7:154861818-154861907
  misc_feature 1..89: note = hyper
  source 1..89: mol_type = genomic DNA
tgctcccgggcggggcgaggtggcagcaccgcggacagcaccacatgtggtggcgcacactgggagccgccaggcgcggggagcgcagc

SEQ ID NO: 9292 - DNA, 131 bp, Homo sapiens
  misc_feature 1..131: note = chr7:154862176-154862307
  misc_feature 1..131: note = hyper
  source 1..131: mol_type = genomic DNA
tgggcagggagacaacgcggtgagagcgactgctctgacgcaccagcccctctcctgcacccacacgctgctggccgcccagcttctccccgatctgggagatgctcggctctgggcggccaaacagcctt

SEQ ID NO: 9293 - DNA, 2593 bp, Homo sapiens; identical to SEQ ID NO: 727
  misc_feature 1..2593: note = chr7:155164445-155167038
  misc_feature 1..2593: note = hyper
  source 1..2593: mol_type = genomic DNA

SEQ ID NO: 9294 - DNA, 51 bp, Homo sapiens; identical to SEQ ID NO: 728
  misc_feature 1..51: note = chr7:155167039-155167090
  misc_feature 1..51: note = hyper
  source 1..51: mol_type = genomic DNA

SEQ ID NO: 9295 - DNA, 487 bp, Homo sapiens; identical to SEQ ID NO: 729
  misc_feature 1..487: note = chr7:155167174-155167661
  misc_feature 1..487: note = hyper
  source 1..487: mol_type = genomic DNA

SEQ ID NO: 9296 - DNA, 77 bp, Homo sapiens
  misc_feature 1..77: note = chr7:155168537-155168614
  misc_feature 1..77: note = hyper
  source 1..77: mol_type = genomic DNA
tgccaggcgacgtttcgtggttgtatttggcccactaaatcctaggtcgctcttcctatgtacgactgtagactcac

SEQ ID NO: 9297 - DNA, 202 bp, Homo sapiens
  misc_feature 1..202: note = chr7:155170276-155170478
  misc_feature 1..202: note = hyper
  source 1..202: mol_type = genomic DNA
ccctgaacaggctggcggtgggaagcaggcattggagtcccacggctcactggactgcagcagcgagcccttcacggttgcaaaggaaggaaattcctagcggggcaactcttcagcgtccgccccacagacctagcacgatgtccttttctgtctcaagatacatctggctgggcttccctaaaaccgggcttagttggac

SEQ ID NO: 9298 - DNA, 89 bp, Homo sapiens
  misc_feature 1..89: note = chr7:155170836-155170925
  misc_feature 1..89: note = hyper
  source 1..89: mol_type = genomic DNA
gcttgagggctgctccgcatagaccaacgtccggggaaggcacacagtggccgagggcccgcgcgcttgggctacggctgtgatggtat

SEQ ID NO: 9299 - DNA, 78 bp, Homo sapiens
  misc_feature 1..78: note = chr7:155173869-155173947
  misc_feature 1..78: note = hyper
  source 1..78: mol_type = genomic DNA
cttcaccttccaaaccgcagtccctggtgatcctgacttttgcagcctggctctgggtccacacggggctggagaagg

SEQ ID NO: 9300 - DNA, 634 bp, Homo sapiens; identical to SEQ ID NO: 3142
  misc_feature 1..634: note = chr7:155174224-155174858
  misc_feature 1..634: note = hyper
  source 1..634: mol_type = genomic DNA

SEQ ID NO: 9301 - DNA, 61 bp, Homo sapiens; identical to SEQ ID NO: 730
  misc_feature 1..61: note = chr7:155241429-155241490
  misc_feature 1..61: note = hyper
  source 1..61: mol_type = genomic DNA

SEQ ID NO: 9302 - DNA, 738 bp, Homo sapiens; identical to SEQ ID NO: 731
  misc_feature 1..738: note = chr7:155241491-155242229
  misc_feature 1..738: note = hyper
  source 1..738: mol_type = genomic DNA

SEQ ID NO: 9303 - DNA, 742 bp, Homo sapiens; identical to SEQ ID NO: 3145
  misc_feature 1..742: note = chr7:155242699-155243441
  misc_feature 1..742: note = hyper
  source 1..742: mol_type = genomic DNA

SEQ ID NO: 9304 - DNA, 67 bp, Homo sapiens
  misc_feature 1..67: note = chr7:155243755-155243822
  misc_feature 1..67: note = hyper
  source 1..67: mol_type = genomic DNA
cggttttgttttccaggggtagtttctgcagaaaggagattctcctccgggccgaagggctaccagc

SEQ ID NO: 9305 - DNA, 208 bp, Homo sapiens; identical to SEQ ID NO: 3146
  misc_feature 1..208: note = chr7:155244031-155244239
  misc_feature 1..208: note = hyper
  source 1..208: mol_type = genomic DNA

SEQ ID NO: 9306 - DNA, 491 bp, Homo sapiens; identical to SEQ ID NO: 732
  misc_feature 1..491: note = chr7:155246989-155247480
  misc_feature 1..491: note = hyper
  source 1..491: mol_type = genomic DNA

SEQ ID NO: 9307 - DNA, 37 bp, Homo sapiens
  misc_feature 1..37: note = chr7:155248008-155248045
  misc_feature 1..37: note = hyper
  source 1..37: mol_type = genomic DNA
ctctgcccaccggcccgccaggcgccctggaggtgac

SEQ ID NO: 9308 - DNA, 88 bp, Homo sapiens
  misc_feature 1..88: note = chr7:155249117-155249205
  misc_feature 1..88: note = hyper
  source 1..88: mol_type = genomic DNA
taaatgatggacaggcgagcctggggtaacaacgggtgtttggtgggtagacaagagcaaatgggaaggagcccgagggaggaggggg

SEQ ID NO: 9309 - DNA, 111 bp, Homo sapiens; identical to SEQ ID NO: 3148
  misc_feature 1..111: note = chr7:155249900-155250011
  misc_feature 1..111: note = hyper
  source 1..111: mol_type = genomic DNA

SEQ ID NO: 9310 - DNA, 430 bp, Homo sapiens
  misc_feature 1..430: note = chr7:155250387-155250817
  misc_feature 1..430: note = hyper
  source 1..430: mol_type = genomic DNA
cgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctct

SEQ ID NO: 9311 - DNA, 123 bp, Homo sapiens
  misc_feature 1..123: note = chr7:155251427-155251550
  misc_feature 1..123: note = hyper
  source 1..123: mol_type = genomic DNA
agcagctcttgggctcgggctcccgagagccccggcagaacccgccatgtgcgcccggcgcgggcgggccgctcccagccgccggcagcgactctccgggtgacggggaaggcggctccaaga

SEQ ID NO: 9312 - DNA, 100 bp, Homo sapiens; identical to SEQ ID NO: 3149
  misc_feature 1..100: note = chr7:155252162-155252262
  misc_feature 1..100: note = hyper
  source 1..100: mol_type = genomic DNA

SEQ ID NO: 9313 - DNA, 146 bp, Homo sapiens; identical to SEQ ID NO: 3150
  misc_feature 1..146: note = chr7:155252316-155252462
  misc_feature 1..146: note = hyper
  source 1..146: mol_type = genomic DNA

SEQ ID NO: 9314 - DNA, 156 bp, Homo sapiens
  misc_feature 1..156: note = chr7:155252910-155253066
  misc_feature 1..156: note = hyper
  source 1..156: mol_type = genomic DNA
acaggctcacaatgccgggcgaggagactcggccgggctttgtgcggcgcgggagttcgctgagccagcccccaacggcccgggagctgggcagcaccgcccggcccggcctggcccggcccagctcagcccagcccaagtcgcctatcttcatgg

SEQ ID NO: 9315 - DNA, 423 bp, Homo sapiens; identical to SEQ ID NO: 733
  misc_feature 1..423: note = chr7:155254901-155255324
  misc_feature 1..423: note = hyper
  source 1..423: mol_type = genomic DNA

SEQ ID NO: 9316 - skipped

SEQ ID NO: 9317 - DNA, 44 bp, Homo sapiens; identical to SEQ ID NO: 3153
  misc_feature 1..44: note = chr7:155256268-155256312
  misc_feature 1..44: note = hyper
  source 1..44: mol_type = genomic DNA

SEQ ID NO: 9318 - DNA, 792 bp, Homo sapiens; identical to SEQ ID NO: 734
  misc_feature 1..792: note = chr7:155258072-155258864
  misc_feature 1..792: note = hyper
  source 1..792: mol_type = genomic DNA

SEQ ID NO: 9319 - DNA, 164 bp, Homo sapiens; identical to SEQ ID NO: 735
  misc_feature 1..164: note = chr7:155258914-155259078
  misc_feature 1..164: note = hyper
  source 1..164: mol_type = genomic DNA

SEQ ID NO: 9320 - DNA, 504 bp, Homo sapiens; identical to SEQ ID NO: 736
  misc_feature 1..504: note = chr7:155259119-155259623
  misc_feature 1..504: note = hyper
  source 1..504: mol_type = genomic DNA

SEQ ID NO: 9321 - DNA, 12 bp, Homo sapiens
  misc_feature 1..12: note = chr7:155259833-155259845
  misc_feature 1..12: note = hyper
  source 1..12: mol_type = genomic DNA
cggggattcgcc

SEQ ID NO: 9322 - DNA, 112 bp, Homo sapiens; identical to SEQ ID NO: 738
  misc_feature 1..112: note = chr7:155259846-155259958
  misc_feature 1..112: note = hyper
  source 1..112: mol_type = genomic DNA

SEQ ID NO: 9323 - DNA, 99 bp, Homo sapiens; identical to SEQ ID NO: 739
  misc_feature 1..99: note = chr7:155260038-155260137
  misc_feature 1..99: note = hyper
  source 1..99: mol_type = genomic DNA

SEQ ID NO: 9324 - DNA, 106 bp, Homo sapiens; identical to SEQ ID NO: 3160
  misc_feature 1..106: note = chr7:155260785-155260891
  misc_feature 1..106: note = hyper
  source 1..106: mol_type = genomic DNA

SEQ ID NO: 9325 - DNA, 140 bp, Homo sapiens; identical to SEQ ID NO: 3161
  misc_feature 1..140: note = chr7:155261070-155261210
  misc_feature 1..140: note = hyper
  source 1..140: mol_type = genomic DNA

SEQ ID NO: 9326 - DNA, 215 bp, Homo sapiens
  misc_feature 1..215: note = chr7:155264127-155264342
  misc_feature 1..215: note = hyper
  source 1..215: mol_type = genomic DNA
gaaacaaaaacagcacgtcagaggaagaatgtcatacaaacccgctggagtcacaaggcaaaacagcccccatacctaaacgcccggcgtgacaatggcctttgtgcctggcgccgtcggggggagctgggcgcctagcgggtggggcaggcggaagttggacacatttccacgcaggtgaggccatccatggggtgatgcgggtgttggggctc

SEQ ID NO: 9327 - DNA, 197 bp, Homo sapiens; identical to SEQ ID NO: 740
  misc_feature 1..197: note = chr7:155301753-155301950
  misc_feature 1..197: note = hyper
  source 1..197: mol_type = genomic DNA

SEQ ID NO: 9328 - DNA, 346 bp, Homo sapiens; identical to SEQ ID NO: 741
  misc_feature 1..346: note = chr7:155302372-155302718
  misc_feature 1..346: note = hyper
  source 1..346: mol_type = genomic DNA

SEQ ID NO: 9329 - DNA, 188 bp, Homo sapiens; identical to SEQ ID NO: 742
  misc_feature 1..188: note = chr7:155302963-155303151
  misc_feature 1..188: note = hyper
  source 1..188: mol_type = genomic DNA

SEQ ID NO: 9330 - DNA, 33 bp, Homo sapiens
  misc_feature 1..33: note = chr7:155325796-155325829
  misc_feature 1..33: note = hyper
  source 1..33: mol_type = genomic DNA
gagtaaccaagcatacgccgtacagtgacaaca

SEQ ID NO: 9331 - DNA, 372 bp, Homo sapiens; identical to SEQ ID NO: 3165
  misc_feature 1..372: note = chr7:155326169-155326541
  misc_feature 1..372: note = hyper
  source 1..372: mol_type = genomic DNA

SEQ ID NO: 9332 - DNA, 45 bp, Homo sapiens
  misc_feature 1..45: note = chr7:155580181-155580226
  misc_feature 1..45: note = hyper
  source 1..45: mol_type = genomic DNA
gggccgcccctgtctcgggccctgccgcgccgcccgcccgctgca

SEQ ID NO: 9333 - DNA, 41 bp, Homo sapiens
  misc_feature 1..41: note = chr7:156409472-156409513
  misc_feature 1..41: note = hyper
  source 1..41: mol_type = genomic DNA
tcctcgccccgaccccgcgcccctgcgcccgggctccagcc

SEQ ID NO: 9334 - DNA, 75 bp, Homo sapiens
  misc_feature 1..75: note = chr7:156409727-156409802
  misc_feature 1..75: note = hyper
  source 1..75: mol_type = genomic DNA
cgcgctcagccgggtgaacctggaactgtgttcctggcccagcgctttcataaaagggcgcggaatagtaagtcc

SEQ ID NO: 9335 - DNA, 21 bp, Homo sapiens
  misc_feature 1..21: note = chr7:156794464-156794485
  misc_feature 1..21: note = hyper
  source 1..21: mol_type = genomic DNA
ccactgcgcccagcctgattt

SEQ ID NO: 9336 - DNA, 288 bp, Homo sapiens; identical to SEQ ID NO: 744
  misc_feature 1..288: note = chr7:156795067-156795355
  misc_feature 1..288: note = hyper
  source 1..288: mol_type = genomic DNA

SEQ ID NO: 9337 - DNA, 235 bp, Homo sapiens; identical to SEQ ID NO: 745
  misc_feature 1..235: note = chr7:156795401-156795636
  misc_feature 1..235: note = hyper
  source 1..235: mol_type = genomic DNA

SEQ ID NO: 9338 - DNA, 114 bp, Homo sapiens; identical to SEQ ID NO: 746
  misc_feature 1..114: note = chr7:156795899-156796013
  misc_feature 1..114: note = hyper
  source 1..114: mol_type = genomic DNA

SEQ ID NO: 9339 - DNA, 246 bp, Homo sapiens; identical to SEQ ID NO: 747
  misc_feature 1..246: note = chr7:156796494-156796740
  misc_feature 1..246: note = hyper
  source 1..246: mol_type = genomic DNA

SEQ ID NO: 9340 - DNA, 355 bp, Homo sapiens; identical to SEQ ID NO: 748
  misc_feature 1..355: note = chr7:156797005-156797360
  misc_feature 1..355: note = hyper
  source 1..355: mol_type = genomic DNA

SEQ ID NO: 9341 - DNA, 828 bp, Homo sapiens; identical to SEQ ID NO: 749
  misc_feature 1..828: note = chr7:156797607-156798435
  misc_feature 1..828: note = hyper
  source 1..828: mol_type = genomic DNA

SEQ ID NO: 9342 - DNA, 621 bp, Homo sapiens; identical to SEQ ID NO: 750
  misc_feature 1..621: note = chr7:156798526-156799147
  misc_feature 1..621: note = hyper
  source 1..621: mol_type = genomic DNA

SEQ ID NO: 9343 - DNA, 50 bp, Homo sapiens; identical to SEQ ID NO: 751
  misc_feature 1..50: note = chr7:156799290-156799340
  misc_feature 1..50: note = hyper
  source 1..50: mol_type = genomic DNA

SEQ ID NO: 9344 - DNA, 139 bp, Homo sapiens
  misc_feature 1..139: note = chr7:156800933-156801072
  misc_feature 1..139: note = hyper
  source 1..139: mol_type = genomic DNA
ccgtgggcaacttagcgtccttggctctgggaaatgcaggtcatattggtggctttctatcagaagggatgggccctgggtcggcaccctgggtttaagcccaggctggcaggggattcgcagacgcagacgtgtctga

SEQ ID NO: 9345 - DNA, 434 bp, Homo sapiens; identical to SEQ ID NO: 752
  misc_feature 1..434: note = chr7:156801438-156801872
  misc_feature 1..434: note = hyper
  source 1..434: mol_type = genomic DNA

SEQ ID NO: 9346 - DNA, 30 bp, Homo sapiens
  misc_feature 1..30: note = chr7:156809193-156809223
  misc_feature 1..30: note = hyper
  source 1..30: mol_type = genomic DNA
gtccaagtccatgttcgataatggcaggaa

SEQ ID NO: 9347 - DNA, 105 bp, Homo sapiens
  misc_feature 1..105: note = chr7:156810064-156810169
  misc_feature 1..105: note = hyper
  source 1..105: mol_type = genomic DNA
caccgaggggcaaaccggctgaggacccaggcacgaagagtgtcaccagctctgaccacaagccccgtagaccagggctgcgtccataatcggggttgatggcat

SEQ ID NO: 9348 - DNA, 31 bp, Homo sapiens; identical to SEQ ID NO: 753
  misc_feature 1..31: note = chr7:156810491-156810522
  misc_feature 1..31: note = hyper
  source 1..31: mol_type = genomic DNA

SEQ ID NO: 9349 - DNA, 204 bp, Homo sapiens; identical to SEQ ID NO: 754
  misc_feature 1..204: note = chr7:156810597-156810801
  misc_feature 1..204: note = hyper
  source 1..204: mol_type = genomic DNA

SEQ ID NO: 9350 - DNA, 104 bp, Homo sapiens; identical to SEQ ID NO: 755
  misc_feature 1..104: note = chr7:156811302-156811406
  misc_feature 1..104: note = hyper
  source 1..104: mol_type = genomic DNA

SEQ ID NO: 9351 - DNA, 38 bp, Homo sapiens
  misc_feature 1..38: note = chr7:156811672-156811710
  misc_feature 1..38: note = hyper
  source 1..38: mol_type = genomic DNA
cctggagccgagggacgccccgacggacctcgggcctc

SEQ ID NO: 9352 - DNA, 974 bp, Homo sapiens; identical to SEQ ID NO: 756
  misc_feature 1..974: note = chr7:156812852-156813826
  misc_feature 1..974: note = hyper
  source 1..974: mol_type = genomic DNA

SEQ ID NO: 9353 - DNA, 244 bp, Homo sapiens; identical to SEQ ID NO: 757
  misc_feature 1..244: note = chr7:156813986-156814230
  misc_feature 1..244: note = hyper
  source 1..244: mol_type = genomic DNA

SEQ ID NO: 9354 - DNA, 11 bp, Homo sapiens
  misc_feature 1..11: note = chr7:156871282-156871293
  misc_feature 1..11: note = hyper
  source 1..11: mol_type = genomic DNA
cgagctccaga

SEQ ID NO: 9355 - DNA, 71 bp, Homo sapiens
  misc_feature 1..71: note = chr7:157129160-157129231
  misc_feature 1..71: note = hyper
  source 1..71: mol_type = genomic DNA
gccggcgccttcgcccgccttcgctggccgccgcttggtttgttcttcttctccttcggggacttctccgc

SEQ ID NO: 9356 - DNA, 55 bp, Homo sapiens
  misc_feature 1..55: note = chr7:157476914-157476969
  misc_feature 1..55: note = hyper
  source 1..55: mol_type = genomic DNA
ctgagttaatggaaacgcgggttaaatgagaaaagacgcccggattttcctgcct

SEQ ID NO: 9357 - DNA, 16 bp, Homo sapiens
  misc_feature 1..16: note = chr7:157477473-157477489
  misc_feature 1..16: note = hyper
  source 1..16: mol_type = genomic DNA
gggccggggtctcctc

SEQ ID NO: 9358 - DNA, 107 bp, Homo sapiens; identical to SEQ ID NO: 759
  misc_feature 1..107: note = chr7:157477710-157477817
  misc_feature 1..107: note = hyper
  source 1..107: mol_type = genomic DNA

SEQ ID NO: 9359 - DNA, 17 bp, Homo sapiens
  misc_feature 1..17: note = chr7:157481533-157481550
  misc_feature 1..17: note = hyper
  source 1..17: mol_type = genomic DNA
cgtccctcccccctcgc

SEQ ID NO: 9360 - DNA, 227 bp, Homo sapiens; identical to SEQ ID NO: 3184
  misc_feature 1..227: note = chr7:157481847-157482074
  misc_feature 1..227: note = hyper
  source 1..227: mol_type = genomic DNA

SEQ ID NO: 9361 - DNA, 110 bp, Homo sapiens
  misc_feature 1..110: note = chr7:157482557-157482667
  misc_feature 1..110: note = hyper
  source 1..110: mol_type = genomic DNA
gatactcccatggctcggaggcgcgctcccggaccctggtgaggagggtgaagagcgccccaaaatgggctgagaggaaaatgcgcccacactggcgcctctccatcctg

SEQ ID NO: 9362 - DNA, 239 bp, Homo sapiens; identical to SEQ ID NO: 3185
  misc_feature 1..239: note = chr7:157483274-157483513
  misc_feature 1..239: note = hyper
  source 1..239: mol_type = genomic DNA

SEQ ID NO: 9363 - DNA, 83 bp, Homo sapiens
  misc_feature 1..83: note = chr7:157483738-157483821
  misc_feature 1..83: note = hyper
  source 1..83: mol_type = genomic DNA
caccggttgctatagcgatgtccccccccccccccacatgttgctgacagcaattggctaaggggccgcggctctccaaacac

SEQ ID NO: 9364 - DNA, 75 bp, Homo sapiens
  misc_feature 1..75: note = chr7:157484507-157484582
  misc_feature 1..75: note = hyper
  source 1..75: mol_type = genomic DNA
cgagaagagctagggtctcggggcgactaggaccactgagcacctcccccccgcgcctcccgcccatgctctctc

SEQ ID NO: 9365 - DNA, 99 bp, Homo sapiens; identical to SEQ ID NO: 3186
  misc_feature 1..99: note = chr7:157485503-157485602
  misc_feature 1..99: note = hyper
  source 1..99: mol_type = genomic DNA

SEQ ID NO: 9366 - DNA, 15 bp, Homo sapiens
  misc_feature 1..15: note = chr7:157485649-157485664
  misc_feature 1..15: note = hyper
  source 1..15: mol_type = genomic DNA
cggttcctgtccctc

SEQ ID NO: 9367 - DNA, 68 bp, Homo sapiens; identical to SEQ ID NO: 3188
  misc_feature 1..68: note = chr7:157486014-157486082
  misc_feature 1..68: note = hyper
  source 1..68: mol_type = genomic DNA

SEQ ID NO: 9368 - DNA, 211 bp, Homo sapiens; identical to SEQ ID NO: 3189
  misc_feature 1..211: note = chr7:157486204-157486415
  misc_feature 1..211: note = hyper
  source 1..211: mol_type = genomic DNA

SEQ ID NO: 9369 - DNA, 28 bp, Homo sapiens
  misc_feature 1..28: note = chr7:157486475-157486503
  misc_feature 1..28: note = hyper
  source 1..28: mol_type = genomic DNA
cgccctggatcgccggagcctcatccag

SEQ ID NO: 9370 - DNA, 162 bp, Homo sapiens
  misc_feature 1..162: note = chr7:158936595-158936757
  misc_feature 1..162: note = hyper
  source 1..162: mol_type = genomic DNA
ccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccg

SEQ ID NO: 9371 - DNA, 129 bp, Homo sapiens; identical to SEQ ID NO: 3191
  misc_feature 1..129: note = chr7:158937202-158937331
  misc_feature 1..129: note = hyper
  source 1..129: mol_type = genomic DNA

SEQ ID NO: 9372 - DNA, 91 bp, Homo sapiens
  misc_feature 1..91: note = chr7:158938315-158938406
  misc_feature 1..91: note = hyper
  source 1..91: mol_type = genomic DNA
gggttttgtgtcctgcgtttgcaaaacgggggtcattctctccccgcaaacgcggcggcgggtggggaacgctgggcggggactcacgcgg

SEQ ID NO: 9373 - DNA, 82 bp, Homo sapiens
  misc_feature 1..82: note = chr8:495729-495811
  misc_feature 1..82: note = hyper
  source 1..82: mol_type = genomic DNA
ggtgggcggtggggccgctggggcctggggcgccgcgggctcggcccggactgacggcggtggggggcggggatggggccgt

SEQ ID NO: 9374 - DNA, 56 bp, Homo sapiens; identical to SEQ ID NO: 3192
  misc_feature 1..56: note = chr8:687162-687218
  misc_feature 1..56: note = hyper
  source 1..56: mol_type = genomic DNA

SEQ ID NO: 9375 - DNA, 129 bp, Homo sapiens; identical to SEQ ID NO: 3193
  misc_feature 1..129: note = chr8:687513-687642
  misc_feature 1..129: note = hyper
  source 1..129: mol_type = genomic DNA

SEQ ID NO: 9376 - DNA, 139 bp, Homo sapiens; identical to SEQ ID NO: 3194
  misc_feature 1..139: note = chr8:687837-687976
  misc_feature 1..139: note = hyper
  source 1..139: mol_type = genomic DNA

SEQ ID NO: 9377 - DNA, 46 bp, Homo sapiens
  misc_feature 1..46: note = chr8:4849490-4849536
  misc_feature 1..46: note = hyper
  source 1..46: mol_type = genomic DNA
gtcctggaccccctccgcgcgcacacacttgcgcacagcacctctc

SEQ ID NO: 9378 - DNA, 60 bp, Homo sapiens
  misc_feature 1..60: note = chr8:4850456-4850516
  misc_feature 1..60: note = hyper
  source 1..60: mol_type = genomic DNA
ggagctggtgctgagcggtcagctttcacggagccctggacgccccgtggaggcaagtgc

SEQ ID NO: 9379 - DNA, 46 bp, Homo sapiens
  misc_feature 1..46: note = chr8:4851880-4851926
  misc_feature 1..46: note = hyper
  source 1..46: mol_type = genomic DNA
acagcaccagcagcccgagaagcaggagcagcgactggaatctcct

SEQ ID NO: 9380 - DNA, 68 bp, Homo sapiens
  misc_feature 1..68: note = chr8:4852501-4852569
  misc_feature 1..68: note = hyper
  source 1..68: mol_type = genomic DNA
gacagagcccagcctcggggcctcgggctgcccgcaccgtgctgcgcttcattcggcctcagcgcagc

SEQ ID NO: 9381 - DNA, 30 bp, Homo sapiens
  misc_feature 1..30: note = chr8:6692832-6692862
  misc_feature 1..30: note = hyper
  source 1..30: mol_type = genomic DNA
gcgcgcagtgctgggcgcaggctggggcag

SEQ ID NO: 9382 - DNA, 194 bp, Homo sapiens
  misc_feature 1..194: note = chr8:9756090-9756284
  misc_feature 1..194: note = hyper
  source 1..194: mol_type = genomic DNA
aacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggc

SEQ ID NO: 9383 - DNA, 15 bp, Homo sapiens
  misc_feature 1..15: note = chr8:9756486-9756501
  misc_feature 1..15: note = hyper
  source 1..15: mol_type = genomic DNA
cgctagagtgaaatc

SEQ ID NO: 9384 - DNA, 104 bp, Homo sapiens; identical to SEQ ID NO: 3195
  misc_feature 1..104: note = chr8:9762586-9762690
  misc_feature 1..104: note = hyper
  source 1..104: mol_type = genomic DNA

SEQ ID NO: 9385 - DNA, 540 bp, Homo sapiens; identical to SEQ ID NO: 3196
  misc_feature 1..540: note = chr8:9762751-9763291
  misc_feature 1..540: note = hyper
  source 1..540: mol_type = genomic DNA

SEQ ID NO: 9386 - DNA, 197 bp, Homo sapiens; identical to SEQ ID NO: 3197
  misc_feature 1..197: note = chr8:9763565-9763762
  misc_feature 1..197: note = hyper
  source 1..197: mol_type = genomic DNA

SEQ ID NO: 9387 - DNA, 263 bp, Homo sapiens; identical to SEQ ID NO: 3198
  misc_feature 1..263: note = chr8:9763787-9764050
  misc_feature 1..263: note = hyper
  source 1..263: mol_type = genomic DNA

SEQ ID NO: 9388 - DNA, 718 bp, Homo sapiens; identical to SEQ ID NO: 3199
  misc_feature 1..718: note = chr8:9764195-9764913
  misc_feature 1..718: note = hyper
  source 1..718: mol_type = genomic DNA

SEQ ID NO: 9389 - DNA, 131 bp, Homo sapiens
  misc_feature 1..131: note = chr8:10587422-10587553
  misc_feature 1..131: note = hyper
  source 1..131: mol_type = genomic DNA
ccccgccccctggggcgccgatctccgctcctgtcccagcagaggagcctccctgcccgccgcgcggtttcactttggaccgcgccaagtgcccccgctctgaatcctgggcaccgcgagcacccacgctc

SEQ ID NO: 9390 - DNA, 216 bp, Homo sapiens
  misc_feature 1..216: note = chr8:11204810-11205026
  misc_feature 1..216: note = hyper
  source 1..216: mol_type = genomic DNA
cagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgt

SEQ ID NO: 9391 - DNA, 249 bp, Homo sapiens
  misc_feature 1..249: note = chr8:11205453-11205702
  misc_feature 1..249: note = hyper
  source 1..249: mol_type = genomic DNA
gcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccggtctgcagtcaga

SEQ ID NO: 9392 - DNA, 61 bp, Homo sapiens
  misc_feature 1..61: note = chr8:11206007-11206068
  misc_feature 1..61: note = hyper
  source 1..61: mol_type = genomic DNA
gcgcacacagctaggcgggccgcgggccgcgaccccctggctggtccgtgctctccccctg

SEQ ID NO: 9393 - DNA, 30 bp, Homo sapiens
  misc_feature 1..30: note = chr8:11536827-11536857
  misc_feature 1..30: note = hyper
  source 1..30: mol_type = genomic DNA
gggggaggaaggggacgtttctagaagaaa

SEQ ID NO: 9394 - DNA, 104 bp, Homo sapiens
  misc_feature 1..104: note = chr8:11537179-11537283
  misc_feature 1..104: note = hyper
  source 1..104: mol_type = genomic DNA
gagccctgagtgggccgggtgctgggcgaacagtcctagccctgcactgaggttggaaaagcgaacggaaagtgacatttttacaggggcgaggttgggatcgg

SEQ ID NO: 9395 - DNA, 50 bp, Homo sapiens
  misc_feature 1..50: note = chr8:11550672-11550722
  misc_feature 1..50: note = hyper
  source 1..50: mol_type = genomic DNA
agcttagaaatgattcggcaagctgggcgcggtggcgcatatttgtaatc

SEQ ID NO: 9396 - skipped

SEQ ID NO: 9397 - DNA, 51 bp, Homo sapiens
  misc_feature 1..51: note = chr8:11560067-11560118
  misc_feature 1..51: note = hyper
  source 1..51: mol_type = genomic DNA
gtgctccggagaccgcttttccgcagcgccggcctccgagatccccagcac

SEQ ID NO: 9398 - DNA, 30 bp, Homo sapiens
  misc_feature 1..30: note = chr8:11560481-11560511
  misc_feature 1..30: note = hyper
  source 1..30: mol_type = genomic DNA
cccgcgtcctggcctcgtccttaacccccg

SEQ ID NO: 9399 - DNA, 141 bp, Homo sapiens; identical to SEQ ID NO: 3200
  misc_feature 1..141: note = chr8:11560711-11560852
  misc_feature 1..141: note = hyper
  source 1..141: mol_type = genomic DNA

SEQ ID NO: 9400 - DNA, 30 bp, Homo sapiens
  misc_feature 1..30: note = chr8:11561116-11561146
  misc_feature 1..30: note = hyper
  source 1..30: mol_type = genomic DNA
tgaggcctgggctcccgaccatctccctgg

SEQ ID NO: 9401 - DNA, 282 bp, Homo sapiens; identical to SEQ ID NO: 3201
  misc_feature 1..282: note = chr8:11561442-11561724
  misc_feature 1..282: note = hyper
  source 1..282: mol_type = genomic DNA

SEQ ID NO: 9402 - DNA, 471 bp, Homo sapiens; identical to SEQ ID NO: 3202
  misc_feature 1..471: note = chr8:11561725-11562196
  misc_feature 1..471: note = hyper
  source 1..471: mol_type = genomic DNA

SEQ ID NO: 9403 - DNA, 146 bp, Homo sapiens; identical to SEQ ID NO: 3203
  misc_feature 1..146: note = chr8:11562235-11562381
  misc_feature 1..146: note = hyper
  source 1..146: mol_type = genomic DNA

SEQ ID NO: 9404 - DNA, 104 bp, Homo sapiens; identical to SEQ ID NO: 3204
  misc_feature 1..104: note = chr8:11562627-11562731
  misc_feature 1..104: note = hyper
  source 1..104: mol_type = genomic DNA

SEQ ID NO: 9405 - DNA, 36 bp, Homo sapiens
  misc_feature 1..36: note = chr8:12808858-12808894
  misc_feature 1..36: note = hyper
  source 1..36: mol_type = genomic DNA
cgcgctaaagccaagcgtcgtcgtcacccaaggtac

SEQ ID NO: 9406 - DNA, 247 bp, Homo sapiens
  misc_feature 1..247: note = chr8:12989381-12989628
  misc_feature 1..247: note = hyper
  source 1..247: mol_type = genomic DNA
gccccaggggctgtgcgctgaaggacgctcgcggacgcagcaaactacacgcagcagggtgctgcagagaggaggggtgcacctccttcggagggatcaaaggctcgccccaggactctggaggtggggacagcgacatggagtgggggcaggcttccaagaagctgtcgccttgttacgaaaatagtcgggtcgggaggcgagcttccttcctctctccggcccaggaactcgctcctcggcctcc

SEQ ID NO: 9407 - DNA, 236 bp, Homo sapiens
  misc_feature 1..236: note = chr8:12991090-12991326
  misc_feature 1..236: note = hyper
  source 1..236: mol_type = genomic DNA
ggaatgtttcccccacgggcctccacgttcccagcgggaagcgccgaaaagtcgccaactattggccccgggtgcaaaggcaaaggtcacaaggcatttacttggcggaggtgtccggcctggaccctagtgtgccttgagcgtcccttctttttcttggtagctctgcgtactttttacctgtcttttatcctggcgggaaccacgtaaatttgcgggaacggaggggaagcgga

SEQ ID NO: 9408 - DNA, 134 bp, Homo sapiens
  misc_feature 1..134: note = chr8:15094433-15094567
  misc_feature 1..134: note = hyper
  source 1..134: mol_type = genomic DNA
ccccggacctgctcccgcgcctggggctagggcaggctagccgtccccggcagcgggggtacctctccagcccctgcactgcaactgcgggaggaaacactgcccgcgggcggtgggagggaaaaggggtctca

SEQ ID NO: 9409 - DNA, 93 bp, Homo sapiens
  misc_feature 1..93: note = chr8:16859361-16859454
  misc_feature 1..93: note = hyper
  source 1..93: mol_type = genomic DNA
caggtgcgccagctgcgcagcccccggcccgccgcgcgcgctccgctccgccgcgctcctgcgctcgcccagcagcggcggccgctccccggc

SEQ ID NO: 9410 - DNA, 30 bp, Homo sapiens
  misc_feature 1..30: note = chr8:16884436-16884466
  misc_feature 1..30: note = hyper
  source 1..30: mol_type = genomic DNA
gccgcgcctcagttacgctgactcggctgt

SEQ ID NO: 9411 - DNA, 30 bp, Homo sapiens
  misc_feature 1..30: note = chr8:16884959-16884989
  misc_feature 1..30: note = hyper
  source 1..30: mol_type = genomic DNA
tggaggcggcggcggcgctggggggagctg

SEQ ID NO: 9412 - DNA, 153 bp, Homo sapiens
  misc_feature 1..153: note = chr8:19797866-19798019
  misc_feature 1..153: note = hyper
  source 1..153: mol_type = genomic DNA
ggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 9413 - DNA, 149 bp, Homo sapiens
  misc_feature 1..149: note = chr8:20161245-20161394
  misc_feature 1..149: note = hyper
  source 1..149: mol_type = genomic DNA
cttacctgccccctgcgcctcgggcgcacttgagactttttttttttcccagtgtttcccggtgtgttcccgtctctctttttccagagctgctgagcgggccgggccggtcccactgcgcgggatgcagctcccggctcccactcact

SEQ ID NO: 9414 - DNA, 34 bp, Homo sapiens
  misc_feature 1..34: note = chr8:20161617-20161651
  misc_feature 1..34: note = hyper
  source 1..34: mol_type = genomic DNA
acagctggggctgctcgcgacctcgcggctcctt

SEQ ID NO: 9415 - DNA, 32 bp, Homo sapiens
  misc_feature 1..32: note = chr8:20161666-20161698
  misc_feature 1..32: note = hyper
  source 1..32: mol_type = genomic DNA
cgcggggtcccgggtcccgtctctctgctctc

SEQ ID NO: 9416 - DNA, 30 bp, Homo sapiens
  misc_feature 1..30: note = chr8:22613837-22613867
  misc_feature 1..30: note = hyper
  source 1..30: mol_type = genomic DNA
agagacccttaaccccggacagccccagct

SEQ ID NO: 9417 - DNA, 134 bp, Homo sapiens
  misc_feature 1..134: note = chr8:22960648-22960782
  misc_feature 1..134: note = hyper
  source 1..134: mol_type = genomic DNA
caagaccctaaagttcgtcgtcgtcatcgtcgcggtcctgctgccagtgagtcccggccgcggtccctggctggggaagagcgcacctggcgccgggagggggcagggagacggggacacggcagggatgcctg

SEQ ID NO: 9418 - DNA, 147 bp, Homo sapiens
  misc_feature 1..147: note = chr8:23021380-23021527
  misc_feature 1..147: note = hyper
  source 1..147: mol_type = genomic DNA
ctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttc

SEQ ID NO: 9419 - DNA, 159 bp, Homo sapiens
  misc_feature 1..159: note = chr8:23260834-23260993
  misc_feature 1..159: note = hyper
  source 1..159: mol_type = genomic DNA
gcatacctggcgtgccgagagcgcctctgctcccgcaggactcacggcgctcccgcgctcccaacagcctttcgagcaggctgggggttgaaccgggttcaagcagtggacgctacagctcccgggcgcagcccccggggtccccgcccccactccgtc

SEQ ID NO: 9420 - DNA, 160 bp, Homo sapiens
  misc_feature 1..160: note = chr8:23261393-23261553
  misc_feature 1..160: note = hyper
  source 1..160: mol_type = genomic DNA
gagaccccatagggacgctcccgctttctcgcgaaccgcttcggggagggggtggcgcgggaagcgctcttacttggtttcagggatccgcagtggccgggctgggaccgcgctctccacggtggtccccctccgcttccgccgccgctgagcccctttc

SEQ ID NO: 9421 - DNA, 50 bp, Homo sapiens; identical to SEQ ID NO: 760
  misc_feature 1..50: note = chr8:23559552-23559602
  misc_feature 1..50: note = hyper
  source 1..50: mol_type = genomic DNA

SEQ ID NO: 9422 - DNA, 972 bp, Homo sapiens; identical to SEQ ID NO: 761
  misc_feature 1..972: note = chr8:23559665-23560637
  misc_feature 1..972: note = hyper
  source 1..972: mol_type = genomic DNA

SEQ ID NO: 9423 - DNA, 230 bp, Homo sapiens; identical to SEQ ID NO: 762
  misc_feature 1..230: note = chr8:23564830-23565060
  misc_feature 1..230: note = hyper
  source 1..230: mol_type = genomic DNA

SEQ ID NO: 9424 - DNA, 15 bp, Homo sapiens
  misc_feature 1..15: note = chr8:23566840-23566855
  misc_feature 1..15: note = hyper
  source 1..15: mol_type = genomic DNA
aacttagaatatttc

SEQ ID NO: 9425 - DNA, 15 bp, Homo sapiens
  misc_feature 1..15: note = chr8:23566900-23566915
  misc_feature 1..15: note = hyper
  source 1..15: mol_type = genomic DNA
cgctgggttctcgcc

SEQ ID NO: 9426 - DNA, 54 bp, Homo sapiens; identical to SEQ ID NO: 3210
  misc_feature 1..54: note = chr8:23567116-23567170
  misc_feature 1..54: note = hyper
  source 1..54: mol_type = genomic DNA

SEQ ID NO: 9427 - DNA, 292 bp, Homo sapiens; identical to SEQ ID NO: 763
  misc_feature 1..292: note = chr8:23571681-23571973
  misc_feature 1..292: note = hyper
  source 1..292: mol_type = genomic DNA

SEQ ID NO: 9428 - DNA, 85 bp, Homo sapiens; identical to SEQ ID NO: 3212
  misc_feature 1..85: note = chr8:23572524-23572609
  misc_feature 1..85: note = hyper
  source 1..85: mol_type = genomic DNA

SEQ ID NO: 9429 - DNA, 46 bp, Homo sapiens; identical to SEQ ID NO: 3213
  misc_feature 1..46: note = chr8:23583971-23584017
  misc_feature 1..46: note = hyper
  source 1..46: mol_type = genomic DNA

SEQ ID NO: 9430 - DNA, 308 bp, Homo sapiens; identical to SEQ ID NO: 3214
  misc_feature 1..308: note = chr8:23584093-23584401
  misc_feature 1..308: note = hyper
  source 1..308: mol_type = genomic DNA

SEQ ID NO: 9431 - DNA, 193 bp, Homo sapiens; identical to SEQ ID NO: 3215
  misc_feature 1..193: note = chr8:23584581-23584774
  misc_feature 1..193: note = hyper
  source 1..193: mol_type = genomic DNA

SEQ ID NO: 9432 - DNA, 69 bp, Homo sapiens
  misc_feature 1..69: note = chr8:24770293-24770362
  misc_feature 1..69: note = hyper
  source 1..69: mol_type = genomic DNA
gggtgacaagccccccgggtggctgcacctcccactcgccgacctgggcgctgtccttggtgctgccgg

SEQ ID NO: 9433 - DNA, 117 bp, Homo sapiens
  misc_feature 1..117: note = chr8:24770413-24770530
  misc_feature 1..117: note = hyper
  source 1..117: mol_type = genomic DNA
cgtcccccaaacgttaaaaacgccatatcccactttttatacaaataactaccccggcctgttctctttgtccccttcccgaagccttcaggcagaccgttccgcaaagtctttttt

SEQ ID NO: 9434 - DNA, 213 bp, Homo sapiens; identical to SEQ ID NO: 3216
  misc_feature 1..213: note = chr8:24770912-24771125
  misc_feature 1..213: note = hyper
  source 1..213: mol_type = genomic DNA

SEQ ID NO: 9435 - DNA, 213 bp, Homo sapiens; identical to SEQ ID NO: 3217
  misc_feature 1..213: note = chr8:24771349-24771562
  misc_feature 1..213: note = hyper
  source 1..213: mol_type = genomic DNA

SEQ ID NO: 9436 - DNA, 276 bp, Homo sapiens; identical to SEQ ID NO: 3218
  misc_feature 1..276: note = chr8:24813188-24813464
  misc_feature 1..276: note = hyper
  source 1..276: mol_type = genomic DNA

SEQ ID NO: 9437 - DNA, 276 bp, Homo sapiens; identical to SEQ ID NO: 3219
  misc_feature 1..276: note = chr8:24813618-24813894
  misc_feature 1..276: note = hyper
  source 1..276: mol_type = genomic DNA

SEQ ID NO: 9438 - DNA, 418 bp, Homo sapiens; identical to SEQ ID NO: 3220
  misc_feature 1..418: note = chr8:24814010-24814428
  misc_feature 1..418: note = hyper
  source 1..418: mol_type = genomic DNA

SEQ ID NO: 9439 - DNA, 108 bp, Homo sapiens
  misc_feature 1..108: note = chr8:24815208-24815316
  misc_feature 1..108: note = hyper
  source 1..108: mol_type = genomic DNA
ctggggaggagaactcggcacccaggcttcttcaggaacggatagaaaatagccatagccgcgtgactcttcccccgatacaatgtaataacccgaaaacagatgcag

SEQ ID NO: 9440 - DNA, 414 bp, Homo sapiens
  misc_feature 1..414: note = chr8:24857626-24858040
  misc_feature 1..414: note = hyper
  source 1..414: mol_type = genomic DNA
gtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttacactcaccctccctccccgcgtggcaggagacctacactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagct

SEQ ID NO: 9441 - DNA, 57 bp, Homo sapiens
  misc_feature 1..57: note = chr8:24858336-24858393
  misc_feature 1..57: note = hyper
  source 1..57: mol_type = genomic DNA
attggcgggttagcccgggcgcagcgccctcttcccagctcccgcacccccagggct

SEQ ID NO: 9442 - DNA, 514 bp, Homo sapiens; identical to SEQ ID NO: 764
  misc_feature 1..514: note = chr8:24858647-24859161
  misc_feature 1..514: note = hyper
  source 1..514: mol_type = genomic DNA

SEQ ID NO: 9443 - DNA, 30 bp, Homo sapiens
  misc_feature 1..30: note = chr8:24859496-24859526
  misc_feature 1..30: note = hyper
  source 1..30: mol_type = genomic DNA
tccactttttcacttcgatctaattggtct

SEQ ID NO: 9444 - DNA, 276 bp, Homo sapiens; identical to SEQ ID NO: 3222
  misc_feature 1..276: note = chr8:25900417-25900693
  misc_feature 1..276: note = hyper
  source 1..276: mol_type = genomic DNA

SEQ ID NO: 9445 - DNA, 237 bp, Homo sapiens; identical to SEQ ID NO: 3223
  misc_feature 1..237: note = chr8:25900780-25901017
  misc_feature 1..237: note = hyper
  source 1..237: mol_type = genomic DNA

SEQ ID NO: 9446 - DNA, 178 bp, Homo sapiens; identical to SEQ ID NO: 3224
  misc_feature 1..178: note = chr8:25901018-25901196
  misc_feature 1..178: note = hyper
  source 1..178: mol_type = genomic DNA

SEQ ID NO: 9447 - DNA, 307 bp, Homo sapiens
  misc_feature 1..307: note = chr8:25901540-25901847
  misc_feature 1..307: note = hyper
  source 1..307: mol_type = genomic DNA
gcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtgg

SEQ ID NO: 9448 - DNA, 63 bp, Homo sapiens
  misc_feature 1..63: note = chr8:25902113-25902176
  misc_feature 1..63: note = hyper
  source 1..63: mol_type = genomic DNA
cgcgcagggcctgggcgacagatggggggacagggagagagaaaggcacggggtgcgcggggg

SEQ ID NO: 9449 - DNA, 66 bp, Homo sapiens
  misc_feature 1..66: note = chr8:25903788-25903854
  misc_feature 1..66: note = hyper
  source 1..66: mol_type = genomic DNA
tggcagcagcctcaccgaacagctgaaaccctagacggttttttaactgcgcggggctgctcgcgg

SEQ ID NO: 9450 - DNA, 191 bp, Homo sapiens
  misc_feature 1..191: note = chr8:25904157-25904348
  misc_feature 1..191: note = hyper
  source 1..191: mol_type = genomic DNA
ttaggtgtaggtgagcgctcgcaaatgaactgctagagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcggg

SEQ ID NO: 9451 - DNA, 318 bp, Homo sapiens
  misc_feature 1..318: note = chr8:25905311-25905629
  misc_feature 1..318: note = hyper
  source 1..318: mol_type = genomic DNA
ggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcgg

SEQ ID NO: 9452 - DNA, 105 bp, Homo sapiens
  misc_feature 1..105: note = chr8:25905695-25905800
  misc_feature 1..105: note = hyper
  source 1..105: mol_type = genomic DNA
cgatctcgtgcaacacaaaacctgccccgagctgtgcgggggcctggcaagcgcagctgcggccccgggaagcccaatcccgcgggactgcggagcccacgcgct

SEQ ID NO: 9453 - DNA, 38 bp, Homo sapiens
  misc_feature 1..38: note = chr8:25907271-25907309
  misc_feature 1..38: note = hyper
  source 1..38: mol_type = genomic DNA
tgtcatcactatttacggtgcagcgatcagggcaagtt

SEQ ID NO: 9454 - DNA, 62 bp, Homo sapiens
  misc_feature 1..62: note = chr8:25909197-25909259
  misc_feature 1..62: note = hyper
  source 1..62: mol_type = genomic DNA
gcacagggactggatcgctcagtgggtgataagctttttgtttgttccgcatggaattgcat

SEQ ID NO: 9455 - DNA, 45 bp, Homo sapiens
  misc_feature 1..45: note = chr8:26372863-26372908
  misc_feature 1..45: note = hyper
  source 1..45: mol_type = genomic DNA
aataagtgtctcagccggggcttcacagagcgctccccaaaccgc

SEQ ID NO: 9456 - DNA, 44 bp, Homo sapiens
  misc_feature 1..44: note = chr8:26723005-26723049
  misc_feature 1..44: note = hyper
  source 1..44: mol_type = genomic DNA
gcgctacaggttgggcgctgctcctggcccgcagttacctacat

SEQ ID NO: 9457 - DNA, 406 bp, Homo sapiens
  misc_feature 1..406: note = chr8:26723674-26724080
  misc_feature 1..406: note = hyper
  source 1..406: mol_type = genomic DNA
gcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcgggcaggggccgccttcgattttctgggctgggggccaccatctgcgtaagaaacctgggtttccacaactgcgaacctaccgcagggactcggca

SEQ ID NO: 9458 - DNA, 50 bp, Homo sapiens
  misc_feature 1..50: note = chr8:26724529-26724579
  misc_feature 1..50: note = hyper
  source 1..50: mol_type = genomic DNA
gctcttctctggaggcggagaggggaccgtgtctccgaggcaccaaatcc

SEQ ID NO: 9459 - DNA, 340 bp, Homo sapiens
  misc_feature 1..340: note = chr8:30769317-30769657
  misc_feature 1..340: note = hyper
  source 1..340: mol_type = genomic DNA
aaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcaccta

SEQ ID NO: 9460 - DNA, 34 bp, Homo sapiens
  misc_feature 1..34: note = chr8:31496785-31496819
  misc_feature 1..34: note = hyper
  source 1..34: mol_type = genomic DNA
ctgcagcctgtttgccgcccgtcctcccattgca

SEQ ID NO: 9461 - DNA, 56 bp, Homo sapiens
  misc_feature 1..56: note = chr8:31497468-31497524
  misc_feature 1..56: note = hyper
  source 1..56: mol_type = genomic DNA
cgacagccagaagcccgcacgcacctcgcaccatgagatggcgacgcgccccgcgc

SEQ ID NO: 9462 - DNA, 211 bp, Homo sapiens
  misc_feature 1..211: note = chr8:31497750-31497961
  misc_feature 1..211: note = hyper
  source 1..211: mol_type = genomic DNA
agggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 9463 - DNA, 135 bp, Homo sapiens
  misc_feature 1..135: note = chr8:32404798-32404933
  misc_feature 1..135: note = hyper
  source 1..135: mol_type = genomic DNA
aaggagtaggtttcacgcgcagttctgagtaaagtttgaatctgagaaaccccacattcacgaattaaggatctccagttctgtgtctttattctacccctccctgcctgcttttccactcggcagaactgagtg

SEQ ID NO: 9464 - DNA, 37 bp, Homo sapiens
  misc_feature 1..37: note = chr8:32405476-32405513
  misc_feature 1..37: note = hyper
  source 1..37: mol_type = genomic DNA
ggctgcggaggggagcgggcagcgagagcctcgggtc

SEQ ID NO: 9465 - DNA, 396 bp, Homo sapiens
  misc_feature 1..396: note = chr8:32406532-32406928
  misc_feature 1..396: note = hyper
  source 1..396: mol_type = genomic DNA
cctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctac

SEQ ID NO: 9466 - DNA, 53 bp, Homo sapiens
  misc_feature 1..53: note = chr8:32406929-32406982
  misc_feature 1..53: note = hyper
  source 1..53: mol_type = genomic DNA
gagactcaagagcagcggcagggattcctaaaggtcagcgaagcagatgaaat

SEQ ID NO: 9467 - DNA, 176 bp, Homo sapiens
  misc_feature 1..176: note = chr8:33371806-33371982
  misc_feature 1..176: note = hyper
  source 1..176: mol_type = genomic DNA
gcctgtagccacaagcgtttgaaaattcaaattctagcgtcaaggtagaagcccccagctggcgtctggggcagccctgagggaggtgggtcgtcgggttggcggatccggcttgggcccgccccgccagtgtcggcgccgggtgcgcagggacagcagagcgctgtcttgggcat

SEQ ID NO: 9468 - DNA, 237 bp, Homo sapiens
  misc_feature 1..237: note = chr8:33457142-33457379
  misc_feature 1..237: note = hyper
  source 1..237: mol_type = genomic DNA
agccagctgaaaaggcgaaggcccgccgcagcccctctacctctttgcaagcgctgcgctgggcctcagtccgaaaggcggatcgccggcgcagacagcgccacggccatgacgctcctgctgctgtcgccgccgctgtttctgcccaagacaggttgacagattagcagctatttttaagccatgacacacacgtcgaagcagggttcaaatcagcgtgtgcgctggtgacataaa

SEQ ID NO: 9469 - DNA, 43 bp, Homo sapiens
  misc_feature 1..43: note = chr8:35093236-35093279
  misc_feature 1..43: note = hyper
  source 1..43: mol_type = genomic DNA
tcgccgaccctttcccgggctcccggagcgtgaagaagagccg

SEQ ID NO: 9470 - DNA, 23 bp, Homo sapiens
  misc_feature 1..23: note = chr8:35093951-35093974
  misc_feature 1..23: note = hyper
  source 1..23: mol_type = genomic DNA
gccagccctggagctcgggagag

SEQ ID NO: 9471 - DNA, 193 bp, Homo sapiens; identical to SEQ ID NO: 765
  misc_feature 1..193: note = chr8:37655798-37655991
  misc_feature 1..193: note = hyper
  source 1..193: mol_type = genomic DNA

SEQ ID NO: 9472 - DNA, 148 bp, Homo sapiens; identical to SEQ ID NO: 766
  misc_feature 1..148: note = chr8:37656049-37656197
  misc_feature 1..148: note = hyper
  source 1..148: mol_type = genomic DNA

SEQ ID NO: 9473 - DNA, 415 bp, Homo sapiens; identical to SEQ ID NO: 767
  misc_feature 1..415: note = chr8:37822994-37823409
  misc_feature 1..415: note = hyper
  source 1..415: mol_type = genomic DNA

SEQ ID NO: 9474 - DNA, 13 bp, Homo sapiens
  misc_feature 1..13: note = chr8:37823410-37823423
  misc_feature 1..13: note = hyper
  source 1..13: mol_type = genomic DNA
ggttggagtggca

SEQ ID NO: 9475 - DNA, 389 bp, Homo sapiens; identical to SEQ ID NO: 769
  misc_feature 1..389: note = chr8:38008209-38008598
  misc_feature 1..389: note = hyper
  source 1..389: mol_type = genomic DNA

SEQ ID NO: 9476 - DNA, 158 bp, Homo sapiens
  misc_feature 1..158: note = chr8:38323407-38323565
  misc_feature 1..158: note = hyper
  source 1..158: mol_type = genomic DNA
tcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggacc

SEQ ID NO: 9477 - DNA, 355 bp, Homo sapiens
  misc_feature 1..355: note = chr8:38323800-38324155
  misc_feature 1..355: note = hyper
  source 1..355: mol_type = genomic DNA
cagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtct

SEQ ID NO: 9478 - DNA, 26 bp, Homo sapiens
  misc_feature 1..26: note = chr8:41165893-41165919
  misc_feature 1..26: note = hyper
  source 1..26: mol_type = genomic DNA
cagagctgccgctcccgggccagccc

SEQ ID NO: 9479 - DNA, 152 bp, Homo sapiens; identical to SEQ ID NO: 3231
  misc_feature 1..152: note = chr8:41166000-41166152
  misc_feature 1..152: note = hyper
  source 1..152: mol_type = genomic DNA

SEQ ID NO: 9480 - DNA, 414 bp, Homo sapiens; identical to SEQ ID NO: 3232
  misc_feature 1..414: note = chr8:41166266-41166680
  misc_feature 1..414: note = hyper
  source 1..414: mol_type = genomic DNA

SEQ ID NO: 9481 - DNA, 244 bp, Homo sapiens; identical to SEQ ID NO: 3233
  misc_feature 1..244: note = chr8:41166745-41166989
  misc_feature 1..244: note = hyper
  source 1..244: mol_type = genomic DNA

SEQ ID NO: 9482 - DNA, 98 bp, Homo sapiens; identical to SEQ ID NO: 3234
  misc_feature 1..98: note = chr8:41167025-41167123
  misc_feature 1..98: note = hyper
  source 1..98: mol_type = genomic DNA

SEQ ID NO: 9483 - DNA, 82 bp, Homo sapiens
  misc_feature 1..82: note = chr8:41424760-41424842
  misc_feature 1..82: note = hyper
  source 1..82: mol_type = genomic DNA
ccacctgacccccagcgacccaagaagcaagttgtgtttgcagacgcaaaggggctgtcgttggtatcggtgcactggtttg

SEQ ID NO: 9484 - DNA, 378 bp, Homo sapiens
  misc_feature 1..378: note = chr8:41503901-41504279
  misc_feature 1..378: note = hyper
  source 1..378: mol_type = genomic DNA
ggaaggtaggctcctcggcgtccccccgcaggctgcagccaggatcccgggcctggacggcgggcgtcagacgctgtgcgctcccaggctgagcaccgagaaggcggcgcggtgcttgcgcagcagcaggcggatcttctcgtcgtccgagtcggggtccagcggcttgttgtactcgtcgtcctcgttctccgagggtgcgcggtccccgcctgcgcctgcacccgcgccgcccggggcccggggcgtggaggacgagggctccagggcgctcttcttccgccacttggtcctgcggttctggaaccacacctgcgatgagaaagaatgtgaagggcacaggggcacagcgcgcacgggacgcgagaacagccatcc

SEQ ID NO: 9485 - DNA, 11 bp, Homo sapiens
  misc_feature 1..11: note = chr8:41624550-41624561
  misc_feature 1..11: note = hyper
  source 1..11: mol_type = genomic DNA
ctccacgctcc

SEQ ID NO: 9486 - DNA, 103 bp, Homo sapiens
  misc_feature 1..103: note = chr8:41624633-41624736
  misc_feature 1..103: note = hyper
  source 1..103: mol_type = genomic DNA
cgcagccttcaggccagaggaattttcctctggatcctgctagaagcctcggcagcagaagggcagccccagcgcgcgcacccgcacccgccggggaaagttg

SEQ ID NO: 9487 - DNA, 54 bp, Homo sapiens
  misc_feature 1..54: note = chr8:41625007-41625061
  misc_feature 1..54: note = hyper
  source 1..54: mol_type = genomic DNA
caggcgccctccactcgccccggcccggccctggccctgcgctctcccgcccgc

SEQ ID NO: 9488 - DNA, 144 bp, Homo sapiens
  misc_feature 1..144: note = chr8:41686308-41686452
  misc_feature 1..144: note = hyper
  source 1..144: mol_type = genomic DNA
cctgaagattttccacgcgaaagtgctggggagagagttgggcctgggaggctgcgccttcttcccgcgaatcccgaaaactgcgcggcaaaggcgggttccgcagaagtcgcgcgtgacccggggcgccgccctcctcggggc

SEQ ID NO: 9489 - DNA, 205 bp, Homo sapiens
  misc_feature 1..205: note = chr8:41733449-41733654
  misc_feature 1..205: note = hyper
  source 1..205: mol_type = genomic DNA
ccagaggggccggcgcgcgcccgggcgcacactcgcacacctgcccgcgcgcacacacccgcgcctggccccgcgcgcgcacgtcccgcgacctcgcaggttcgcggcccgcaaccggcagggcaggagcttccaccaatcccctcgcctcacgcctcctgcccaaatatagaaaccgacttccttgtcctagagctcggagcgg

SEQ ID NO: 9490 - DNA, 92 bp, Homo sapiens
  misc_feature 1..92: note = chr8:41733684-41733776
  misc_feature 1..92: note = hyper
  source 1..92: mol_type = genomic DNA
cggcgctccccaggcgggcgcggggacggccctgtctggcctcaccagcacgtggggcgctgcctgcgctccagccgcggcaccctggcacc

SEQ ID NO: 9491 - DNA, 428 bp, Homo sapiens; identical to SEQ ID NO: 3235
  misc_feature 1..428: note = chr8:41753325-41753753
  misc_feature 1..428: note = hyper
  source 1..428: mol_type = genomic DNA

SEQ ID NO: 9492 - DNA, 411 bp, Homo sapiens; identical to SEQ ID NO: 3236
  misc_feature 1..411: note = chr8:41753770-41754181
  misc_feature 1..411: note = hyper
  source 1..411: mol_type = genomic DNA

SEQ ID NO: 9493 - DNA, 1026 bp, Homo sapiens; identical to SEQ ID NO: 3237
  misc_feature 1..1026: note = chr8:41754182-41755208
  misc_feature 1..1026: note = hyper
  source 1..1026: mol_type = genomic DNA

SEQ ID NO: 9494 - DNA, 40 bp, Homo sapiens
  misc_feature 1..40: note = chr8:42009967-42010007
  misc_feature 1..40: note = hyper
  source 1..40: mol_type = genomic DNA
attgtggagggtgggcgccctgccgcggcccagtggggct

SEQ ID NO: 9495 - DNA, 36 bp, Homo sapiens
  misc_feature 1..36: note = chr8:43102519-43102555
  misc_feature 1..36: note = hyper
  source 1..36: mol_type = genomic DNA
aagccgggacttgtacgcccgcgacaggaaagacag

SEQ ID NO: 9496 - DNA, 194 bp, Homo sapiens
  misc_feature 1..194: note = chr8:48100201-48100395
  misc_feature 1..194: note = hyper
  source 1..194: mol_type = genomic DNA
cacagtccctgggtccgggagccagagcagcgccactcggagacgggatggttccgtgggttgtgtaggagcacaggaaagcggaggccgggccacacagcaccgcgaacccagcagcccaagcccagcggaccaagcagccacccccgggagccgccactgcctggagcagtcaccggcgggagcctccattt

SEQ ID NO: 9497 - DNA, 140 bp, Homo sapiens; identical to SEQ ID NO: 3238
  misc_feature 1..140: note = chr8:49293385-49293525
  misc_feature 1..140: note = hyper
  source 1..140: mol_type = genomic DNA

SEQ ID NO: 9498 - DNA, 37 bp, Homo sapiens; identical to SEQ ID NO: 3239
  misc_feature 1..37: note = chr8:49293580-49293617
  misc_feature 1..37: note = hyper
  source 1..37: mol_type = genomic DNA

SEQ ID NO: 9499 - DNA, 160 bp, Homo sapiens; identical to SEQ ID NO: 770
  misc_feature 1..160: note = chr8:49468668-49468828
  misc_feature 1..160: note = hyper
  source 1..160: mol_type = genomic DNA

SEQ ID NO: 9500 - DNA, 362 bp, Homo sapiens; identical to SEQ ID NO: 771
  misc_feature 1..362: note = chr8:49468829-49469191
  misc_feature 1..362: note = hyper
  source 1..362: mol_type = genomic DNA

SEQ ID NO: 9501 - DNA, 34 bp, Homo sapiens
  misc_feature 1..34: note = chr8:49647817-49647851
  misc_feature 1..34: note = hyper
  source 1..34: mol_type = genomic DNA
ctcagttactgatctcgtgcgcggccctaacaga

SEQ ID NO: 9502 - DNA, 189 bp, Homo sapiens
  misc_feature 1..189: note = chr8:49782697-49782886
  misc_feature 1..189: note = hyper
  source 1..189: mol_type = genomic DNA
taaacacccccttggcgtccgcctgggggtccccatgaaagtccccgcacgccctccccggccccgccctcctcagagcgtgggccccgcgcgccgccaccgcccggccgggaggcgcggggctccctagaaggctcgggcatgtcggagggagccgcggtgcagagacttgccacgcggctgcccggg

SEQ ID NO: 9503 - DNA, 30 bp, Homo sapiens
  misc_feature 1..30: note = chr8:49834319-49834349
  misc_feature 1..30: note = hyper
  source 1..30: mol_type = genomic DNA
cggggacacagtgtccgccaggagaaggaa

SEQ ID NO: 9504 - DNA, 30 bp, Homo sapiens
  misc_feature 1..30: note = chr8:49834685-49834715
  misc_feature 1..30: note = hyper
  source 1..30: mol_type = genomic DNA
taaaggcaggctgatcggaagaactggaag

SEQ ID NO: 9505 - DNA, 154 bp, Homo sapiens
  misc_feature 1..154: note = chr8:50822179-50822333
  misc_feature 1..154: note = hyper
  source 1..154: mol_type = genomic DNA
tggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgc

SEQ ID NO: 9506 - DNA, 30 bp, Homo sapiens
  misc_feature 1..30: note = chr8:50822561-50822591
  misc_feature 1..30: note = hyper
  source 1..30: mol_type = genomic DNA
tgccgcctcctcgcccgtcccccgcgcgcg

SEQ ID NO: 9507 - DNA, 36 bp, Homo sapiens
  misc_feature 1..36: note = chr8:50823108-50823144
  misc_feature 1..36: note = hyper
  source 1..36: mol_type = genomic DNA
actggcgtctgcacccgttgccgagtgtgggtggct

SEQ ID NO: 9508 - DNA, 35 bp, Homo sapiens
  misc_feature 1..35: note = chr8:50823452-50823487
  misc_feature 1..35: note = hyper
  source 1..35: mol_type = genomic DNA
agcctaggctgtgggcgactcgctagcactgccct

SEQ ID NO: 9509 - DNA, 15 bp, Homo sapiens
  misc_feature 1..15: note = chr8:50824293-50824308
  misc_feature 1..15: note = hyper
  source 1..15: mol_type = genomic DNA
ctgcagccacaggga

SEQ ID NO: 9510 - DNA, 20 bp, Homo sapiens
  misc_feature 1..20: note = chr8:50824352-50824372
  misc_feature 1..20: note = hyper
  source 1..20: mol_type = genomic DNA
cgccacgggcagctgggcta

SEQ ID NO: 9511 - DNA, 49 bp, Homo sapiens
  misc_feature 1..49: note = chr8:53477121-53477170
  misc_feature 1..49: note = hyper
  source 1..49: mol_type = genomic DNA
gccagtaacataagccgccgcctgctgaaactggcgcttcctcagccac

SEQ ID NO: 9512 - DNA, 288 bp, Homo sapiens; identical to SEQ ID NO: 3242
  misc_feature 1..288: note = chr8:53477449-53477737
  misc_feature 1..288: note = hyper
  source 1..288: mol_type = genomic DNA

SEQ ID NO: 9513 - DNA, 150 bp, Homo sapiens; identical to SEQ ID NO: 3243
  misc_feature 1..150: note = chr8:53478480-53478630
  misc_feature 1..150: note = hyper
  source 1..150: mol_type = genomic DNA

SEQ ID NO: 9514 - DNA, 30 bp, Homo sapiens
  misc_feature 1..30: note = chr8:53853779-53853809
  misc_feature 1..30: note = hyper
  source 1..30: mol_type = genomic DNA
ccctgctgccccacccgagccctggcagtc

SEQ ID NO: 9515 - DNA, 123 bp, Homo sapiens; identical to SEQ ID NO: 3244
  misc_feature 1..123: note = chr8:53854249-53854372
  misc_feature 1..123: note = hyper
  source 1..123: mol_type = genomic DNA

SEQ ID NO: 9516 - DNA, 154 bp, Homo sapiens
  misc_feature 1..154: note = chr8:54163673-54163827
  misc_feature 1..154: note = hyper
  source 1..154: mol_type = genomic DNA
cggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagag

SEQ ID NO: 9517 - skipped

SEQ ID NO: 9518 - DNA, 53 bp, Homo sapiens
  misc_feature 1..53: note = chr8:54789257-54789310
  misc_feature 1..53: note = hyper
  source 1..53: mol_type = genomic DNA
cctaactggagaagccgctgggtcccgcgccaggctcgcggtggcttcagagt

SEQ ID NO: 9519 - DNA, 193 bp, Homo sapiens; identical to SEQ ID NO: 772
  misc_feature 1..193: note = chr8:54789613-54789806
  misc_feature 1..193: note = hyper
  source 1..193: mol_type = genomic DNA

SEQ ID NO: 9520 - DNA, 588 bp, Homo sapiens; identical to SEQ ID NO: 773
  misc_feature 1..588: note = chr8:54790022-54790610
  misc_feature 1..588: note = hyper
  source 1..588: mol_type = genomic DNA

SEQ ID NO: 9521 - DNA, 49 bp, Homo sapiens; identical to SEQ ID NO: 774
  misc_feature 1..49: note = chr8:54791897-54791946
  misc_feature 1..49: note = hyper
  source 1..49: mol_type = genomic DNA

SEQ ID NO: 9522 - DNA, 487 bp, Homo sapiens; identical to SEQ ID NO: 775
  misc_feature 1..487: note = chr8:54792184-54792671
  misc_feature 1..487: note = hyper
  source 1..487: mol_type = genomic DNA

SEQ ID NO: 9523 - DNA, 427 bp, Homo sapiens; identical to SEQ ID NO: 776
  misc_feature 1..427: note = chr8:54792701-54793128
  misc_feature 1..427: note = hyper
  source 1..427: mol_type = genomic DNA

SEQ ID NO: 9524 - DNA, 161 bp, Homo sapiens
  misc_feature 1..161: note = chr8:54793349-54793510
  misc_feature 1..161: note = hyper
  source 1..161: mol_type = genomic DNA
ggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtga

SEQ ID NO: 9525 - DNA, 126 bp, Homo sapiens
  misc_feature 1..126: note = chr8:54793756-54793882
  misc_feature 1..126: note = hyper
  source 1..126: mol_type = genomic DNA
gtgtcgccgttgctgcggggcgggagccggtgcgagtcgggggttccttcccgcagtgcgagtttgggggagtggggctgcgagtgcgtccgcgtgcgaagaggggcatcgcgccaccaggatcaa

SEQ ID NO: 9526 - DNA, 217 bp, Homo sapiens
  misc_feature 1..217: note = chr8:54794167-54794384
  misc_feature 1..217: note = hyper
  source 1..217: mol_type = genomic DNA
ccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatctt

SEQ ID NO: 9527 - DNA, 134 bp, Homo sapiens
  misc_feature 1..134: note = chr8:54794647-54794781
  misc_feature 1..134: note = hyper
  source 1..134: mol_type = genomic DNA
tccccacacccagctcgggcggaggagccctgagagaagcggctagctgagagtggggtgggcgttttggggaaaggtttgcgtgcgctgcggccctaccgctgctagagaagtggaagagagagagtgggcgc

SEQ ID NO: 9528 - DNA, 124 bp, Homo sapiens
  misc_feature 1..124: note = chr8:54794826-54794950
  misc_feature 1..124: note = hyper
  source 1..124: mol_type = genomic DNA
cgcttgtgggggagtgagtggggaaggggctttgggagaggcggcgcgcgggcactgaggtgcatcgtgagcttcccggacttgacagcatcaaaggaaaatcctggcgagcagccagggccag

SEQ ID NO: 9529 - DNA, 23 bp, Homo sapiens
  misc_feature 1..23: note = chr8:54795139-54795162
  misc_feature 1..23: note = hyper
  source 1..23: mol_type = genomic DNA
cgtaacttggcaaaagctcgcgc

SEQ ID NO: 9530 - DNA, 203 bp, Homo sapiens; identical to SEQ ID NO: 3250
  misc_feature 1..203: note = chr8:55366165-55366368
  misc_feature 1..203: note = hyper
  source 1..203: mol_type = genomic DNA

SEQ ID NO: 9531 - DNA, 562 bp, Homo sapiens; identical to SEQ ID NO: 3251
  misc_feature 1..562: note = chr8:55367063-55367625
  misc_feature 1..562: note = hyper
  source 1..562: mol_type = genomic DNA

SEQ ID NO: 9532 - DNA, 223 bp, Homo sapiens; identical to SEQ ID NO: 777
  misc_feature 1..223: note = chr8:55370113-55370336
  misc_feature 1..223: note = hyper
  source 1..223: mol_type = genomic DNA

SEQ ID NO: 9533 - DNA, 86 bp, Homo sapiens; identical to SEQ ID NO: 778
  misc_feature 1..86: note = chr8:55370337-55370423
  misc_feature 1..86: note = hyper
  source 1..86: mol_type = genomic DNA

SEQ ID NO: 9534 - skipped

SEQ ID NO: 9535 - DNA, 109 bp, Homo sapiens; identical to SEQ ID NO: 780
  misc_feature 1..109: note = chr8:55370567-55370676
  misc_feature 1..109: note = hyper
  source 1..109: mol_type = genomic DNA

SEQ ID NO: 9536 - DNA, 204 bp, Homo sapiens; identical to SEQ ID NO: 781
  misc_feature 1..204: note = chr8:55371172-55371376
  misc_feature 1..204: note = hyper
  source 1..204: mol_type = genomic DNA

SEQ ID NO: 9537 - DNA, 286 bp, Homo sapiens; identical to SEQ ID NO: 782
  misc_feature 1..286: note = chr8:55371439-55371725
  misc_feature 1..286: note = hyper
  source 1..286: mol_type = genomic DNA

SEQ ID NO: 9538 - DNA, 75 bp, Homo sapiens; identical to SEQ ID NO: 783
  misc_feature 1..75: note = chr8:55371993-55372068
  misc_feature 1..75: note = hyper
  source 1..75: mol_type = genomic DNA

SEQ ID NO: 9539 - DNA, 60 bp, Homo sapiens; identical to SEQ ID NO: 784
  misc_feature 1..60: note = chr8:55372416-55372476
  misc_feature 1..60: note = hyper
  source 1..60: mol_type = genomic DNA

SEQ ID NO: 9540 - DNA, 29 bp, Homo sapiens
  misc_feature 1..29: note = chr8:55379202-55379231
  misc_feature 1..29: note = hyper
  source 1..29: mol_type = genomic DNA
ctcttagcttggtgccggggcccgcccgg

SEQ ID NO: 9541 - DNA, 162 bp, Homo sapiens; identical to SEQ ID NO: 3261
  misc_feature 1..162: note = chr8:55379295-55379457
  misc_feature 1..162: note = hyper
  source 1..162: mol_type = genomic DNA

SEQ ID NO: 9542 - DNA, 108 bp, Homo sapiens; identical to SEQ ID NO: 3262
  misc_feature 1..108: note = chr8:55380036-55380144
  misc_feature 1..108: note = hyper
  source 1..108: mol_type = genomic DNA

SEQ ID NO: 9543 - DNA, 14 bp, Homo sapiens
  misc_feature 1..14: note = chr8:55383182-55383196
  misc_feature 1..14: note = hyper
  source 1..14: mol_type = genomic DNA
ggtgccgacttcaa

SEQ ID NO: 9544 - DNA, 206 bp, Homo sapiens
  misc_feature 1..206: note = chr8:56013657-56013863
  misc_feature 1..206: note = hyper
  source 1..206: mol_type = genomic DNA
gcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagg

SEQ ID NO: 9545 - DNA, 54 bp, Homo sapiens; identical to SEQ ID NO: 3263
  misc_feature 1..54: note = chr8:56014131-56014185
  misc_feature 1..54: note = hyper
  source 1..54: mol_type = genomic DNA

SEQ ID NO: 9546 - DNA, 368 bp, Homo sapiens; identical to SEQ ID NO: 3264
  misc_feature 1..368: note = chr8:56014376-56014744
  misc_feature 1..368: note = hyper
  source 1..368: mol_type = genomic DNA

SEQ ID NO: 9547 - DNA, 19 bp, Homo sapiens
  misc_feature 1..19: note = chr8:56015034-56015053
  misc_feature 1..19: note = hyper
  source 1..19: mol_type = genomic DNA
ggtgtggaggcatcatggc

SEQ ID NO: 9548 - DNA, 161 bp, Homo sapiens; identical to SEQ ID NO: 786
  misc_feature 1..161: note = chr8:56015185-56015346
  misc_feature 1..161: note = hyper
  source 1..161: mol_type = genomic DNA

SEQ ID NO: 9549 - DNA, 67 bp, Homo sapiens; identical to SEQ ID NO: 787
  misc_feature 1..67: note = chr8:56015565-56015632
  misc_feature 1..67: note = hyper
  source 1..67: mol_type = genomic DNA

SEQ ID NO: 9550 - DNA, 181 bp, Homo sapiens; identical to SEQ ID NO: 3268
  misc_feature 1..181: note = chr8:57026141-57026322
  misc_feature 1..181: note = hyper
  source 1..181: mol_type = genomic DNA

SEQ ID NO: 9551 - DNA, 55 bp, Homo sapiens; identical to SEQ ID NO: 3269
  misc_feature 1..55: note = chr8:57026501-57026556
  misc_feature 1..55: note = hyper
  source 1..55: mol_type = genomic DNA

SEQ ID NO: 9552 - DNA, 148 bp, Homo sapiens; identical to SEQ ID NO: 788
  misc_feature 1..148: note = chr8:57069590-57069738
  misc_feature 1..148: note = hyper
  source 1..148: mol_type = genomic DNA

SEQ ID NO: 9553 - DNA, 163 bp, Homo sapiens; identical to SEQ ID NO: 789
  misc_feature 1..163: note = chr8:57069850-57070013
  misc_feature 1..163: note = hyper
  source 1..163: mol_type = genomic DNA

SEQ ID NO: 9554 - DNA, 143 bp, Homo sapiens; identical to SEQ ID NO: 790
  misc_feature 1..143: note = chr8:57070014-57070157
  misc_feature 1..143: note = hyper
  source 1..143: mol_type = genomic DNA

SEQ ID NO: 9555 - DNA, 180 bp, Homo sapiens
  misc_feature 1..180: note = chr8:57232591-57232771
  misc_feature 1..180: note = hyper
  source 1..180: mol_type = genomic DNA
caggaccgacgacctcggcaacttacccaggacactctccctagctgtccgcggagaagccggcctcgtctgccccaggcacccgagtccctggctcggagctcagtcaggttcaggtgtttatccaggcgccgcccaagtccaagggcgggactgccgcggcagcgccaggggtggggc

SEQ ID NO: 9556 - DNA, 286 bp, Homo sapiens; identical to SEQ ID NO: 791
  misc_feature 1..286: note = chr8:57358806-57359092
  misc_feature 1..286: note = hyper
  source 1..286: mol_type = genomic DNA

SEQ ID NO: 9557 - DNA, 400 bp, Homo sapiens; identical to SEQ ID NO: 792
  misc_feature 1..400: note = chr8:57359259-57359659
  misc_feature 1..400: note = hyper
  source 1..400: mol_type = genomic DNA

SEQ ID NO: 9558 - DNA, 86 bp, Homo sapiens; identical to SEQ ID NO: 793
  misc_feature 1..86: note = chr8:57360540-57360626
  misc_feature 1..86: note = hyper
  source 1..86: mol_type = genomic DNA

SEQ ID NO: 9559 - DNA, 37 bp, Homo sapiens; identical to SEQ ID NO: 794
  misc_feature 1..37: note = chr8:57360769-57360806
  misc_feature 1..37: note = hyper
  source 1..37: mol_type = genomic DNA

SEQ ID NO: 9560 - DNA, 29 bp, Homo sapiens
  misc_feature 1..29: note = chr8:58907390-58907419
  misc_feature 1..29: note = hyper
  source 1..29: mol_type = genomic DNA
agagagactgctgggcgggggttgggatt

SEQ ID NO: 9561 - DNA, 338 bp, Homo sapiens
  misc_feature 1..338: note = chr8:58907483-58907821
  misc_feature 1..338: note = hyper
  source 1..338: mol_type = genomic DNA
cgcggagctaagccggctctgcgcctgcagcttccccgcccggcccgggtctccgttgagcccggcctcactggcccaggcggaccccgtccggctttctgggctgccgggggaggcgcagcgccgctgcctgccccgcgccccctctgcgctcggcttggctgcacgtcccgggctcggctaggaggctgggcacggggccggggctggagccggggttggagccagggcggggggaagctggccgcgctgcggagcggaggtgggctccgaaagcgcgccgccggttgctgctggaggagtgggactacgaaggatggggactccgctcggccacc

SEQ ID NO: 9562 - DNA, 119 bp, Homo sapiens
  misc_feature 1..119: note = chr8:58907822-58907941
  misc_feature 1..119: note = hyper
  source 1..119: mol_type = genomic DNA
ctcctgaatggtctctaatctcggtgttaaatactttatgagagtatcaataccacctaatcctttgctgagaattactgctagaaatgtagattctgaggttccgaaagtttgttttt

SEQ ID NO: 9563 - DNA, 37 bp, Homo sapiens
  misc_feature 1..37: note = chr8:60030268-60030305
  misc_feature 1..37: note = hyper
  source 1..37: mol_type = genomic DNA
tcccgtggaatgcaccgagggtcgccatggatgtgcc

SEQ ID NO: 9564 - DNA, 71 bp, Homo sapiens
  misc_feature 1..71: note = chr8:60030539-60030610
  misc_feature 1..71: note = hyper
  source 1..71: mol_type = genomic DNA
agtaaccccctccctcgtaccccctgactgtcctataggtggacccagccgaactccgcagcagcccaggc

SEQ ID NO: 9565 - DNA, 65 bp, Homo sapiens
  misc_feature 1..65: note = chr8:60030824-60030889
  misc_feature 1..65: note = hyper
  source 1..65: mol_type = genomic DNA
ttgacccagctaccccgctgtgctctggcccgcggacctgtgtccgaacccgggctcggctgccg

SEQ ID NO: 9566 - DNA, 61 bp, Homo sapiens
  misc_feature 1..61: note = chr8:60031205-60031266
  misc_feature 1..61: note = hyper
  source 1..61: mol_type = genomic DNA
aggaaggaaagaatccgagcaaatcgtgtcactttccgcacaatcgcggtgtttggcaagc

SEQ ID NO: 9567 - DNA, 75 bp, Homo sapiens
  misc_feature 1..75: note = chr8:60031479-60031554
  misc_feature 1..75: note = hyper
  source 1..75: mol_type = genomic DNA
gtcccagacagggagcgtcgggcgcagcggcgggctgggctggaggtggataaaatcttacgtccatttcactct

SEQ ID NO: 9568 - DNA, 89 bp, Homo sapiens
  misc_feature 1..89: note = chr8:60032140-60032229
  misc_feature 1..89: note = hyper
  source 1..89: mol_type = genomic DNA
ccagaggccggggaccggagaaaggaggagcggagaaggagaaggaggagagcacggcctggctgggacagaagcggtgggaccctggg

SEQ ID NO: 9569 - DNA, 231 bp, Homo sapiens
  misc_feature 1..231: note = chr8:60032490-60032721
  misc_feature 1..231: note = hyper
  source 1..231: mol_type = genomic DNA
tcccctccctactcccggcccgtagtggaggtgactttcctgcgcagcgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctctttggcttccctctgccgcctgcagcccgcacccctccgaga

SEQ ID NO: 9570 - DNA, 391 bp, Homo sapiens
  misc_feature 1..391: note = chr8:61193203-61193594
  misc_feature 1..391: note = hyper
  source 1..391: mol_type = genomic DNA
tctccaagccaaaaacgaattcttcacgctaacactgtcttcctcaggtgtttagtaaaatgtaccgctgctcttcttgactactcagaagacataaaaggtacagccacggcttggaggctagcccgccctccggaccgcagcaggtgcgaacgccagccctgcggaaggctcccgggtgagagcgcaggcggcggaagagcgcaggcggcgagcacgcctccctggagcgcctcccgcccgaaacgcaccaggggagtgggaaagtggcagagacccccgtgggaaagagggggcgtgggggtgctcggagcgcgcagcggcagcaggactcgagtcccgcgctcggcgagacactgacgccgccgcgggaccccggacaccccgactc

SEQ ID NO: 9571 - DNA, 46 bp, Homo sapiens
  misc_feature 1..46: note = chr8:62200760-62200806
  misc_feature 1..46: note = hyper
  source 1..46: mol_type = genomic DNA
tcgatgccatggctgcggcgtttcagcacttcggtatgtggacagc

SEQ ID NO: 9572 - DNA, 171 bp, Homo sapiens
  misc_feature 1..171: note = chr8:63160730-63160901
  misc_feature 1..171: note = hyper
  source 1..171: mol_type = genomic DNA
gggcagaagcaagctcggatgggagacccccgagctgcgtgcccagcgccggctcaacagacttgcccgcgcagcgcccgcgggccccctcgcatccgggcaggttccggagctgggccttgcgctccccggcgcccgcccaccctgggtgtctcgcgtcccggcccttcc

SEQ ID NO: 9573 - DNA, 57 bp, Homo sapiens
  misc_feature 1..57: note = chr8:63161631-63161688
  misc_feature 1..57: note = hyper
  source 1..57: mol_type = genomic DNA
catgggctgctgcaccggacgctgctcgctcatctgcctctgcgcgctgcagttggt

SEQ ID NO: 9574 - DNA, 32 bp, Homo sapiens
  misc_feature 1..32: note = chr8:63998517-63998549
  misc_feature 1..32: note = hyper
  source 1..32: mol_type = genomic DNA
agagtggtccggtagcgcgttgagctgcggcc

SEQ ID NO: 9575 - DNA, 82 bp, Homo sapiens
  misc_feature 1..82: note = chr8:65281329-65281411
  misc_feature 1..82: note = hyper
  source 1..82: mol_type = genomic DNA
ggggcctctggtcagcgctgattaataagtgttttttgttgtgaagtgttgaataatagaggatggccggtgacccagtaag

SEQ ID NO: 9576 - DNA, 30 bp, Homo sapiens
  misc_feature 1..30: note = chr8:65281704-65281734
  misc_feature 1..30: note = hyper
  source 1..30: mol_type = genomic DNA
agtttcgcgcttgttcgaccaacaccagtg

SEQ ID NO: 9577 - DNA, 109 bp, Homo sapiens; identical to SEQ ID NO: 3277
  misc_feature 1..109: note = chr8:65282332-65282441
  misc_feature 1..109: note = hyper
  source 1..109: mol_type = genomic DNA

SEQ ID NO: 9578 - DNA, 221 bp, Homo sapiens
  misc_feature 1..221: note = chr8:65283860-65284081
  misc_feature 1..221: note = hyper
  source 1..221: mol_type = genomic DNA
accagagcagagagccgcaccttcccagcggcgggccccagtgcgcacagcgtgactttgcctcccccaggctcagcaagtcgttgacgatctttagcagtcccgcatcccaggtcaataaactggaaacggatagaatgagaatcatggatgagagataaagggcagcggggtgatgcgcatttcttgtagtgcctccaaaaaaccgtggtctctcgccg

SEQ ID NO: 9579 - DNA, 154 bp, Homo sapiens
  misc_feature 1..154: note = chr8:65286558-65286712
  misc_feature 1..154: note = hyper
  source 1..154: mol_type = genomic DNA
cctagaatggagccccggccagccgcgggccgggccccttggttttcaggacttattcttgccggggttggctcgcacgccagcatcgcgccttcggtgcgtcttttatctccatctcaaatatgggatcttcttgggacgaggactgaatgag

SEQ ID NO: 9580 - DNA, 170 bp, Homo sapiens; identical to SEQ ID NO: 3278
  misc_feature 1..170: note = chr8:65286942-65287112
  misc_feature 1..170: note = hyper
  source 1..170: mol_type = genomic DNA

SEQ ID NO: 9581 - DNA, 304 bp, Homo sapiens
  misc_feature 1..304: note = chr8:65289049-65289353
  misc_feature 1..304: note = hyper
  source 1..304: mol_type = genomic DNA
tttagttttagacaacgtattcaaagtacttgagaagaatatgcaatgacattttttccgtgtcctaatcaggaccatggtgaggtccccgtggttcaccgagtggtggtccagggctctggttgggacgctgagttaggttggcaaagcgtcattgttttgaaaggcacattcgtccggaatggcattcgtgataagattaaacataaacctaaaccttggcctcgggggaaggcaggctgcggggttgagaagaggagatgcagattagctctgcttttgctgcttgcgcacataattaaga

SEQ ID NO: 9582 - DNA, 724 bp, Homo sapiens; identical to SEQ ID NO: 3279
  misc_feature 1..724: note = chr8:65289592-65290316
  misc_feature 1..724: note = hyper
  source 1..724: mol_type = genomic DNA

SEQ ID NO: 9583 - DNA, 27 bp, Homo sapiens
  misc_feature 1..27: note = chr8:65290655-65290682
  misc_feature 1..27: note = hyper
  source 1..27: mol_type = genomic DNA
tctctctcctttcctcggactctggag

SEQ ID NO: 9584 - DNA, 30 bp, Homo sapiens
  misc_feature 1..30: note = chr8:65291052-65291082
  misc_feature 1..30: note = hyper
  source 1..30: mol_type = genomic DNA
atgagttaatttttccgcattacaaagaaa

SEQ ID NO: 9585 - DNA, 30 bp, Homo sapiens
  misc_feature 1..30: note = chr8:65291776-65291806
  misc_feature 1..30: note = hyper
  source 1..30: mol_type = genomic DNA
ggtgaatgccaagagcggagcctacggctg

SEQ ID NO: 9586 - DNA, 86 bp, Homo sapiens
  misc_feature 1..86: note = chr8:65292608-65292694
  misc_feature 1..86: note = hyper
  source 1..86: mol_type = genomic DNA
atgcaccaaagtagccgcgccctccctgcctggcgctgtccgcggtgctgaccgtggcccttttctctctccgtaatcaaactgga

SEQ ID NO: 9587 - DNA, 51 bp, Homo sapiens; identical to SEQ ID NO: 3280
  misc_feature 1..51: note = chr8:65488271-65488322
  misc_feature 1..51: note = hyper
  source 1..51: mol_type = genomic DNA

SEQ ID NO: 9588 - DNA, 30 bp, Homo sapiens
  misc_feature 1..30: note = chr8:65489099-65489129
  misc_feature 1..30: note = hyper
  source 1..30: mol_type = genomic DNA
ggctctcagtggattcgcttttccagagct

SEQ ID NO: 9589 - DNA, 84 bp, Homo sapiens; identical to SEQ ID NO: 3281
  misc_feature 1..84: note = chr8:65492776-65492860
  misc_feature 1..84: note = hyper
  source 1..84: mol_type = genomic DNA

SEQ ID NO: 9590 - DNA, 384 bp, Homo sapiens; identical to SEQ ID NO: 3282
  misc_feature 1..384: note = chr8:65493195-65493579
  misc_feature 1..384: note = hyper
  source 1..384: mol_type = genomic DNA

SEQ ID NO: 9591 - DNA, 149 bp, Homo sapiens; identical to SEQ ID NO: 3283
  misc_feature 1..149: note = chr8:65493806-65493955
  misc_feature 1..149: note = hyper
  source 1..149: mol_type = genomic DNA

SEQ ID NO: 9592 - DNA, 25 bp, Homo sapiens
  misc_feature 1..25: note = chr8:65494076-65494101
  misc_feature 1..25: note = hyper
  source 1..25: mol_type = genomic DNA
cggcttaacatcaatgcccgagagc

SEQ ID NO: 9593 - DNA, 91 bp, Homo sapiens; identical to SEQ ID NO: 3285
  misc_feature 1..91: note = chr8:65494102-65494193
  misc_feature 1..91: note = hyper
  source 1..91: mol_type = genomic DNA

SEQ ID NO: 9594 - DNA, 82 bp, Homo sapiens
  misc_feature 1..82: note = chr8:65498500-65498582
  misc_feature 1..82: note = hyper
  source 1..82: mol_type = genomic DNA
gcaaatgatcatcttcgatagagctctctagttacccgtgcttctccctccctatggtatgtgtttgtgtgtgtgtgtgtgc

SEQ ID NO: 9595 - DNA, 22 bp, Homo sapiens
  misc_feature 1..22: note = chr8:65498642-65498664
  misc_feature 1..22: note = hyper
  source 1..22: mol_type = genomic DNA
cagtccccgcagctgggcaacc

SEQ ID NO: 9596 - DNA, 173 bp, Homo sapiens; identical to SEQ ID NO: 3286
  misc_feature 1..173: note = chr8:65499750-65499923
  misc_feature 1..173: note = hyper
  source 1..173: mol_type = genomic DNA

SEQ ID NO: 9597 - DNA, 30 bp, Homo sapiens
  misc_feature 1..30: note = chr8:67089781-67089811
  misc_feature 1..30: note = hyper
  source 1..30: mol_type = genomic DNA
gagttggttagagttcgctcagctgggagg

SEQ ID NO: 9598 - DNA, 128 bp, Homo sapiens
  misc_feature 1..128: note = chr8:67344533-67344661
  misc_feature 1..128: note = hyper
  source 1..128: mol_type = genomic DNA
caagggtggatggtgcgagcgccgctggggcagctggcgttctggttcttactccgtgggaaaatggccctgagcccgactggcttgaggcttagacaggtgaccccgcgaagcgggtgggcaggcgc

SEQ ID NO: 9599 - DNA, 95 bp, Homo sapiens; identical to SEQ ID NO: 795
  misc_feature 1..95: note = chr8:67873327-67873422
  misc_feature 1..95: note = hyper
  source 1..95: mol_type = genomic DNA

SEQ ID NO: 9600 - skipped

SEQ ID NO: 9601 - DNA, 251 bp, Homo sapiens; identical to SEQ ID NO: 797
  misc_feature 1..251: note = chr8:67873800-67874051
  misc_feature 1..251: note = hyper
  source 1..251: mol_type = genomic DNA

SEQ ID NO: 9602 - DNA, 509 bp, Homo sapiens; identical to SEQ ID NO: 798
  misc_feature 1..509: note = chr8:67874164-67874673
  misc_feature 1..509: note = hyper
  source 1..509: mol_type = genomic DNA

SEQ ID NO: 9603 - DNA, 103 bp, Homo sapiens; identical to SEQ ID NO: 799
  misc_feature 1..103: note = chr8:67874755-67874858
  misc_feature 1..103: note = hyper
  source 1..103: mol_type = genomic DNA

SEQ ID NO: 9604 - DNA, 402 bp, Homo sapiens; identical to SEQ ID NO: 800
  misc_feature 1..402: note = chr8:67874859-67875261
  misc_feature 1..402: note = hyper
  source 1..402: mol_type = genomic DNA

SEQ ID NO: 9605 - DNA, 179 bp, Homo sapiens; identical to SEQ ID NO: 801
  misc_feature 1..179: note = chr8:67875262-67875441
  misc_feature 1..179: note = hyper
  source 1..179: mol_type = genomic DNA

SEQ ID NO: 9606 - DNA, 240 bp, Homo sapiens; identical to SEQ ID NO: 802
  misc_feature 1..240: note = chr8:67875442-67875682
  misc_feature 1..240: note = hyper
  source 1..240: mol_type = genomic DNA

SEQ ID NO: 9607 - DNA, 159 bp, Homo sapiens; identical to SEQ ID NO: 3295
  misc_feature 1..159: note = chr8:67940805-67940964
  misc_feature 1..159: note = hyper
  source 1..159: mol_type = genomic DNA

SEQ ID NO: 9608 - DNA, 258 bp, Homo sapiens; identical to SEQ ID NO: 3296
  misc_feature 1..258: note = chr8:68864545-68864803
  misc_feature 1..258: note = hyper
  source 1..258: mol_type = genomic DNA

SEQ ID NO: 9609 - DNA, 37 bp, Homo sapiens
  misc_feature 1..37: note = chr8:68865398-68865435
  misc_feature 1..37: note = hyper
  source 1..37: mol_type = genomic DNA
caattccctcccccccgccccccgccccggcttaaat

SEQ ID NO: 9610 - DNA, 61 bp, Homo sapiens
  misc_feature 1..61: note = chr8:69242905-69242966
  misc_feature 1..61: note = hyper
  source 1..61: mol_type = genomic DNA
cattggctttttaagcggcgctgtcgctagggagcggctggtagggcgagcagcctcgggg

SEQ ID NO: 9611 - DNA, 202 bp, Homo sapiens; identical to SEQ ID NO: 3297
  misc_feature 1..202: note = chr8:69243284-69243486
  misc_feature 1..202: note = hyper
  source 1..202: mol_type = genomic DNA

SEQ ID NO: 9612 - DNA, 329 bp, Homo sapiens; identical to SEQ ID NO: 3298
  misc_feature 1..329: note = chr8:69243487-69243816
  misc_feature 1..329: note = hyper
  source 1..329: mol_type = genomic DNA

SEQ ID NO: 9613 - DNA, 49 bp, Homo sapiens
  misc_feature 1..49: note = chr8:69244461-69244510
  misc_feature 1..49: note = hyper
  source 1..49: mol_type = genomic DNA
tgagcaggggtggggcgtgcggaccgtagtcagaagtggaggcccttgc

SEQ ID NO: 9614 - DNA, 125 bp, Homo sapiens
  misc_feature 1..125: note = chr8:69244511-69244636
  misc_feature 1..125: note = hyper
  source 1..125: mol_type = genomic DNA
gagggactcccttggtcccatccagttcagggggcactgaccggcggcgagagttcgcgggagggtcgaggtgctcccgccttgcccccgccttgcccccgccttgcccccgccccccacgtctc

SEQ ID NO: 9615 - DNA, 34 bp, Homo sapiens
  misc_feature 1..34: note = chr8:70404830-70404864
  misc_feature 1..34: note = hyper
  source 1..34: mol_type = genomic DNA
cgccgccgtccaagccggccggctgcagcgcagt

SEQ ID NO: 9616 - DNA, 356 bp, Homo sapiens
  misc_feature 1..356: note = chr8:70744839-70745195
  misc_feature 1..356: note = hyper
  source 1..356: mol_type = genomic DNA
agcttctgcagtggccggcgcctccagctgctctcccgccccgggctgcagtccagtgccttcgtccatggcgcttagaattcagatttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttga

SEQ ID NO: 9617 - DNA, 30 bp, Homo sapiens
  misc_feature 1..30: note = chr8:70945287-70945317
  misc_feature 1..30: note = hyper
  source 1..30: mol_type = genomic DNA
ggtcccactcatctgcgccaggtggagggg

SEQ ID NO: 9618 - DNA, 71 bp, Homo sapiens; identical to SEQ ID NO: 3299
  misc_feature 1..71: note = chr8:70946844-70946915
  misc_feature 1..71: note = hyper
  source 1..71: mol_type = genomic DNA

SEQ ID NO: 9619 - DNA, 568 bp, Homo sapiens; identical to SEQ ID NO: 3300
  misc_feature 1..568: note = chr8:70947090-70947658
  misc_feature 1..568: note = hyper
  source 1..568: mol_type = genomic DNA

SEQ ID NO: 9620 - DNA, 23 bp, Homo sapiens
  misc_feature 1..23: note = chr8:70982262-70982285
  misc_feature 1..23: note = hyper
  source 1..23: mol_type = genomic DNA
cgctcccacaattaagacaaaac

SEQ ID NO: 9621 - DNA, 281 bp, Homo sapiens; identical to SEQ ID NO: 804
  misc_feature 1..281: note = chr8:70982286-70982567
  misc_feature 1..281: note = hyper
  source 1..281: mol_type = genomic DNA

SEQ ID NO: 9622 - DNA, 397 bp, Homo sapiens; identical to SEQ ID NO: 805
  misc_feature 1..397: note = chr8:70982850-70983247
  misc_feature 1..397: note = hyper
  source 1..397: mol_type = genomic DNA

SEQ ID NO: 9623 - DNA, 302 bp, Homo sapiens; identical to SEQ ID NO: 806
  misc_feature 1..302: note = chr8:70983568-70983870
  misc_feature 1..302: note = hyper
  source 1..302: mol_type = genomic DNA

SEQ ID NO: 9624 - DNA, 277 bp, Homo sapiens; identical to SEQ ID NO: 807
  misc_feature 1..277: note = chr8:70984016-70984293
  misc_feature 1..277: note = hyper
  source 1..277: mol_type = genomic DNA

SEQ ID NO: 9625 - DNA, 319 bp, Homo sapiens; identical to SEQ ID NO: 808
  misc_feature 1..319: note = chr8:70984343-70984662
  misc_feature 1..319: note = hyper
  source 1..319: mol_type = genomic DNA

SEQ ID NO: 9626 - DNA, 250 bp, Homo sapiens; identical to SEQ ID NO: 809
  misc_feature 1..250: note = chr8:70984744-70984994
  misc_feature 1..250: note = hyper
  source 1..250: mol_type = genomic DNA

SEQ ID NO: 9627 - DNA, 168 bp, Homo sapiens
  misc_feature 1..168: note = chr8:72273966-72274134
  misc_feature 1..168: note = hyper
  source 1..168: mol_type = genomic DNA
gctcctggatgggtacgcgcgggggctctcaggcgctctggtgcagccgcggcgcttctgggagtggagcgcctctgcaggggaaagctcggcgcagggggcaggcgcctggccgctgccgcaggctcgggctgccgagcgactgagcgaaaacgtgttccccaggaa

SEQ ID NO: 9628 - DNA, 78 bp, Homo sapiens; identical to SEQ ID NO: 810
  misc_feature 1..78: note = chr8:72460433-72460511
  misc_feature 1..78: note = hyper
  source 1..78: mol_type = genomic DNA

SEQ ID NO: 9629 - DNA, 557 bp, Homo sapiens; identical to SEQ ID NO: 3309
  misc_feature 1..557: note = chr8:72468582-72469139
  misc_feature 1..557: note = hyper
  source 1..557: mol_type = genomic DNA

SEQ ID NO: 9630 - DNA, 54 bp, Homo sapiens
  misc_feature 1..54: note = chr8:72469478-72469532
  misc_feature 1..54: note = hyper
  source 1..54: mol_type = genomic DNA
ggccacagcaagagtcgccgggtgaggacgggcccggcccgtggcgcctagctg

SEQ ID NO: 9631 - DNA, 119 bp, Homo sapiens
  misc_feature 1..119: note = chr8:72754490-72754609
  misc_feature 1..119: note = hyper
  source 1..119: mol_type = genomic DNA
cgcgaaaggccggggctgtgtggaaccgtcccgcacgtgtgcgatgaatctggctccgctgagaacggatccgtgggctgtctggcgcgggctggggcagcagccgagagttagtctac

SEQ ID NO: 9632 - DNA, 441 bp, Homo sapiens
  misc_feature 1..441: note = chr8:72754821-72755262
  misc_feature 1..441: note = hyper
  source 1..441: mol_type = genomic DNA
gctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgaggttctgtcgtttagttcccttc

SEQ ID NO: 9633 - DNA, 345 bp, Homo sapiens; identical to SEQ ID NO: 811
  misc_feature 1..345: note = chr8:72755470-72755815
  misc_feature 1..345: note = hyper
  source 1..345: mol_type = genomic DNA

SEQ ID NO: 9634 - DNA, 157 bp, Homo sapiens; identical to SEQ ID NO: 812
  misc_feature 1..157: note = chr8:72756655-72756812
  misc_feature 1..157: note = hyper
  source 1..157: mol_type = genomic DNA

SEQ ID NO: 9635 - DNA, 83 bp, Homo sapiens; identical to SEQ ID NO: 813
  misc_feature 1..83: note = chr8:72756813-72756896
  misc_feature 1..83: note = hyper
  source 1..83: mol_type = genomic DNA

SEQ ID NO: 9636 - DNA, 316 bp, Homo sapiens; identical to SEQ ID NO: 3313
  misc_feature 1..316: note = chr8:72987600-72987916
  misc_feature 1..316: note = hyper
  source 1..316: mol_type = genomic DNA

SEQ ID NO: 9637 - DNA, 119 bp, Homo sapiens; identical to SEQ ID NO: 3314
  misc_feature 1..119: note = chr8:72987917-72988036
  misc_feature 1..119: note = hyper
  source 1..119: mol_type = genomic DNA

SEQ ID NO: 9638 - DNA, 15 bp, Homo sapiens
  misc_feature 1..15: note = chr8:73163646-73163661
  misc_feature 1..15: note = hyper
  source 1..15: mol_type = genomic DNA
ccggacttcagaacc

SEQ ID NO: 9639 - DNA, 108 bp, Homo sapiens
  misc_feature 1..108: note = chr8:73163859-73163967
  misc_feature 1..108: note = hyper
  source 1..108: mol_type = genomic DNA
cgagagagcgctgtcagccggccaggcgctggggtccgcgcgagcccgagctctccctcgctgcagctcacaggcagcgaaaatctcgctccgcgagagccctggaga

SEQ ID NO: 9640 - DNA, 46 bp, Homo sapiens
  misc_feature 1..46: note = chr8:73448786-73448832
  misc_feature 1..46: note = hyper
  source 1..46: mol_type = genomic DNA
gtcagatcttatctgcgctcctagttatctccgcagctctttctcc

SEQ ID NO: 9641 - DNA, 153 bp, Homo sapiens; identical to SEQ ID NO: 3315
  misc_feature 1..153: note = chr8:73449802-73449955
  misc_feature 1..153: note = hyper
  source 1..153: mol_type = genomic DNA

SEQ ID NO: 9642 - DNA, 90 bp, Homo sapiens; identical to SEQ ID NO: 3316
  misc_feature 1..90: note = chr8:73450026-73450116
  misc_feature 1..90: note = hyper
  source 1..90: mol_type = genomic DNA

SEQ ID NO: 9643 - DNA, 39 bp, Homo sapiens
  misc_feature 1..39: note = chr8:73450520-73450559
  misc_feature 1..39: note = hyper
  source 1..39: mol_type = genomic DNA
attcttcaagcggtgcgcggtctccgttctgtagcacga

SEQ ID NO: 9644 - DNA, 262 bp, Homo sapiens; identical to SEQ ID NO: 3317
  misc_feature 1..262: note = chr8:75896574-75896836
  misc_feature 1..262: note = hyper
  source 1..262: mol_type = genomic DNA

SEQ ID NO: 9645 - DNA, 364 bp, Homo sapiens; identical to SEQ ID NO: 3318
  misc_feature 1..364: note = chr8:75896837-75897201
  misc_feature 1..364: note = hyper
  source 1..364: mol_type = genomic DNA

SEQ ID NO: 9646 - DNA, 156 bp, Homo sapiens; identical to SEQ ID NO: 3319
  misc_feature 1..156: note = chr8:77585219-77585375
  misc_feature 1..156: note = hyper
  source 1..156: mol_type = genomic DNA

SEQ ID NO: 9647 - DNA, 102 bp, Homo sapiens
  misc_feature 1..102: note = chr8:77585603-77585705
  misc_feature 1..102: note = hyper
  source 1..102: mol_type = genomic DNA
tcacagatgcaaaggcgctgtacggtgaactttatatcgtggaaactaacttaactccgagaagagaaagtgcaattagacggcaaccgagtataagaaaat

SEQ ID NO: 9648 - DNA, 165 bp, Homo sapiens; identical to SEQ ID NO: 3320
  misc_feature 1..165: note = chr8:77586175-77586340
  misc_feature 1..165: note = hyper
  source 1..165: mol_type = genomic DNA

SEQ ID NO: 9649 - DNA, 293 bp, Homo sapiens; identical to SEQ ID NO: 3321
  misc_feature 1..293: note = chr8:77590239-77590532
  misc_feature 1..293: note = hyper
  source 1..293: mol_type = genomic DNA

SEQ ID NO: 9650 - DNA, 399 bp, Homo sapiens
  misc_feature 1..399: note = chr8:77593310-77593709
  misc_feature 1..399: note = hyper
  source 1..399: mol_type = genomic DNA
gggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcac

SEQ ID NO: 9651 - DNA, 56 bp, Homo sapiens
  misc_feature 1..56: note = chr8:77594619-77594675
  misc_feature 1..56: note = hyper
  source 1..56: mol_type = genomic DNA
agaggctggggtgaacgctggggctggggctgcaggtagacacccgcccaccggag

SEQ ID NO: 9652 - DNA, 114 bp, Homo sapiens
  misc_feature 1..114: note = chr8:77594757-77594871
  misc_feature 1..114: note = hyper
  source 1..114: mol_type = genomic DNA
cgggatcgcccggcctctgggccagggacccgcgaggcggcggctgcttgctccgaacggaacgccgccgggtgtgcgttagaccagcggatagacgcccgcggcttggggtca

SEQ ID NO: 9653 - DNA, 46 bp, Homo sapiens
  misc_feature 1..46: note = chr8:77595339-77595385
  misc_feature 1..46: note = hyper
  source 1..46: mol_type = genomic DNA
gagaggaggcttctgcgggcgcctttggccgcgacttctcacttcc

SEQ ID NO: 9654 - DNA, 453 bp, Homo sapiens
  misc_feature 1..453: note = chr8:79428468-79428921
  misc_feature 1..453: note = hyper
  source 1..453: mol_type = genomic DNA
tgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctat

SEQ ID NO: 9655 - DNA, 490 bp, Homo sapiens; identical to SEQ ID NO: 3322
  misc_feature 1..490: note = chr8:80523960-80524450
  misc_feature 1..490: note = hyper
  source 1..490: mol_type = genomic DNA

SEQ ID NO: 9656 - DNA, 463 bp, Homo sapiens
  misc_feature 1..463: note = chr8:80524845-80525308
  misc_feature 1..463: note = hyper
  source 1..463: mol_type = genomic DNA
tgccttgagtgcccacggttctggcgctcagtggccccggggtgaaaaggcagggtggggcctggggtcctgtggcagctggaagcacgtgtcccccgggacttggttgcaggatgcggagacagggaaagctgccgaaaggactccatctgcgcggctccgccctgccctaccctccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccc

SEQ ID NO: 9657 - DNA, 39 bp, Homo sapiens
  misc_feature 1..39: note = chr8:80525530-80525569
  misc_feature 1..39: note = hyper
  source 1..39: mol_type = genomic DNA
ctggccgggtgggggcgcacgtggcgactgggtgtgtgg

SEQ ID NO: 9658 - DNA, 164 bp, Homo sapiens; identical to SEQ ID NO: 3323
  misc_feature 1..164: note = chr8:80803593-80803757
  misc_feature 1..164: note = hyper
  source 1..164: mol_type = genomic DNA

SEQ ID NO: 9659 - DNA, 199 bp, Homo sapiens; identical to SEQ ID NO: 3324
  misc_feature 1..199: note = chr8:81478156-81478355
  misc_feature 1..199: note = hyper
  source 1..199: mol_type = genomic DNA

SEQ ID NO: 9660 - DNA, 448 bp, Homo sapiens
  misc_feature 1..448: note = chr8:82192848-82193296
  misc_feature 1..448: note = hyper
  source 1..448: mol_type = genomic DNA
ctggaaggaagatggcgcctggtggacagcaaaggctttgatgaatacatgaaggagctaggtgaggcacccggcctggcagcgcctgcaacgtggcgtgttgtgcggtcgtctgtccctaggtccccgtcagcgtgccagattctggggcaggagatgctcggcggcctacccccatcccctcccatcttccccaccacgcggccgttgggtgcagcgcgcgcagcaccacgcgggcaggcggcgaggagcagggagcgtgcgcgcctcttgcccgcccgcgggccgcaagattccggaggtggtccaccccgtggtccacctacctctgcttctttcccttcgcccaaacggcagcccttccgcattgcttcctgtcctttagcgcgcgcacccgtcacctcacgctgcacttctttcgaccccctccaggcgaccctgtatttcc

SEQ ID NO: 9661 - DNA, 30 bp, Homo sapiens
  misc_feature 1..30: note = chr8:82193521-82193551
  misc_feature 1..30: note = hyper
  source 1..30: mol_type = genomic DNA
ttcctctgtcagccccgtctcccccaggtc

SEQ ID NO: 9662 - DNA, 94 bp, Homo sapiens
  misc_feature 1..94: note = chr8:85095574-85095668
  misc_feature 1..94: note = hyper
  source 1..94: mol_type = genomic DNA
aggcgccaggctccccgtcgccgccgccgccgcctcgccagccagagttgggctccgtgggcttcccccctcgcagcctcggtccttccccgct

SEQ ID NO: 9663 - DNA, 141 bp, Homo sapiens
  misc_feature 1..141: note = chr8:85096583-85096724
  misc_feature 1..141: note = hyper
  source 1..141: mol_type = genomic DNA
aaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaaat

SEQ ID NO: 9664 - DNA, 41 bp, Homo sapiens
  misc_feature 1..41: note = chr8:85097179-85097220
  misc_feature 1..41: note = hyper
  source 1..41: mol_type = genomic DNA
ccttgaggatggcaccggccctcgcacgctcaactcctgct

SEQ ID NO: 9665 - DNA, 942 bp, Homo sapiens
  misc_feature 1..942: note = chr8:89339064-89340006
  misc_feature 1..942: note = hyper
  source 1..942: mol_type = genomic DNA
aattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgatgcacgaaatccaaccgtcttccagtgctgaatgtgagtaagatcatagtgaactgtgcttcaatggatggacgagctccccttcgttttctccctctctccctctccctccctccctcgtttcctttcaaaaaaaagtcctccgggtgggtaaggagcctgcaggttcacccacagccgggcaaggggaggagacaggggccccgcgctcggcagcccccgagaggcagcggcgaagacagggtcagcagtagttcctgttcaccatcctccggggtcagtcaccgggaacgtggcgcctaagttcaccggcggttccggctcaaagagcctagtcgcagccgcagcagcagcagccgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcgcgcgcgcgcgcacacacacacac

SEQ ID NO: 9666 - DNA, 124 bp, Homo sapiens
  misc_feature 1..124: note = chr8:89340273-89340397
  misc_feature 1..124: note = hyper
  source 1..124: mol_type = genomic DNA
cgcatctaaaaacgagtgcgcccctctccagccatgagctgggtggggctcaggctgcggaccctagtggggcctggggagcggcccaaccctggtcctggagagcggtcggcattcctgagga

SEQ ID NO: 9667 - DNA, 30 bp, Homo sapiens
  misc_feature 1..30: note = chr8:89340928-89340958
  misc_feature 1..30: note = hyper
  source 1..30: mol_type = genomic DNA
ggcaagagggggaggcggctggcaagaagc

SEQ ID NO: 9668 - DNA, 32 bp, Homo sapiens
  misc_feature 1..32: note = chr8:91094254-91094286
  misc_feature 1..32: note = hyper
  source 1..32: mol_type = genomic DNA
aatccagccttctttcgcgcctgctggagctc

SEQ ID NO: 9669 - DNA, 90 bp, Homo sapiens
  misc_feature 1..90: note = chr8:91804064-91804154
  misc_feature 1..90: note = hyper
  source 1..90: mol_type = genomic DNA
ggtgcgtccgcctagccccgctccgcctgaggccgtcagggctcccgaggatggaagattcccaggagacatcgccgtcctccaacaact

SEQ ID NO: 9670 - DNA, 448 bp, Homo sapiens; identical to SEQ ID NO: 814
  misc_feature 1..448: note = chr8:91997061-91997509
  misc_feature 1..448: note = hyper
  source 1..448: mol_type = genomic DNA

SEQ ID NO: 9671 - DNA, 479 bp, Homo sapiens; identical to SEQ ID NO: 815
  misc_feature 1..479: note = chr8:91997527-91998006
  misc_feature 1..479: note = hyper
  source 1..479: mol_type = genomic DNA

SEQ ID NO: 9672 - DNA, 141 bp, Homo sapiens
  misc_feature 1..141: note = chr8:93114380-93114521
  misc_feature 1..141: note = hyper
  source 1..141: mol_type = genomic DNA
atcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctggg

SEQ ID NO: 9673 - DNA, 30 bp, Homo sapiens
  misc_feature 1..30: note = chr8:93115382-93115412
  misc_feature 1..30: note = hyper
  source 1..30: mol_type = genomic DNA
ctgctcccctcctcccgcctccctccctcc

SEQ ID NO: 9674 - DNA, 36 bp, Homo sapiens
  misc_feature 1..36: note = chr8:93115823-93115859
  misc_feature 1..36: note = hyper
  source 1..36: mol_type = genomic DNA
gggcggcctccctcccggcctcgccctctcccatgc

SEQ ID NO: 9675 - DNA, 202 bp, Homo sapiens; identical to SEQ ID NO: 816
  misc_feature 1..202: note = chr8:97157008-97157210
  misc_feature 1..202: note = hyper
  source 1..202: mol_type = genomic DNA

SEQ ID NO: 9676 - DNA, 232 bp, Homo sapiens; identical to SEQ ID NO: 817
  misc_feature 1..232: note = chr8:97157666-97157898
  misc_feature 1..232: note = hyper
  source 1..232: mol_type = genomic DNA

SEQ ID NO: 9677 - DNA, 122 bp, Homo sapiens; identical to SEQ ID NO: 818
  misc_feature 1..122: note = chr8:97158021-97158143
  misc_feature 1..122: note = hyper
  source 1..122: mol_type = genomic DNA

SEQ ID NO: 9678 - DNA, 204 bp, Homo sapiens; identical to SEQ ID NO: 819
  misc_feature 1..204: note = chr8:97169716-97169920
  misc_feature 1..204: note = hyper
  source 1..204: mol_type = genomic DNA

SEQ ID NO: 9679 - DNA, 13 bp, Homo sapiens
  misc_feature 1..13: note = chr8:97169921-97169934
  misc_feature 1..13: note = hyper
  source 1..13: mol_type = genomic DNA
gaagtccttgcca

SEQ ID NO: 9680 - DNA, 180 bp, Homo sapiens; identical to SEQ ID NO: 821
  misc_feature 1..180: note = chr8:97170158-97170338
  misc_feature 1..180: note = hyper
  source 1..180: mol_type = genomic DNA

SEQ ID NO: 9681 - DNA, 291 bp, Homo sapiens; identical to SEQ ID NO: 822
  misc_feature 1..291: note = chr8:97170377-97170668
  misc_feature 1..291: note = hyper
  source 1..291: mol_type = genomic DNA

SEQ ID NO: 9682 - DNA, 65 bp, Homo sapiens; identical to SEQ ID NO: 3334
  misc_feature 1..65: note = chr8:97171119-97171184
  misc_feature 1..65: note = hyper
  source 1..65: mol_type = genomic DNA

SEQ ID NO: 9683 - DNA, 361 bp, Homo sapiens; identical to SEQ ID NO: 823
  misc_feature 1..361: note = chr8:97171598-97171959
  misc_feature 1..361: note = hyper
  source 1..361: mol_type = genomic DNA

SEQ ID NO: 9684 - DNA, 722 bp, Homo sapiens; identical to SEQ ID NO: 824
  misc_feature 1..722: note = chr8:97172018-97172740
  misc_feature 1..722: note = hyper
  source 1..722: mol_type = genomic DNA

SEQ ID NO: 9685 - DNA, 50 bp, Homo sapiens; identical to SEQ ID NO: 825
  misc_feature 1..50: note = chr8:97172821-97172871
  misc_feature 1..50: note = hyper
  source 1..50: mol_type = genomic DNA

SEQ ID NO: 9686 - DNA, 388 bp, Homo sapiens; identical to SEQ ID NO: 826
  misc_feature 1..388: note = chr8:97173138-97173526
  misc_feature 1..388: note = hyper
  source 1..388: mol_type = genomic DNA

SEQ ID NO: 9687 - DNA, 13 bp, Homo sapiens
  misc_feature 1..13: note = chr8:97173527-97173540
  misc_feature 1..13: note = hyper
  source 1..13: mol_type = genomic DNA
gtggtaccctccc

SEQ ID NO: 9688 - DNA, 30 bp, Homo sapiens
  misc_feature 1..30: note = chr8:97505645-97505675
  misc_feature 1..30: note = hyper
  source 1..30: mol_type = genomic DNA
aaagagaaaagacaacggggaagaaaagag

SEQ ID NO: 9689 - DNA, 231 bp, Homo sapiens; identical to SEQ ID NO: 3340
  misc_feature 1..231: note = chr8:97506177-97506408
  misc_feature 1..231: note = hyper
  source 1..231: mol_type = genomic DNA

SEQ ID NO: 9690 - DNA, 38 bp, Homo sapiens; identical to SEQ ID NO: 3341
  misc_feature 1..38: note = chr8:97506447-97506485
  misc_feature 1..38: note = hyper
  source 1..38: mol_type = genomic DNA

SEQ ID NO: 9691 - DNA, 580 bp, Homo sapiens; identical to SEQ ID NO: 3342
  misc_feature 1..580: note = chr8:97507115-97507695
  misc_feature 1..580: note = hyper
  source 1..580: mol_type = genomic DNA

SEQ ID NO: 9692 - DNA, 50 bp, Homo sapiens; identical to SEQ ID NO: 828
  misc_feature 1..50: note = chr8:98289818-98289868
  misc_feature 1..50: note = hyper
  source 1..50: mol_type = genomic DNA

SEQ ID NO: 9693 - DNA, 425 bp, Homo sapiens; identical to SEQ ID NO: 829
  misc_feature 1..425: note = chr8:98289922-98290347
  misc_feature 1..425: note = hyper
  source 1..425: mol_type = genomic DNA

SEQ ID NO: 9694 - DNA, 94 bp, Homo sapiens
  misc_feature 1..94: note = chr8:99076589-99076683
  misc_feature 1..94: note = hyper
  source 1..94: mol_type = genomic DNA
tgccataccctccaccgtctcccctcctgtctcctgggctctactcctccctgccctcctctgcgtcctggccctcccgctctcttccgctttg

SEQ ID NO: 9695 - DNA, 240 bp, Homo sapiens
  misc_feature 1..240: note = chr8:99076759-99076999
  misc_feature 1..240: note = hyper
  source 1..240: mol_type = genomic DNA
cgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcg

SEQ ID NO: 9696 - DNA, 91 bp, Homo sapiens
  misc_feature 1..91: note = chr8:99439283-99439374
  misc_feature 1..91: note = hyper
  source 1..91: mol_type = genomic DNA
tgggtgggtgaggggcgcgcggatccggagagggggctccgggagcggcgggaccacgcagccacctgtgagccttcggcagctgcgggcg

SEQ ID NO: 9697 - DNA, 660 bp, Homo sapiens; identical to SEQ ID NO: 830
  misc_feature 1..660: note = chr8:99439694-99440354
  misc_feature 1..660: note = hyper
  source 1..660: mol_type = genomic DNA

SEQ ID NO: 9698 - DNA, 298 bp, Homo sapiens; identical to SEQ ID NO: 831
  misc_feature 1..298: note = chr8:99951846-99952144
  misc_feature 1..298: note = hyper
  source 1..298: mol_type = genomic DNA

SEQ ID NO: 9699 - DNA, 106 bp, Homo sapiens; identical to SEQ ID NO: 832
  misc_feature 1..106: note = chr8:99952198-99952304
  misc_feature 1..106: note = hyper
  source 1..106: mol_type = genomic DNA

SEQ ID NO: 9700 - DNA, 319 bp, Homo sapiens; identical to SEQ ID NO: 833
  misc_feature 1..319: note = chr8:99952532-99952851
  misc_feature 1..319: note = hyper
  source 1..319: mol_type = genomic DNA

SEQ ID NO: 9701 - DNA, 140 bp, Homo sapiens
  misc_feature 1..140: note = chr8:99954416-99954556
  misc_feature 1..140: note = hyper
  source 1..140: mol_type = genomic DNA
tcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggc

SEQ ID NO: 9702 - DNA, 92 bp, Homo sapiens
  misc_feature 1..92: note = chr8:99955188-99955280
  misc_feature 1..92: note = hyper
  source 1..92: mol_type = genomic DNA
aaacactcgaatctccgtttcaagctcactttttaatctttgcgaacttaaaattggaaagacagaaaaaaaatctgcgacccctgttatgt

SEQ ID NO: 9703 - DNA, 30 bp, Homo sapiens
  misc_feature 1..30: note = chr8:99960111-99960141
  misc_feature 1..30: note = hyper
  source 1..30: mol_type = genomic DNA
tctcctggggcatcccgggtggagggatgt

SEQ ID NO: 9704 - DNA, 133 bp, Homo sapiens
  misc_feature 1..133: note = chr8:99960365-99960498
  misc_feature 1..133: note = hyper
  source 1..133: mol_type = genomic DNA
cacttttctttcctgcggcccgtcaccgctgatagatggggctgagggcagaggaaggaaaaagaaaacctccgaggtcagtgcggggcgaggtgagcccctcccagggccctctggcccaggaggatgaagc

SEQ ID NO: 9705 - DNA, 48 bp, Homo sapiens
  misc_feature 1..48: note = chr8:99961792-99961840
  misc_feature 1..48: note = hyper
  source 1..48: mol_type = genomic DNA
tgccacaaggccttccggaggcaagatcacctgcgggatcacaggtga

SEQ ID NO: 9706 - DNA, 178 bp, Homo sapiens; identical to SEQ ID NO: 834
  misc_feature 1..178: note = chr8:99985866-99986044
  misc_feature 1..178: note = hyper
  source 1..178: mol_type = genomic DNA

SEQ ID NO: 9707 - DNA, 302 bp, Homo sapiens; identical to SEQ ID NO: 835
  misc_feature 1..302: note = chr8:99986225-99986527
  misc_feature 1..302: note = hyper
  source 1..302: mol_type = genomic DNA

SEQ ID NO: 9708 - DNA, 165 bp, Homo sapiens; identical to SEQ ID NO: 836
  misc_feature 1..165: note = chr8:99986791-99986956
  misc_feature 1..165: note = hyper
  source 1..165: mol_type = genomic DNA

SEQ ID NO: 9709 - DNA, 30 bp, Homo sapiens
  misc_feature 1..30: note = chr8:101118014-101118044
  misc_feature 1..30: note = hyper
  source 1..30: mol_type = genomic DNA
tgggagcggggataccgctaggagggcagg

SEQ ID NO: 9710 - DNA, 133 bp, Homo sapiens; identical to SEQ ID NO: 3352
  misc_feature 1..133: note = chr8:101821973-101822106
  misc_feature 1..133: note = hyper
  source 1..133: mol_type = genomic DNA

SEQ ID NO: 9711 - DNA, 38 bp, Homo sapiens
  misc_feature 1..38: note = chr8:102505884-102505922
  misc_feature 1..38: note = hyper
  source 1..38: mol_type = genomic DNA
ctcggacgcggcaggcgggactgcgtggggcgcgccga

SEQ ID NO: 9712 - DNA, 174 bp, Homo sapiens
  misc_feature 1..174: note = chr8:104152775-104152949
  misc_feature 1..174: note = hyper
  source 1..174: mol_type = genomic DNA
ctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagaggg

SEQ ID NO: 9713 - DNA, 295 bp, Homo sapiens
  misc_feature 1..295: note = chr8:104153267-104153562
  misc_feature 1..295: note = hyper
  source 1..295: mol_type = genomic DNA
cgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaagcccagggagtggggtcgaccagagccccttaccgaaggctgcgccgatgccccagcttccagcagcccaatgctctttggccttgtccaaagcttgctcgctggtcgggagac

SEQ ID NO: 9714 - DNA, 349 bp, Homo sapiens
  misc_feature 1..349: note = chr8:104511157-104511506
  misc_feature 1..349: note = hyper
  source 1..349: mol_type = genomic DNA
cattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccac

SEQ ID NO: 9715 - DNA, 930 bp, Homo sapiens; identical to SEQ ID NO: 3353
  misc_feature 1..930: note = chr8:104512023-104512953
  misc_feature 1..930: note = hyper
  source 1..930: mol_type = genomic DNA

SEQ ID NO: 9716 - DNA, 504 bp, Homo sapiens; identical to SEQ ID NO: 3354
  misc_feature 1..504: note = chr8:104513405-104513909
  misc_feature 1..504: note = hyper
  source 1..504: mol_type = genomic DNA

SEQ ID NO: 9717 - DNA, 16 bp, Homo sapiens
  misc_feature 1..16: note = chr8:104513910-104513926
  misc_feature 1..16: note = hyper
  source 1..16: mol_type = genomic DNA
gcgagtgctaacaccc

SEQ ID NO: 9718 - DNA, 253 bp, Homo sapiens; identical to SEQ ID NO: 3356
  misc_feature 1..253: note = chr8:105235249-105235502
  misc_feature 1..253: note = hyper
  source 1..253: mol_type = genomic DNA

SEQ ID NO: 9719 - DNA, 191 bp, Homo sapiens
  misc_feature 1..191: note = chr8:105235863-105236054
  misc_feature 1..191: note = hyper
  source 1..191: mol_type = genomic DNA
cgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggaggtgagacaccccttcccccgtagttggtgtctc

SEQ ID NO: 9720 - DNA, 155 bp, Homo sapiens
  misc_feature 1..155: note = chr8:105600526-105600681
  misc_feature 1..155: note = hyper
  source 1..155: mol_type = genomic DNA
gtggggagaagtcagcgggaagccttttcagggaatcgagtaggacaagggctggcgcggtgggaatctcgccggtgagagaacttcctaaccccgggttgagggggcggggggaaggaccgtcccggcagcggcgggggcgagctcctctgctt

SEQ ID NO: 9721 - DNA, 87 bp, Homo sapiens
  misc_feature 1..87: note = chr8:105601174-105601261
  misc_feature 1..87: note = hyper
  source 1..87: mol_type = genomic DNA
gaagctggaggtagacgacgccgacgccgccgccgccgccgccgccgccgccgagccaccggctgctccctgcgctctccgcggctg

SEQ ID NO: 9722 - DNA, 30 bp, Homo sapiens
  misc_feature 1..30: note = chr8:105602021-105602051
  misc_feature 1..30: note = hyper
  source 1..30: mol_type = genomic DNA
tcatttgacatctcacgctgggtcgggtgc

SEQ ID NO: 9723 - DNA, 30 bp, Homo sapiens
  misc_feature 1..30: note = chr8:106330435-106330465
  misc_feature 1..30: note = hyper
  source 1..30: mol_type = genomic DNA
ggccctcctccaagccgtccccacgcctcc

SEQ ID NO: 9724 - DNA, 63 bp, Homo sapiens
  misc_feature 1..63: note = chr8:106331011-106331074
  misc_feature 1..63: note = hyper
  source 1..63: mol_type = genomic DNA
cccggaggagcccagcgcccggagcacctggagtccggccggcggcgggccgagcctggccag

SEQ ID NO: 9725 - DNA, 154 bp, Homo sapiens
  misc_feature 1..154: note = chr8:106331083-106331237
  misc_feature 1..154: note = hyper
  source 1..154: mol_type = genomic DNA
cggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttg

SEQ ID NO: 9726 - DNA, 505 bp, Homo sapiens
  misc_feature 1..505: note = chr8:107283327-107283832
  misc_feature 1..505: note = hyper
  source 1..505: mol_type = genomic DNA
ggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcag

SEQ ID NO: 9727 - DNA, 140 bp, Homo sapiens
  misc_feature 1..140: note = chr8:107284082-107284222
  misc_feature 1..140: note = hyper
  source 1..140: mol_type = genomic DNA
gaatcctgggagtcccggccgtcagaggggttcccaaatccaaagggtccatctccaaggcgtcactccaggggtccgcggttcactttgctgccccttgcaggtgatgctgtgattgttgcctgcggactgggaagcac

SEQ ID NO: 9728 - DNA, 208 bp, Homo sapiens
  misc_feature 1..208: note = chr8:109093726-109093934
  misc_feature 1..208: note = hyper
  source 1..208: mol_type = genomic DNA
gggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctgga

SEQ ID NO: 9729 - DNA, 33 bp, Homo sapiens
  misc_feature 1..33: note = chr8:109094147-109094180
  misc_feature 1..33: note = hyper
  source 1..33: mol_type = genomic DNA
agaaagttcccatctcgtcgcagtttccagaaa

SEQ ID NO: 9730 - DNA, 952 bp, Homo sapiens; identical to SEQ ID NO: 3357
  misc_feature 1..952: note = chr8:109094485-109095437
  misc_feature 1..952: note = hyper
  source 1..952: mol_type = genomic DNA

SEQ ID NO: 9731 - skipped

SEQ ID NO: 9732 - DNA, 139 bp, Homo sapiens
  misc_feature 1..139: note = chr8:109799601-109799740
  misc_feature 1..139: note = hyper
  source 1..139: mol_type = genomic DNA
acgaaggagagagagcggggatatgcgctccagctctgctaggctccagggctctcacccttgcattcaaagcctccaccccatcccactccccgccactcaccttctgcttcggccacccggtgcggctccagcaccg

SEQ ID NO: 9733 - DNA, 117 bp, Homo sapiens; identical to SEQ ID NO: 3359
  misc_feature 1..117: note = chr8:110703765-110703882
  misc_feature 1..117: note = hyper
  source 1..117: mol_type = genomic DNA

SEQ ID NO: 9734 - DNA, 30 bp, Homo sapiens
  misc_feature 1..30: note = chr8:110704224-110704254
  misc_feature 1..30: note = hyper
  source 1..30: mol_type = genomic DNA
gaacactgacttcagcgtgaacctaaggtg

SEQ ID NO: 9735 - DNA, 52 bp, Homo sapiens
  misc_feature 1..52: note = chr8:110986212-110986264
  misc_feature 1..52: note = hyper
  source 1..52: mol_type = genomic DNA
ctgcaggaaggagagcgcgcacagctgctccatgacatgcaggcggccggtg

SEQ ID NO: 9736 - DNA, 354 bp, Homo sapiens
  misc_feature 1..354: note = chr8:110986328-110986682
  misc_feature 1..354: note = hyper
  source 1..354: mol_type = genomic DNA
cggggttggcatcgtcgcaaagctccagagggctgggcacggcggccagggccccggggcggcggtaggaagccaccaccacggccagcttgccaaggcgcgtgtgcgggaagcaggacagcgcctgctgcgagagcacgaagcggctgccgcccacgttgaccgtgaagcagtccccgagcgccaagggctccccttcaccctcgctgcagaagacactagagtccagggaggtcagggagccgctgtccagcggcgagtccagcagcgctctgccgctggaaggcatctctaacccagtcgccgcggcctgagggcgccacaaagttggggacacgccggaagctttggtcc

SEQ ID NO: 9737 - DNA, 85 bp, Homo sapiens
  misc_feature 1..85: note = chr8:110986934-110987019
  misc_feature 1..85: note = hyper
  source 1..85: mol_type = genomic DNA
ctggcccttcccaaacgttgtcaccccgcctcccaacttcgcaattgcgattcccagcccaggaggtgtacagattgaatgactc

SEQ ID NO: 9738 - DNA, 202 bp, Homo sapiens
  misc_feature 1..202: note = chr8:110987020-110987222
  misc_feature 1..202: note = hyper
  source 1..202: mol_type = genomic DNA
ctacttggtgggtggaggggttggggaagggaggaaggagggagatgtggggcggaggaggaggaagaggagagaagatgactcttagctgaacgcaagcaagcaagcaagcaagggggatggcgagactcactcctgcccgcaggagaccaaaacaaaaagttcagaaagcaaaggaagtggtaaccgggtcccttccaac

SEQ ID NO: 9739 - DNA, 146 bp, Homo sapiens
  misc_feature 1..146: note = chr8:110987765-110987911
  misc_feature 1..146: note = hyper
  source 1..146: mol_type = genomic DNA
ggcccctggaagctgcgctccagccaacctgttggactcggggtgaggaggtgggggtgggagggaagagcaagtgactcacctgcagctcccggcacatctggtctgcgcacaaccggcgccgcaggtaacgtactcttcttttg

SEQ ID NO: 9740 - DNA, 408 bp, Homo sapiens; identical to SEQ ID NO: 837
  misc_feature 1..408: note = chr8:114444784-114445192
  misc_feature 1..408: note = hyper
  source 1..408: mol_type = genomic DNA

SEQ ID NO: 9741 - DNA, 41 bp, Homo sapiens
  misc_feature 1..41: note = chr8:114445521-114445562
  misc_feature 1..41: note = hyper
  source 1..41: mol_type = genomic DNA
gttgggaaagactgtcgccttatgggcgaggactgtgggtg

SEQ ID NO: 9742 - DNA, 30 bp, Homo sapiens
  misc_feature 1..30: note = chr8:114445847-114445877
  misc_feature 1..30: note = hyper
  source 1..30: mol_type = genomic DNA
gcgcgacgccgcacccggtctcccacctgc

SEQ ID NO: 9743 - DNA, 179 bp, Homo sapiens; identical to SEQ ID NO: 3361
  misc_feature 1..179: note = chr8:114446958-114447137
  misc_feature 1..179: note = hyper
  source 1..179: mol_type = genomic DNA

SEQ ID NO: 9744 - DNA, 30 bp, Homo sapiens
  misc_feature 1..30: note = chr8:114447368-114447398
  misc_feature 1..30: note = hyper
  source 1..30: mol_type = genomic DNA
gtaagcaacctgagccgtgctttgtacatt

SEQ ID NO: 9745 - DNA, 30 bp, Homo sapiens
  misc_feature 1..30: note = chr8:114448796-114448826
  misc_feature 1..30: note = hyper
  source 1..30: mol_type = genomic DNA
atcagattattttatcggtgcaaattgcaa

SEQ ID NO: 9746 - DNA, 32 bp, Homo sapiens
  misc_feature 1..32: note = chr8:114449074-114449106
  misc_feature 1..32: note = hyper
  source 1..32: mol_type = genomic DNA
ccctttcatattattcgcgagctcctaattcc

SEQ ID NO: 9747 - DNA, 23 bp, Homo sapiens
  misc_feature 1..23: note = chr8:116660615-116660638
  misc_feature 1..23: note = hyper
  source 1..23: mol_type = genomic DNA
cgataacacgcccacagcccggg

SEQ ID NO: 9748 - DNA, 139 bp, Homo sapiens; identical to SEQ ID NO: 3363
  misc_feature 1..139: note = chr8:117950379-117950518
  misc_feature 1..139: note = hyper
  source 1..139: mol_type = genomic DNA

SEQ ID NO: 9749 - DNA, 173 bp, Homo sapiens; identical to SEQ ID NO: 3364
  misc_feature 1..173: note = chr8:117950779-117950952
  misc_feature 1..173: note = hyper
  source 1..173: mol_type = genomic DNA

SEQ ID NO: 9750 - DNA, 30 bp, Homo sapiens
  misc_feature 1..30: note = chr8:121136879-121136909
  misc_feature 1..30: note = hyper
  source 1..30: mol_type = genomic DNA
ggagaagaggaggctcgaagggggccttta

SEQ ID NO: 9751 - DNA, 297 bp, Homo sapiens; identical to SEQ ID NO: 3365
  misc_feature 1..297: note = chr8:121137130-121137427
  misc_feature 1..297: note = hyper
  source 1..297: mol_type = genomic DNA

SEQ ID NO: 9752 - DNA, 45 bp, Homo sapiens; identical to SEQ ID NO: 3366
  misc_feature 1..45: note = chr8:121137638-121137683
  misc_feature 1..45: note = hyper
  source 1..45: mol_type = genomic DNA

SEQ ID NO: 9753 - DNA, 30 bp, Homo sapiens
  misc_feature 1..30: note = chr8:122652164-122652194
  misc_feature 1..30: note = hyper
  source 1..30: mol_type = genomic DNA
ccccagatctcccaccgggcagtgtcccca

SEQ ID NO: 9754 - DNA, 323 bp, Homo sapiens
  misc_feature 1..323: note = chr8:124173095-124173418
  misc_feature 1..323: note = hyper
  source 1..323: mol_type = genomic DNA
gaccttctgagccttcgagtggaatgaaactcgaacggcttcccagctgcggcgatgaggtcccgctcctgcagaatcccggcaggagcggagactcgggaggggaccgctggctgcaggcgccctgctggagtccggaacgagggtggtcagggtcgcctccccacggggtcgcagatgagggagtggggccgcgcagggaggctcctgcaggccgtgacccccaggcctggcccgtagagagtgactgatggcgaggacccgctggggacccgagggcctcagcctgcgcctgcgccggggctccccgaccaagaccttcc

SEQ ID NO: 9755 - DNA, 33 bp, Homo sapiens
  misc_feature 1..33: note = chr8:131455313-131455346
  misc_feature 1..33: note = hyper
  source 1..33: mol_type = genomic DNA
gggagggcgccccatcggcggggtccgggccgc

SEQ ID NO: 9756 - DNA, 102 bp, Homo sapiens
  misc_feature 1..102: note = chr8:131455680-131455782
  misc_feature 1..102: note = hyper
  source 1..102: mol_type = genomic DNA
cgcgcccgagcgccccgcaactcaccgggacctggcgggccgctgggcattattccatcgcgggttcggccgggcgctcgcggctctcgggtgggaaagcga

SEQ ID NO: 9757 - DNA, 295 bp, Homo sapiens; identical to SEQ ID NO: 3367
  misc_feature 1..295: note = chr8:132052005-132052300
  misc_feature 1..295: note = hyper
  source 1..295: mol_type = genomic DNA

SEQ ID NO: 9758 - DNA, 118 bp, Homo sapiens; identical to SEQ ID NO: 3368
  misc_feature 1..118: note = chr8:132052398-132052516
  misc_feature 1..118: note = hyper
  source 1..118: mol_type = genomic DNA

SEQ ID NO: 9759 - DNA, 367 bp, Homo sapiens; identical to SEQ ID NO: 3369
  misc_feature 1..367: note = chr8:132052589-132052956
  misc_feature 1..367: note = hyper
  source 1..367: mol_type = genomic DNA

SEQ ID NO: 9760 - DNA, 30 bp, Homo sapiens
  misc_feature 1..30: note = chr8:132053488-132053518
  misc_feature 1..30: note = hyper
  source 1..30: mol_type = genomic DNA
tcatcccctttatttcgttctttggagtcc

SEQ ID NO: 9761 - DNA, 777 bp, Homo sapiens; identical to SEQ ID NO: 838
  misc_feature 1..777: note = chr8:132053807-132054584
  misc_feature 1..777: note = hyper
  source 1..777: mol_type = genomic DNA

SEQ ID NO: 9762 - DNA, 164 bp, Homo sapiens; identical to SEQ ID NO: 839
  misc_feature 1..164: note = chr8:132054593-132054757
  misc_feature 1..164: note = hyper
  source 1..164: mol_type = genomic DNA

SEQ ID NO: 9763 - DNA, 257 bp, Homo sapiens
  misc_feature 1..257: note = chr8:133492359-133492616
  misc_feature 1..257: note = hyper
  source 1..257: mol_type = genomic DNA
ccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgcca

SEQ ID NO: 9764 - DNA, 41 bp, Homo sapiens
  misc_feature 1..41: note = chr8:133493711-133493752
  misc_feature 1..41: note = hyper
  source 1..41: mol_type = genomic DNA
taaaagccaagttgtcgggttggtcaaggccgggcgcaccg

(The sequence listing continues in the following parts.)

What is claimed is:

1. A mixture for processing cell-free DNA fragments, the mixture comprising (a) converted cell-free DNA (cfDNA) molecules or amplification products thereof; and (b) a panel of different oligonucleotide probes configured to hybridize to converted cell-free DNA fragments derived from at least 500 target genomic regions;
   wherein the converted cfDNA molecules comprise deaminated nucleotides obtained by treating cfDNA molecules with a deaminating agent;
   wherein each target genomic region of the at least 500 target genomic regions has an anomalous methylation pattern in cancerous samples; and
   wherein each of the at least 500 target genomic regions comprises a sequence with complementarity to at least a pair of probes in the panel, wherein each probe of a pair has a first portion and a second portion, wherein the first portions of a probe pair are complementary to the same sequence of at least 25 nucleotides in length, and wherein the second portions of a probe pair are complementary to different sequences at different ends of the sequence complementary to the respective first portions.

2. The mixture of claim 1, wherein each of the at least 500 target genomic regions is determined to be anomalously methylated in cancer training samples based on criteria comprising a number of cancer samples that comprise an anomalously methylated cfDNA fragment that overlaps the target genomic region, and wherein the target genomic region is determined to be anomalously methylated in cancer training samples relative to non-cancer training samples based on criteria comprising $N_{cancer}$ and $N_{non-cancer}$, wherein:

$N_{cancer}$, for each CpG, site is a number of cancer samples that include a cfDNA fragment covering the CpG site in the cfDNA fragment that (1) has at least 4 CpG sites, wherein at least 70% of the CpG sites are methylated or unmethylated and (2) has a p-value rarity in non-cancerous samples of below a threshold value; and $N_{non-cancer}$, for each CpG, site is a number of non-cancer samples that include a cfDNA fragment covering the CpG site in the cfDNA fragment that (1) has at least 4 CpG sites, wherein at least 70% of the sites are methylated or unmethylated and (2) has a p-value rarity in non-cancerous samples of below a threshold value.

3. The mixture of claim 2, wherein each of the at least 500 target genomic regions is determined to be anomalously methylated based on criteria positively correlated with $N_{cancer}$ and negatively correlated with $N_{non-cancer}$.

4. The mixture of claim 2, wherein each of the at least 500 target genomic regions is determined to be anomalously methylated based on a score, wherein the score is calculated as $(N_{cancer}+1)/(N_{cancer}+N_{non-cancer}+2)$.

5. The mixture of claim 1, wherein the at least 500 target genomic regions comprise all genomic regions identified in List 1.

6. The mixture of claim 1, wherein the at least 500 target genomic regions comprise at least 500 of genomic regions identified in List 1.

7. The mixture of claim 1, wherein the at least 500 target genomic regions comprise at least 500 of genomic regions identified in List 2.

8. The mixture of claim 1, wherein the at least 500 target genomic regions comprise at least 500 of genomic regions identified in List 3.

9. The mixture of claim 1, wherein the at least 500 target genomic regions comprise at least 500 of genomic regions identified in List 5.

10. The mixture of claim 1, wherein the at least 500 target genomic regions comprise at least 500 of genomic regions identified in List 8.

11. The mixture of claim 1, wherein the at least 500 target genomic regions comprise at least 500 genomic regions identified in List 4.

12. The mixture of claim 1, wherein the at least 500 target genomic regions comprise at least 500 genomic regions identified in List 6.

13. The mixture of claim 1, wherein for each probe of the pairs of probes, the first portion is at least 30 nucleotides in length, and the second portion is at least 15 nucleotides in length.

14. The mixture of claim 1, wherein for each probe of the pairs of probes, the second portion is at least 50 nucleotides in length.

15. The mixture of claim 14, wherein for each probe of the pairs of probes, the first portion and second portion together are at least 65 nucleotides in length.

16. The mixture of claim 14, wherein each probe of the pairs of probes is less than 300 nucleotides in length.

17. The mixture of claim 1, wherein the target genomic regions are human genomic regions, and further wherein at least one probe for each of the at least 500 target genomic regions (a) comprises a length of at least 45 bases, and (b) does not comprise a contiguous 45 bases with at least 90% sequence complementarity to 20 off-target regions in a GRCh37/hg19 genome.

18. The mixture of claim 1, wherein each of the oligonucleotide probes in the panel is conjugated to an affinity moiety, wherein the affinity moiety is not a nucleic acid.

19. The mixture of claim 1, wherein the mixture comprises the converted cfDNA.

* * * * *